United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 7

SEQ ID NO: 30322 - DNA, 462 bp, Glycine max
  Peptide Sequence Number=SeqID_122007
atgccaatctccccctgcaaaagtatcagttggtctgtgtcgtcccaacatggggatcgcacccgagagacacccagtggacccggaaaagtccaacagggccctggggtttccagctttggttacgggctctatcagtcctacagggtgctcgtacccccccgacaaggtcacatcatcatagggatcgcgcctgcaagacacccggtggacccgaagaagtccaacagggtcttggagttgtcaagctctaattacgggtctctgtcagttctacagagtacctataacccccagcaagttcatcaggcccctattaatcaggctttcatcaagaagtactgcgtctacaggcaggcgcagggcgaaacaccacagcagcctggggatggccggcagcgggcaacagacgcgccgccatcacctctagagttcacctcagctcatccacaaaaaggttag

SEQ ID NO: 30323 - DNA, 440 bp, Glycine max
  Peptide Sequence Number=SeqID_122008
atggccagaacacgaggtttaggtcgtgccataggtagagttgtaggcagagatagagctgctgacgaggatgctggcgatgttcccgagaggcgtaggcctactgcctcagccccctatgaagcacctgagatgcttgcggatgcacagggagctgatcgtgctgacggatcaggtggtgatgatgctgcagagggattccctggtggtccacgtgacctgtcagtgctcacatcatttgtcgagcatgttgcacatgccgtgtggagtggacaagaacgtcctgatttgaagttagtgtcacatgggaggaaggtgacactgattgggaggccagtgcctgagattgaaggcctggtggctgccacaggattaagtccactgatagattgttcagttattactggcgatcctggacttatatccgcatttgtggagag

SEQ ID NO: 30324 - DNA, 551 bp, Glycine max
  Peptide Sequence Number=SeqID_122009
catttctccgtggactccctctttgggcagcttgtctgtccgatgcagcggtaatgatggcccgagttatgttggggaacggttatgaacccgggatgggtttaggaaaaaacaacggcggcataactagcctgataaatacccaaggaaatcgtgggaagtatggtttaggctataagcccactcaggcggacatgaaaagaagcatcgcgggaaggaagaacaatggtcaaagttcgcgttggagacaagaaggtgaaggaagcccgccctgccacataagtagaagctttataagcgcgggttcgggagacaaagctgggaaattggcagagtggaggaatcgccccggcatttacgcaacaagcataatatccgatgacgagtcccccgaaggtactaatacctgggacccgtctatcgacttcgagcaagaaatgaatcaaacggaagatgaaggaaatgaggatgtgggacttcccccagaactagaaagaatggtcgcccatgaggaccaagaaatggggcctcatcaagaagaaacagagcta

SEQ ID NO: 30325 - DNA, 98 bp, Glycine max
  Peptide Sequence Number=SeqID_122010
atggctgtcatgtgccttatcttagaagctcaagcagaagctcgtttactatgtttctcatacgaactcctgtctccggctattggggatcctattcc

SEQ ID NO: 30326 - DNA, 483 bp, Glycine max
  Peptide Sequence Number=SeqID_122011
atgtgggctttccttaccggtcgtcagatcgactgggcccatttggttcggtaccgaatgcataaggcattacgggccaatgcaccttttccttaccctcatttgataactttgtttctgcgtcattttcaaattccgcttgatgatgaaccatttgttcaagtcaagtgttcctttgcaattagtgctggtgcaatgacttcctttggataccgtaaggatcggaatggtcaatggctaaagaaagacgcactccctcctcaagatgagcgtactccttcacctccgcctcagcgagatgattcagcactcatgaatgaagtccttaccaaattacgaggtcttcgttcttatgttggtgaccgtttcgactcattggatacacgttttgccggcatggatattcgtctcacacagcttgaagaggatgtaggttacattcgtcagagtttcgatcttccaccaccaccaccaccttcttag

SEQ ID NO: 30327 - DNA, 554 bp, Glycine max
  Peptide Sequence Number=SeqID_122012
atggaagtgaaggacaaggttgaactccttccttatagggaccgagatgacctagtccaactttgcataaaggtagagcaacaacttaaatggaagcctcactcttatccaaagaaagaccaaggtcaaggcatcttaggggttgcaccttctaagcccaaagataataaggggaagaatataaaaggaaaagaagaacaacctttaatggttaaggaggagtgtaaggaactaagtgtctcctccaagaggttagctaagaaggaaagtcattttgaaataaagacaaacattaaagaaacttcccttcttagacaacctctgcatcttctcctttgtaaaagagcacttcttagcactgccatacctcttgagcttgatattattcctcaagtaaaggagttgttggatgagagtttgttttgtattataaggcaacaaatccctatgataggtggtatgatgaatgtgttgagtggtgcaaccctcttttgtaaaatcacccatgcatccaacatcttcatgattcacatacatagagactcattaggtag

SEQ ID NO: 30328 - DNA, 300 bp, Glycine max
  Peptide Sequence Number=SeqID_122013
atggagcccaatgtggttatagttgccgctactggcgctgtcgctaaacacactgaaattccccaccataatctagccgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcaggccattgaaggaggtgaagattatgcctttgctaacctag

SEQ ID NO: 30329 - DNA, 180 bp, Glycine max
  Peptide Sequence Number=SeqID_122014
atgacgggagatgtatccaagtttacaaccatttcccccaagaaaagtggacaagttacatacggcgacaacaacaaaggcaaaatcattggagtcagcaaaatagaggatataaagtatcttttgattttgaaaaatgtgttatcaagcatgagcatgacaaggacattgagcatatag

SEQ ID NO: 30330 - DNA, 342 bp, Glycine max
  Peptide Sequence Number=SeqID_122015
atgagtcttcattcttcatctagtgttaatggtgagggttctactcttaaggatccctttagtcatgactcttgcaaaagtttaagtgaagaacttagcgactattatagagggtgccatagttcacatactgaacatcactcccaaagaagagaaaaggaaagaaagcctcaagaggctaacattaacctcccatactttcatgggaaggacaatgtagaggctaacttagattgggaaataagggtggagcaacaacttaaaaggaaatctacttcaaaatcttatggctctcactcttatccaaagaaagaccaaggtcaaggcatcttagagaggtga

SEQ ID NO: 30331 - DNA, 213 bp, Glycine max
  Peptide Sequence Number=SeqID_122016
atgaagctcttaaggtggttgaccccttgcttcttgactaaattcttcaagggatggcaccaatcttcctttccaattttctatatgccaactcacaaacaaggaaacaaagagacaagcaataaccaaagaccaaaaaatgaaatgaaagctaaaccaatagagtttgaacaagacaaattttcaagtattattcaacaattaaagcaatga

SEQ ID NO: 30332 - DNA, 285 bp, Glycine max
  Peptide Sequence Number=SeqID_122017
atggcacgcaaagacaaattatggtcattctgcagccttttgtcatccagaggcggcgggctcgatgacatgcggagacaaattatggtcattccgcacccctttgccattcagacacagtcgtgtccgatggcacgcagagacaaattatggtcattctgcacccttttgtcatctagaggcggcgggcccgatgacatgcggagacattatggcattccgcacccctttacacagatcgtgtcatacgcagagacaaattatggtcattctgcacccttttga

SEQ ID NO: 30333 - DNA, 345 bp, Glycine max
  Peptide Sequence Number=SeqID_122018
atggagatgggaggagatctccatgactacatcaacaagttcaatcagctagtaagtcaattgttgaatgtagatgataaactctcttatgaggagcaggtgttgttgttgttggcctcactaccaaggtccttcaaagccttggttcaaacgttgtttgtaggaatatcaactttgaatttggatgaggtgactgcaactcttagagaaaatcagagaataatgagaactggaaatgttgatgatgaacaccatgcaatagctatggtggagtctgagagatggaggaatcattcaaggagatatgatggtccaagaggaacatcaaaatcggggatcctctag

SEQ ID NO: 30334 - DNA, 162 bp, Glycine max
  Peptide Sequence Number=SeqID_122019
atggcacgcagcgtgttcgctccgtgcccctatttaaaggacctacaagggagagaactaactagaggtattatcctcttcgaagaacatattgcagcagtagggactactagcaacaataagttttcaaagagaaaagctctagatgagggttcactgtaa

SEQ ID NO: 30335 - DNA, 398 bp, Glycine max
  Peptide Sequence Number=SeqID_122020
atggcaaggaagttggagttcatttatcaaaatcgtgtggggtggatccctaatgtccgatcatccattgatatcattttgggcactacgggggatctaggcgcgcaaagtctcaaggtgatacaaagagtccataaggcgtggagaagtcgattgaggaaagacaaggagcttagaggcatccaaaatggcgtcatcggtggttatcgtggatggctaagagttcacacgcgagggttagattggctctccaaattgaaagttatcaatgaggagaacttcgaagctccggaggaagatgaagaagtccaagctctaaaattagagctagggaaggcaagactcgcgaaggagaagttcaaatcagccgctacacacatccggaaagagtataccga

SEQ ID NO: 30336 - DNA, 1083 bp, Glycine max
  Peptide Sequence Number=SeqID_122021
atgtcaatccttaccctcgaaagcaaaaaaaggaaagaaggaaaatttccaatcaaagagaaagcaaaaagaaaagaaaggaaaattcccaatcaaagagtgggagaaagcgaaaagaaaagaaaggaaattcccaatcaaagaatgggagaaattggaagttttatctcttcactaaagcacgttcgcattttagcgaagaaaaacatcgaggttatttctagtctcacaagttatccagaacaacgtaggtctgagttcctcattggaggatacgtaggagcaagagcctcgcttttgtcgaccacaccaccttttgttgccatgacccaagagctggtaacccgcggagacaccttacagttatccgcacctcgtcattcagtgaccccaagtgtgattgatgagcagaggccaatgtggtcatctgcgccctttccggagatgtcagcatcttccggtggagactttttcaagtctcacaaacacagtcgtgtccgatggcacgcagagacaaattatggtcattctgcacccttttgtcatccagaggcggcgggcccgatgacatgcggagacaaaatttggtcattccgcacccctttgccattcagacatagtcgtgtccgatggcacgcagagacaaattatggtcattttgcacccttttgtcatccagaggcggcgggcccgatgacatgcggagacaaaatttggtcattctgcacccctttgacattcagacacagtcgtgtccgatggcacgcagagacaaattatggtcattctgcacccttttgtcatccagaggcggcgggcccgatgacatgcggagacaaaatttggtcattccgcacccctttgccattcagacacagtcgtgttcgatggcacgcagagacaaattatggtcattctgcacccttttgtcatccagaggcggcgggcccgatgacgtgcggagacaaaattttgtcattccgcacccctttgtcattcagacacagttgtgtccgatggcacgcagagacaaattatggtcattctgcacccttcgtcaatcgcggccgacaagcccgttga

SEQ ID NO: 30337 - DNA, 195 bp, Glycine max
  Peptide Sequence Number=SeqID_122022
atggatctagaaggaaaaggtagaggaatctattttggaactatcatcaattttggcaccagcatctgtgagctttggaagctctttgccactcctcaaggttttgatgatgccaagacaaaagcaacacaagttttatttcaagtccaaatcaagaccaagaaaacaaagatcaagaagaaagctaagtcttag

SEQ ID NO: 30338 - DNA, 276 bp, Glycine max
  Peptide Sequence Number=SeqID_122023
atgtcaggatttacacacgattctcctcaaatttcagccagcccgcatcaattagaccttgcaccttacgcttcaaagccctacaatgctcaatggaacaccccagggcttctccgtgacatgcacacgttgcgttcgagtcgtattctcggagaaatggaggttgatgaaccttggctagggttatggctaccattgaattatcaagtggtgttcgtcattggaagtgcggtagacagactttgtggtagatttagggatggcctttgtggataa

SEQ ID NO: 30339 - DNA, 483 bp, Glycine max
  Peptide Sequence Number=SeqID_122024
atgtggcaagaatatgaaggagatcagtggggtcttgatccaaggagaaagaggactacaaagggtcgtctcgtttcaacttgcattcctactgagatgggcgaagaagagaatgaacgggaaaatataaaaaaatgcagaatttgcctgacaacatgctttgcgacttctttggccacgttcatttacaaagattttacacttgctttatctctggtgagacctttgcctctttttataagcgatgctaaattattgagaaaacaaactgcattgaccaagtacaagaatggaagggtatctaaagtcttcatcattgctgaaaaagataatatacaaacagaggactttcaaaggtggataattgaaggcactggtccatatgctgatgtaaaagtgataaaggattcagatcatatggtcatgttttccagaccaaaaaagcttagctttgaactattaaagattgcttatgaatattaa

SEQ ID NO: 30340 - DNA, 711 bp, Glycine max
  Peptide Sequence Number=SeqID_122025
atggcccgcacaaagaagacaggggagatgacgactgagaccgcaaaggaaatcgctaagaagattgtaagtcatggtcaactaaccattactattatgtttcaatattttgagaatgccatgtaccactgccacataggtatcgttcgtcccccatggacgtcaggatgttctcgccgctgctattggacgtcgcgtccagagcaccctggacgtgtccgtgctgctggagccggtgtcaccatcaagcaatactttggatcggctccacggacatcccgcaatgcttcctccctgcctcctaacgaattacagcagttgacccagcagatcagggaccggctagaggagtccatcacagagaaagtgacgaggcaggtcatggcatcctttagccagcttcagtcgcagatgcaatctcagggacttgcagtgcctcctgagcctctggttggtccctccggtcctcaagtgagcacaaaggggagttgtgctgatccctcaggaaacgatcctgagaccggtgactctgacaggtgtggcttgtacatagaagcagatcctgccggcctagttgccatggggagagtttatgagggattcactgttgttcataacactcctttgttgcctggccaagtaaaggtgagtgtggaggaggttacagatgcagatgctccagttcctgtacccattgatgaggtttcctaa

SEQ ID NO: 30341 - DNA, 402 bp, Glycine max
  Peptide Sequence Number=SeqID_122026
atggcttacacggccaaagataacgcggaacaaattaaagatgcggctgccgataaagcgcgggccattaagcaagaagcggataagcagatcgacgacatcaaaacgcaggccaataatgaagcggatagcctgaaaacccaggccagcagtattaaatctgaagccgacaagaaggccgacgcgattgcccaggatgcgaaaaataaagcggatgcggtaaaacaggatgcgcagcaaaaaagcgatgcgatcatgaaagaggcgggaaaaattaaagataacgctatcgttgaagccaaccagctttccgccgatgccgccaataaaaccaaagaaataaaagagagtatcgcgccggagcaagcgccagcacagcaggcgccggccggccaacagtaa

SEQ ID NO: 30342 - DNA, 255 bp, Glycine max
  Peptide Sequence Number=SeqID_122027
atgggggtgcaaatagcacccaggcccatttgggccctccagaagattcctccaaaattctcttccggtgcttcaaaattctcttccccagtggagtcgccaactgtcgtaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagttga

SEQ ID NO: 30343 - DNA, 273 bp, Glycine max
  Peptide Sequence Number=SeqID_122028
atgaaggacaagtatattgttctaagattgttaaagaacttaaacaaaatcaagaacaagcttgttcgcacatcgttcgcgtgtatgatatccactcgacaagctattcctccttctaatgacgcatggacacttatccctgacccaactacaattcgtgcgaaaggtcggccaaaatcaacaaggataaggaatgagatggattgggtcgaaccatctgagcatcgacaaaaatttagtagatgtgaagcagaagggcataacaagcgttga

SEQ ID NO: 30344 - DNA, 410 bp, Glycine max
  Peptide Sequence Number=SeqID_122029
ggattgtgcccgcaagacacctagtggacccgaagaaggccaacagggtcttggagttgccagctctaaatacgggtctctgtcagttctacggagtacctgtcacctccagcaagggcatcaggccccctactaatcgagctttcatcaagaagtactgcgcccccaggcaggcgcaggggcgaaacaccacagcagcattggggtggccggtagcgggcaatagacacaccgccaccacctctaaagttcacctcagctcatccgcaaaaaggttagagcgttgcctacgacacatggccgaccagcagggcgaccaagtccaaagccaaaggacgcacctagttgctcatgatcctggggatttaaataaaacaagcgcaagctcggaaggtagagagataccttag

SEQ ID NO: 30345 - DNA, 324 bp, Glycine max
  Peptide Sequence Number=SeqID_122030
atggcataccatgccaactcaaaagctaatcaaaactcaatgaaaaatcatgaaattcattttgaaagaggatccaatctggataaactgttgatgcaattcatggaaacaactaaatcaactcaacaagcactccaaagtgtagaaatccaggttggtgagctggcagaagtagtaaatcaatttatgtccagaccagaaaaatcatttgtagaggctgaagctcaagagaaaagccctgtaaaagagcatgagtcaagagaaaaagatgaggagaaagatgttggatcaagtggcctcaaaataattaagaaggggggttga

SEQ ID NO: 30346 - DNA, 183 bp, Glycine max
  Peptide Sequence Number=SeqID_122031
aattttaaaaggttacagtttaaatctgatatagctgaaaccagaattaagaaacaaatagcagaattagcagacaccgaacctaagaaagcagaatcaccagacgaaggggcaaaaacggaagaatcaagaccaaaacggaccattaccaaaccttcttacctacgggacttcgtggaatga

SEQ ID NO: 30347 - DNA, 224 bp, Glycine max
  Peptide Sequence Number=SeqID_122032
atgacaagcagagaccaagtttggtcattctgcacccatgatacgcggagataccttatggttattcgcaccctttgtcatccagaggcggcgggcccgatgaacgacaagtcatggtcacccgcgactctcgatcaaccgagaggagcgaaattagtgtcatacactgattttcggggacctttgcttgatgacatgcgaccattctttgtcatccttgtgag

SEQ ID NO: 30348 - DNA, 1087 bp, Glycine max
  Peptide Sequence Number=SeqID_122033
tccttttgtacgtaaaatttccgtcatcttgctggaaaaggcgattcccttcgagtttgtgaacgaactcccctataacgacgtcaacggcgtggcgcagtacaacccgctgggtaaagtcccggcgctgctgaccgatgacggcgcgtgctggtttgattcgcccattattgcgcaatatctggaactgcttcttaacgtcgcgccggcgatgctgcccgcggaacctctggcggcgctgaagatacgccagctggaagccttatctgacggcatcatggaggcggcgatcgcgctggtgcgggaaaaagcgcgtccggcggcccagcagtcagaaaccgagctgctccgccagcgggaaaaaatcgctcgcggccttgatatgttggaagggtacgccgccgacggtaccttgcgtaatggtgaactgaatctggcgaccattactgccgcctgcgccattgcttatctgaatttccgtcgcgtggctcccggatggcgttacaatcgccactcattgttgactccctctcccgtcgggaggggggaaaataacttatcgtcaggttcactcatgtctaccgatactcgcgcgctttatacccggcttccggccattgatcgtttacttcgtgatcccgcttttgctttactgctcgatcgtcatggccattcgcaaatcgtggcgctgctgcgccagatgttggatgaggcgcgggagcatatccgccaggcgcaggcattgccagagtggtgcgacgactggccgcaagagaccgccagccggctgaatcttaaccagcagagcgcgctgcgtccggtattcaacctcacgggcaccgtgctgcacaccaatctggggcgcgcaatccaggcggaagccgcggtacaggcggtagcgcaggcgatgcgcgcgccggtcacgctggaatacgatctcgacgatgccgggcgcggtcatcgcgaccgggcgctggccgatctgctgtgccgcattaccggcgcggaagatgcctgtatcgtcaataacaacgcggcggcggtgctgctgatgctggcggcgacggccagcgggacagaagtggtg

SEQ ID NO: 30349 - DNA, 246 bp, Glycine max
  Peptide Sequence Number=SeqID_122034
atgtcaaaatgccctaggtgtggggtatcacggtacaaagtcaaggatgatgaggaatgtagtagtgatgaaaactcaaagaagggccccccagcgaaggtgtggtggtatctgcaattgttccaaggtttaagcgtcttttcgctaatggagacgatgctaaagaccttacatggcatgcaaatgggagaaactgtgatggaatggtccatcatccggctgattgcttccagtggaagaagatag

SEQ ID NO: 30350 - DNA, 414 bp, Glycine max
  Peptide Sequence Number=SeqID_122035
atggcctggaaacgagagctcacgcttgcggcgctgaacgccagtagcgaaaacaccatggtggcgcatctgggtattatctacacccggctggaggaggcgctgctggaggcggagatgccggtggatgcgcgcacgcatcagccgtttggtctgctgcacggcggcgcttccgcggcgctggcggagacgctgggctcgatggccggttggctgatgaccgaggatgggcaatgtgtggtgggcaccgagcttaacgctacccaccatcgtccggtctccagcggtaaagtgcgcggcgaatgccgaccgctgcatcttggccgccagagtcagagctgggaaattgtggtgtatgacgaaaaagggcggcgctgctgcacctgtcgtctgggaaccgcggtgcttggctaa

SEQ ID NO: 30351 - DNA, 501 bp, Glycine max
  Peptide Sequence Number=SeqID_122036
atgggtgttgcgcttagcggacgctcgctaagccagcagattggtttagcgagaagcgcgaggaagaatccagaagaagatgagctgtcaagtttgctaagcgcaccgctccaggtcatcaagcacaccatccaggtcatcaagcgcaccgcttcatctcatccgctaagcgaaacaagtgcgctaagccaaaatccacttatgcgcgctaagcgatccagatttgcgctaagcgcacgagcacaaacaaggaggtttccagattatggaaagctaaatcctctgttggatcatccctataggactaagttgttgtgctatcatgaggaatcggggtacaagaacttagttgtgtatgtgtgtcttaatatggtcttggttgagtttagtcttacaagaggaatctgcggacgaggcttgatcaggactaggctaggctaccatgaggaatcggggtctagcagtccaggagacaacataggaatgcatgagcattgttaa

SEQ ID NO: 30352 - DNA, 111 bp, Glycine max
  Peptide Sequence Number=SeqID_122037
atggcattctctgaagaactcgctaagctcgcctgctgtgctaagcgagttcattctttgaggataaacactcatcctcttgctgaactacctatggctaagcgaggttga

SEQ ID NO: 30353 - DNA, 798 bp, Glycine max
  Peptide Sequence Number=SeqID_122038
atgtggctcaaagggatgaagacccctatgtttctgtttggaaatcgcgatgaacatgctaagcacactgttgtgcttatcctgctaagtgcgcctgtggctaagcctaagggtcattttggtgaggctgagctaagtgcgccatgctgcgctaagcccaagctaagcgcgagtctgccttcaaattttgatgtagctattgtcaaggaattctatggaaacctctacgacccagaagacaagtcacctaagcaggtgaagatggacatgaatgtgggttacctcatctctcacgaaatctctattattccacagcatgactcctctaggcttggatttccaaccttaatcacagctttgtgtaaagctagaggagtcacatcagattctagatccttggagagcctcagccccgccattaacttggcgttcattaagaagaactgttggaatctggatgatccaacagtgacattcagagggccaaggaagagctcaggcctgccatctattatgagcacaaatgagttcttgactcatgtggcttggctaggagtccaaccttctccttctggagggggtgggacctccacagcccaagagcctgaggttgtagaggagcagataccagtagaggaggatgggcctactcctcctgagccctttgaatttgtttctgacttagtggtggctcaggaggaagtaccttcaccagagccatctcctggacctgttcctgaggacaccatgctagctgaggatacccagccatctgcaccaatattggagcatgagtag

SEQ ID NO: 30354 - DNA, 405 bp, Glycine max
  Peptide Sequence Number=SeqID_122039
atgacaaaggtgatgaacaaaaagctcaaagatcaaagaacaactcaagtgaatcaagaacaagtcaagagttcaagaatcaagaagaattcaagactcaagaagaaagtctacaatcaagaaccaagattcaagattcaagatctcaagaatcaagatcaagattcaagaatgaagaaaaggctcaatcaagataacctgagatctttgtctcaacacattggagggtacatcctttgtggtacaagtagagggtacatctacttgggtttgactgagaacaagagagggtacatctcttgtggatcagttctagtggagggtacatccactaggttcaaagagaacaagggagggtacatcccttgtggatctttacttgtaaaaggatttttacaaggttga

SEQ ID NO: 30355 - DNA, 261 bp, Glycine max
  Peptide Sequence Number=SeqID_122040
atgcctgaatatgcacgagctctagctattaagctagcagatcaggctgtgatagtcccttcgaacctgatcaagctcaccatttctgggctaagcgcacatcccacactaagcgcagctacagcgcgcagagaatctggcacaacaccaatatcaaggccgtgtgctaagcgtgagatcaatgtgctaagtgcagcgattgtcatcagccaggctcagcgcatgactgacgctaagctcaaatccactttctcacactaa

SEQ ID NO: 30356 - DNA, 603 bp, Glycine max
  Peptide Sequence Number=SeqID_122041
atggcagaatatagtgggtatccgcaacaagcgcttcaggatgtcgtcctcaaggttcttcacaaagcagacatttccatcaccgaagtggtaaactttggtcgggtgcaatgtctgaatgaaatccctttgctgggaagtaggcacatgcgtagagttggaagggctggctcccttgggatccatgctggaaattgctgcaggcagagtgagcttggatgccttctcaaatggctgagtagttctggtggtaccattagagccattatagcattaggggtagttcaacatattcagaagatggagtatgaacatactcgtactacatccattgagggtctccagtttcttctccatgtggatccaagcattgaaaacttggatgtgttgattggaaacagaggtttcttggtctacattagtggtggaatgaatggctacggagtgggagctggcgtcaaggacttgcgtcatgctcttgtcttcctcttttttggaaaaagaagaggggatcatagtttggtttgtcttctattggacaacaatgatttgcctttgactccttctgattggagtagtctatggattagtccgttaggctag

SEQ ID NO: 30357 - DNA, 951 bp, Glycine max
  Peptide Sequence Number=SeqID_122042
atggcgtcatcactaacaacaactctatcccagtcccaatcgctctatattaagccccgcctggcgccacggcctcctcatccccaattccgctctcttttcctaacctcaccggcggtggcgggtggtgttcgtgctgctgtcatgcctagaaggactgcggttatcgtgtcggcggcgacggcggagacgccgaagaagaagggcgagtcgaaagggttcgtggaagagatgaggtttgtggcgatgaggcttcacacgagggaccaggccagggagggcgagaaggaggtcaagcagcccgaggagaaagccgttaccaagtggaacccatccgtcgaagggtacctgaaatttcttgtggacagtaagctcgtttatgacacgctggagaaaatcgttcatgaggctcctcatcctttttgtgagtttcttcctagtcatgatatttttagtaataagcttttatttttgtgtgtttgtttctcttgggtcatagaccacgcgtcttccctccaacctactgatgctgaattcagaaacactggattggaaaggtctgcaagtttggtagaagatttggattggttcaaggagcaaggttataccattcctgaaccttcatctcctggtcttacctatgcacaatatcttaaggagttatctgtgaaggatcctcaagcattcatttgccacttttacaacatctactttgctcattcagctggtggtcgaatgattgggaaaaaggttgctgaaaagttacttaacaacaaggcattggagttctacaaatgggacggtgaccttccccagttgttgcagaatgtgagggacaagttgaataaggttgctgaaccttggactcgggaagaaaaggaccactgtctggaagaaacagaaaaatcattcaagctctctggagagattctccgtctgattttatcatga

SEQ ID NO: 30358 - DNA, 165 bp, Glycine max
  Peptide Sequence Number=SeqID_122043
atgacaaaggtgcataatgaccataatttgtctctgcgtgccatcggactcgatcgtctctggatggcgaaaagagattgtggggcgaccgacaaaagcgaggctcttgctcctacgtatcctcaatttgtgatgaggaactcagacctacgtagttctggataa

SEQ ID NO: 30359 - DNA, 465 bp, Glycine max
  Peptide Sequence Number=SeqID_122044
atgcattttcagacgaactcgctaagcgtgcctaccgcgctaagcgagttcatcttttggggaagaacattcatcttcctgaggagatacatgtggctaagcggggctaatttgctaacccaggtggcttggcctggagctcaactttcgattgtaagaactagtggaaggtttgtagctcagacacctcgtcaggaaggatccgacgagactgctgctcctcctaagcttacacctgcacatgttgaaccaatgccagctgatccacattctctagtggcagatccatcttctcccaaacttgaagtagctcccccatcttcacctattattatcatctctgaagactctacagagtcagcatctggagaagctgttgctctctctgattcccctgttttccatctgatagatgaggaggatgctcagactcaggatacacaggatctgtctcagggattttaa

SEQ ID NO: 30360 - DNA, 486 bp, Glycine max
  Peptide Sequence Number=SeqID_122045
gcttgcgatgcgatcaccgagaggttggagcgtcaccttagcctcgagatagtcacgccaggcacatcgacacatgtggtcatcaaagaatgcctcatgattacccgaagtgtcacccgggaccgcattgtgtacgtgaggtctcgaccattcgctaagcgtgccactcaatggctaagcgcgaggaagaattcagaagaagatgagctatcagtgatcgatacatgcgctaagcgcacgagcaccaacaaggccacttatttaagcctgaaatcaaatttgcaaagggagtttggagtttttcttgaagaagcctctacatgcacaagagtctggccttggcttgaagcttttgcatgtttaggaagttctagagagagaaaggttcaagttccaaagagttctgagagattttgctgtgtgaagatctgcagagatgcgagttcgaagcagaagccattcagagaacatgagatgagtttgtga

SEQ ID NO: 30361 - DNA, 330 bp, Glycine max
  Peptide Sequence Number=SeqID_122046
atggcagtagaaccaactgcacaattcttgtgtcccaagttcatcaaatttatgacatcagaagtgcatgaaattggaacaagcattactgatgcaagctccattggagcttgtaggcctaggatcttcttcatcaatggattcctttgcttcttggaagataaatggcagcggaatggagaaggaagcgagaggagatgccacttcaaggagaagatgagtctagaagaagctcaccaccataggaggccatggataagagcttggaggaagaaggagatgaatgaagggagagggagagaagagaacgaaattttgtgctctaaatga

SEQ ID NO: 30362 - DNA, 189 bp, Glycine max
  Peptide Sequence Number=SeqID_122047
atggacgaagatcaatggatgtatgatagtgtaatgtctgaagaagtttatatgaatgaccaaaatgaagatgaaggtggtgtcaatgaagaacatgttgattgttctaatgcgttcaatacttcttatgtgtttgctacctgtgatgatgatctgcattgggctcgatttgttgcttatgaaacttga

SEQ ID NO: 30363 - DNA, 633 bp, Glycine max
  Peptide Sequence Number=SeqID_122048
atgagtaatcgaggacttatgtctgctttcatggagaagtggtataaggaaactagtagtttccatttgctagtaggagaggtgactatcactttggatgatgtggcattgttgttccatcttcctattataggcacattctatacttttgagcctcttcatgtggatgatgccatgtttctcttagtcgaattacttgaagtcagtgctgaagacggaagagctaagacaatacaaagccatggggcatatgtacaactatcatggcttggaagctatgcatggggagctactgcactggtgcatatgtatgagaatttgaatgatacgtcaaagagcacgactaggcaacttgcaagatatatcacacttttacaggcatatcagatggggtccatctattgtcatacatcgaccgaaaatggtagtgcgacagtttggtgttcaccaaactacatggagtggttctacacgatatctcatcccttcatgagttcggcacagcctgaggatcctcctagacatccgcccatgcagcaccatgacacatttgttgaactagatgttgctcagcacccggtggcggcagtggttgtggacgaagaacctgaagatgcacacatgttgatgtag

SEQ ID NO: 30364 - DNA, 180 bp, Glycine max
  Peptide Sequence Number=SeqID_122049
atgggggttgcagtgaccatgatggatatccctgatgggggaaatagagtggggaaatacttgtacttgggggcatgtcactcaatttggaactcccttaagactcaggctgatcaccatggggggggggggggggagttacctgtgcatgataaggtgatctcaacagttgctacctag

SEQ ID NO: 30365 - DNA, 204 bp, Glycine max
  Peptide Sequence Number=SeqID_122050
tcaatcaggcattcttcgttatcaattgtggcatttttggtattctctagaactcctcctccggttgctttgttaggattccaaaacattagagagaaggagaagggattgaagcctccattccatgatcctacgtgcgatgcctctttctccgttcacaggaagtttttcataaatcccaacggtgaaggtgtgcggaattaa

SEQ ID NO: 30366 - DNA, 153 bp, Glycine max
  Peptide Sequence Number=SeqID_122051
atggaggagatacatggagaagaagatgaagaacaaggaaataaagccttggatcttcttcatcaatggagtcctttgcttcttgaagatcaatggcagcagaatggagaaggaggaaaggtgattggggatgccacttcaagaagaagatga

SEQ ID NO: 30367 - DNA, 486 bp, Glycine max
  Peptide Sequence Number=SeqID_122052
atggataagcgctcctgggtgcagggccaattgatcccctatgatgaggatgctatcaaccaattcccggggcatccgttggtcttagaggaggggcaacattgtgagtacaacaagagaagaagccaggtcttgggatttggtctctgccaattctatggggtaccggttacgcccacaaagctcatctggcctcccattaacaggtctttcattgagaagtactgcatgtcaaggcaagcacagcagccggggcaggaccagcagcagcagttggccgcgaacgcaccaccgccacctctacagcagccaccatctctaaacccttacccatggcctactcctgagttgttcaaggccacagttgcatggcttggggacaggcctaattttcaggcgggggcaggccccacagaggccccaggagatgaagacggagttgaggaagatgatgacatggcagatgtgatggatttcttcctttga

SEQ ID NO: 30368 - DNA, 459 bp, Glycine max
  Peptide Sequence Number=SeqID_122053
atggcacggcaagcttggtggagttcgctgagaatcgtggaaggtttgggtagggttacgagcctacacaggtggacaagaagagggtcgcctttgaaaggaaggagagaagcctggcccatctacaagggcaaggactacaagtggaaagggtccccatttgtcacatcagcaaaagctttgttggtgcaagatggatgcgctaggatcagatctgatgttgagtcctgtaagagtaacgataccgaggactcggacgtcgactttgagtgtccgataagtcaagcgaaaggggaagagaatgaagattgggggcttcccccggacttgagaggaatggtggagcaagaagaaaaggaagtgaagccacaccgagaggaaacaaaaattgtgaacttaggtgctaacagagaaagaaaagaggtcaaggtcgacacttgcatgtccataaatgtctga

SEQ ID NO: 30369 - DNA, 1062 bp, Glycine max
  Peptide Sequence Number=SeqID_122054
atgttcctcagcgtgaaaaacatgatttttcactgtgttttcaggctaagcgcatatggcatcaaagaagagaaagacacttgccacaccttcccagaggcttgggaattgtacacagacatagtggtgcctagaaagatacttccagagagcaatgtggtgatatgccacactgagttcaatgatttcaaagaagaacttaagagaagaaattggcatgaagagtttaccatctttgaagaaggcagcattgatgttgccattgtaaaagaattttatgctaacctctatgatccagaggataaatcaccaaagcaggaagaacctgactaccattgctttgacttggagcgtgctttctttctcaaacttggtccctacctcacacactttagatatcactctggacagggccaagttgatttatggaataattcagaggatggacatgaatatggatacttaatttctcatcaaatctctatgatcgcccaacacgactcctctaggcttgggtttccaaccttaatcactactttatgtaaagttagaggagtcacttctgattctaggatactggagagtctcagccccgttattaatttggcatatgtgaagaagaactgttggaatcttgatgatctaactgtgactttcagagggcctaggaaggccaaggggaagaaatatgagattctcccatcttctgaggttccccctaccacatcagctccttccacattagcaccaacttcttctaccccaactacttttgctccatcaccagctcagctaccagttttagctccttcttcttccggaccatcagatttttcttttacaccagagatgttacatgccatgatgcagagcctacaccgagggcatgaggaagtaccttcaccaaagcctattctagagccatcccctacacctatccctgaggataccctgccatccgcaccagcgttggagctagagcagcctattgttcaaaatccaccagctgctccggtgttggatcttactgagcatgcagaggatcacccacaggaggattga

SEQ ID NO: 30370 - DNA, 780 bp, Glycine max
  Peptide Sequence Number=SeqID_122055
atggagggcggcataggtcacatactaaacatcactcccaaagaagagaaaaggatagaaggccttaagatgttaacattagcctcccatatttccatggaaaaagataatgttgaggcctacctagattgggaaatgaaagttgaacaactctttgcttgtcatcatattagtgaagagagaaaagttccattggctacccttagcattcaagggtatgccctctattggtggacttcccttgttagggaaagaaggatttatgggtgtcagacccaaatttcgtctggggactatcattcatggatatttggattctcgctagccgaattgagttgttcgacaccagttaccgtgcaagatgaaagatcattcgatgttttggtcaagggtgcgaaagatactaaaagggatgggcaaaagggtctttttagggatttttctagacctcagcttgcccaggctagcctctggctcacctgggcccccccaaatggcttagggttgaagtccccaactcgtccaggcaagccaagtcacttcagagtgaagcatcagctcaacacacatctttctcgcgttagggctgaagtccccaacgccttaacaacctctttcgttctttggaggtcgatctgtggtcatgctgggtctccgactcgcttgataacagtgaagcctcatctagagtttttctcttttgatgatacattgtcgctggtagtccctaccaccacaatgtttgatatcaaagaggatgatatctctagaaacctttga

SEQ ID NO: 30371 - DNA, 501 bp, Glycine max
  Peptide Sequence Number=SeqID_122056
atgattatgagaggccaagacatttatagtaaccaagatgaggctactacttcaccttcctctagtgaaagtgaagaagcaaaaggggaagaatctagtgaagaaatctacccgcaagaagaaggacaaccattaatggttaaggaggagcgtaaggaggtaagtgtctcctccaagaggttagctaagaaggaaagtcattttacaataaacataaacattaaagaaacttcccctcttagacaacctccacattttctcctttgtaaaaagacacttgttagcattgccacacctcttgggcttgagtttattcctcaagtaaaggagttgttgggggttcccataaaccctaagagaataaaggtcattcctgagtggcccactccaccaagtgttgagggaagaagcctagagtttcaagaacctctagatttgaggtcaaatcctttgcaagggggagggaatgattcaatcctacccccaaagggcattggatag

SEQ ID NO: 30372 - DNA, 258 bp, Glycine max
  Peptide Sequence Number=SeqID_122057
atgtcttcttcccttagcactggttatcgcgataagaaagaggagcctggcggttctggaagtattgtggaggttaatccttatctttcaaaagtggaggagctaaagcataaggttatagcaattgaacaaaaacttgcattacatgaggaaagaatttgtctcttgaagaagatgcttggaaatgaagaggctcaatcttgggcatatgccaatggtgttaagaactacataaataaatggcaaagcaatagatga

SEQ ID NO: 30373 - DNA, 1512 bp, Glycine max
  Peptide Sequence Number=SeqID_122058
atggccaaaatacacgagcaatgtgtccattctgcagttcaggtgaggagagcgctgtccacctattttttcattgtagaaggatatccaatgtgtccattctgcagttcagctgaggagagcgctgtccacctattttttcattgtagaaggataatcccgctatggtgggaatcattatcatgggtgaagttagtgggggctttcccaaatcatccaaggcaacacttcctccaacacatatatggagtgacagagggaatgagagcaagtagatggaaatggtggtggttagcattgacatggagtatttggaagcaaaggaataatatgatcttctccaatgggacttttaatgccaacagaatactagatgaagctattttcttaacatggacatggctcacgcagttggagaaagattttagtattcactacaaccactgttcttatgggcagaacctagaaactagcacatttattggagaaacatcatttgctattgtcattgccatcttgggtcttgtattgttttcccatttgattgggaacatgcagacatatttgcaatcaattactataaggcttgaggagtggaggcttaagcaaagagacacagaggagtggatgaggcatcgccaactccctgaagatttgagaagtcgtgttagacgatttgttcaatataaatggcttgctacgcgtggagttgatgaggaaatcattttacgtgcattgcctgctgatcttcgccgtgatatccaatgccatttgtgcttaaaccttgttagacgagttcccttcttctcacagatggatgatcaacttctggatgcaatatgtgagcggctggtatcgtctctgagcactcaaggaacctacattgttcgtgagggtgaccccgtgactgaaatgctttttatcattagaggtagactggatagttctactacaaatggtggccgtagtggtttcttcaactcaatcatactgagacctggagatttttgtggggaggaactactttcttgggctttactcccaaaatcaactattaatttgccttcttcaactaggacagttaaagccctaagtgaggttgaagcttttgctctacgggctgaagacctcaagtttgttgctaatcaatttaggcgccttcacagtaagaagctgcagcacacttttcgattttattcccaccattggaggacttgggcagcctgctttatacaggctgcttggcgccgatataagaaaaggattactatgaaagatctcagtttgagggaatctattcctttagatgaaacagtagctagtgagagagaacatgaggactatgctgctggttcaaattcaactcgggctaaattaaaccttggggctacaattcttgcttcgagatttgctgctaacacaagaagaggagctctaaagattaaagatgacatgccccagttacagaagcctgaagaacctgacttttccactgaagctgatgatgattag

SEQ ID NO: 30374 - DNA, 432 bp, Glycine max
  Peptide Sequence Number=SeqID_122059
atgactggtccttgtcctagactagtttctattgtccctatcaaagaatcttcgaatttgttgtgcctaatatctctaaggcacatcaagactgtgacatctatacccatgtctactaaagtcatccatgttttggctaatttcttcgaagcagacctcttcaccaaagagattgtgtttggggtgacctcatgggtctggttgtcttgctctgtgagcaggttgaggcattttggatcggatgaggacggagagcttagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30375 - DNA, 921 bp, Glycine max
  Peptide Sequence Number=SeqID_122060
atgctcattgaaaccttagaagaaaaagtatcttcagaggaaaacctcaaccaaatccaacaagatgatcaagtatcgtctttggaagatgacgagatccaagaggtcaacactttgacaaaagagcaggatattttgtttgaagcaataaattccatacatgaccctcaggaaaataaggttttcttgaataaacttaagaaatctttggaagctaaacccaaacaaaaagaatttattactaacaccaaatttaatgttagtaatatgctcaaaagattggaaaatactcttgtcaaaccaaccactatccaagatcttcaaactaagattaagaaccttaagcaagaagttaaagagctcaggaaacaacaagacattcatcagatcattctatctcaatttgaagaacatagtaattcagacaatgaaattaaaggagaagaagatgaatgtcaagatgatgaaatcttcatgggattaatcaacaaggttaaaatccagaagttctataagaacgaagttatcctaggaacaccctttatcaaagctctattccctctccagatatccaaggaaggaataaccacttggcacttgggaaagaaaattacctttgatttctccaccaaaccaattacaaaaaacataaacctcataaaaaagaagatcaaccagatcaatttcttgaaggatgaagtttcctttaacaatatccaaacccaattggaaaaacctcaaatgaaagaaaaaatacattctctgttaaaacatatccaatcaacgatgtgttccaatttgccatatgcattttggaatcggaagaagcatatagtcaacctcctttatgagaaagactttaggggaaaacatattcctacaaaagccagaacaatacagatgaatgaagaacttttttaa

SEQ ID NO: 30376 - DNA, 1704 bp, Glycine max
  Peptide Sequence Number=SeqID_122061
atggctagttttaaaaacaaagaacctgaaaggtttccggaatctgccaacaccttccttggcttctccttctccttcttggatttcaattcatttctgttgatggttcagctgatgaagaattctcggaagcccgaaacgtcttcgtgcggcgaccccgtgaagttggagatcgttgaggacccactggaagaagagcatgggcctcacaacaagcgctgcaaaccctctccctctccctcgcctcagcctcagcaatggagtgcttccgatgatggttctgtcagttctccatcccatctgaacatacttgacgagccgagcccgttgggtttgcgcctcaggaagagcccttcactgttggatttgattcagatgaagctttctcaaggaagtgcgcagccgagcgaagatttaagctctggagccaaaagggagagcagggctgctgctgtgtccggtgccggtggtgctgacaagctcaaagcttctaacttcccagcttcgctgctgaggattggttcgtgggagtataaatcaagatatgagggtgacttggtggcaaagtgttactttgctaaacataagcttgtttgggaagttctcgaaggtggtctaaagagtaaaatagaaattcaatggtcagatatcatggcacttaaggcacattgtcctgatgatgggcctagcacattgactgttgtgcttgctagacagcctctttacttcagggagactaatcctcagcctagaaagcatacactatggcaggcaacagcagattttaccgatggacagtctagtaaacataggctgcattttttgcaatgccctcaagggctgttggcaaaacattttgaaaagcttatccagtgtgacatgcgtcttaatttcttaagccaacagccagagataattttggattcaccacattttgacacacaaccttctgcttttgaggacccagacaatccaaaagatcgcgatcttcttcaagtcagtggtaaaggatcttccacgtcttgttttcaagatagtggatcacctcaggcatccctgttatcatcatttaagactgaacacaatgatcctcctggaatgatgttggatagtctcccccgagatgcaccttcacccagttcagttatggagtgtacttcaattgaagggagtacaagctctgaaactgattccaagggcccaagaaatggggatcagataaaacttcctggacttcgaccttctatgtcagtgagtgattttattggccaaattgaactctgcctgacagagcaaataacctccgggaatccaccattttctgatggaggatcggagtacaaggagatcctggaagacattgctcaacatcttctcaatgacaatcaggttgcagcaacttctgatgaaaaatcactcatgtcaagggtcaattctctctgctgtcttctgcagaaggaccccgttacagtgcagaattctcattttaccgaagatagtagtactgttgaaggacctcatgatggaaaagatgtcaagcctggtgcggaggaaccaaaggacacttctggtggcaagcaagcactaggcatgtctaggaaagactcgtttagtgatttgcttctccatcttcctagaatcacatctcttccaaagtttttgtttaacatatcagaagaggatgatgacagtcatgccaaatag

SEQ ID NO: 30377 - DNA, 492 bp, Glycine max
  misc_feature (81)..(81): n is a, c, g, or t
  Peptide Sequence Number=SeqID_122062
atgcggcagtttggatacacccaaaccattcctgctccgcctgttgattcatgggtgtcgtatgatgatatacacgatagntggatgcactattcggatcataaggttccagcaggtgaggtgtgcgttgtgcctggtcagtgtgccagcgactacatagactggttcttctgcatttcgcattctttcatgacaccaggccagcatcagatcctctgccagatggccccagagacagatatccctcacgtgccggagctaggagcaccatcgacatctgtgaggcccgctatggaggagcctagacatgcagtggaagtttgctatgggattgctgagaggttggagcgccatctgagcctaggggtagtcacgccaggctcatcaacacatgaggtgatcgaagaatgcctcaggatggtcagaagtgtcacacaggaccagctagtatatgttaggtctcgacgcaggcggtgcacggatcagacatag

SEQ ID NO: 30378 - DNA, 360 bp, Glycine max
  Peptide Sequence Number=SeqID_122063
atggtggtggcagcagctgctgaatatggtgaggctcgtagctgtcagggcctactggatcgaagaatacagtctttgacgcgagaatctttgtcaggcaaatgggtttttcttagcttatgtggtgattgtgaaggaggatgggattgcaatggaggttgcgggaagaggttcctcttcttcttcgttgaggagcttgccatcattgttgccgtgataggaggttgtcgtggtgcattgaggaggattctgcgaagagcaacgccgccgtccattgccgagggagctttgccaccgtccaccgttgaggtaagcgtcgcgaccatgtcgtttccaccattgttgccggcgatagggtag

SEQ ID NO: 30379 - DNA, 429 bp, Glycine max
  Peptide Sequence Number=SeqID_122064
atggaggagatgagggaatcaggcttggaagattgggttgaaatagaggactcatgtgactcgagcaagtttgatggcggcaaggtcagcttccatggcatcgagatgctgggatgtcatcctagtgcacatacaaggaaggggcgactctcaatgaaaagcaccaatgatatgagtagtatcaaagggctagaagtggaagtgtctgatgacatcatcgctgagcagattctagcaattcaacaaaggaagaaaaatggtattgttccttattggttgtttcttgatgcaagccttgaggacaaggctattgctgaaggagacagcaatgtcaggcctcccaaattatctagcccagttcagctcaattattggccgtgggtctggaagacatataatatgaaaagggtaattgggagcgagtgttag

SEQ ID NO: 30380 - DNA, 807 bp, Glycine max
  Peptide Sequence Number=SeqID_122065
atggcctccacttgtttagacccttctgtcactggaacaccccttatttgtactgaaaaacttagcgaaaaagttagccttcatggtctacaaagctatgtctatggaaccaaagtttttggtgaatctcaaagcattcaagacttgttccttttagaagaggcacaagctgttgtggaaaagttaaaaatgtttttagaaggtgactctatggaagaagtaaggaggaagaataataatttgtatatggtcatgattcctcgaggagcgaaccaagtttttaaccatattcatgttcaagttctaattgcacatgatgttccctcggtggaagatttagtcacccaactccttcatgtccctactcaaaaaaataaggttagttctcttgaggttcatgagttatctgctatggtatcctctagaggaagaggaagaggaggttatcaaagaaaagggggccaaggaaggggtagaaaaggcaagaacaataatctttggcgcaaccatttcaaaacctcaagtcatacacaagatctctgctatgatttaaatggttttcttgaaaagacaatccatgtgtctaaatttggaaaatctgagcaaactaatgatatttttgaagaaaagtatcaggagtacttactgttgaagacaaacaatcaagctcattcatcctccacaccaagtgtctcaacagcctgcatctctcaatttgtggaaggtcaaggtccatgggtaattgatttaggtgttttttatcacattgctgacaatgattctctattcccttttatgtcttcctga

SEQ ID NO: 30381 - DNA, 423 bp, Glycine max
  Peptide Sequence Number=SeqID_122066
atgacggtgaaggagtgggacttacagagctcgaatccatcgaggaggaacatcaagggaagcaatcacaacaagattggcttcagcgtcgagcatagccagcgatttgagaagcacgcgtatggctatgtagaattcgtagtcctcggcgtacctatgtacatcatcgtcgcgtatgcatttctttttccttctttcacaccagaaacacaccaaaaccccgataacattttcactggaggagaggggaatgagggcgaaggacgaatgtggagttggggggcggtggtggtaccagggagaaggtggagaaagtgtaatgggaagaggagagaagaggagaaggagaagacaactagcgagtggggagaggaacagacgccagttgggaaagaagaggaacggacgcgaggggcgctttaa

SEQ ID NO: 30382 - DNA, 150 bp, Glycine max
  Peptide Sequence Number=SeqID_122067
atggcattctcaggattaataagagctaggaaggttttgatgatgctaaaaagcaaaggacaaaaaggcaaaagcaaaaataacatgaagaatcttgaacacaaacaagtcaagcaattagacgattcaaaacttaggttaaattgttaa

SEQ ID NO: 30383 - DNA, 450 bp, Glycine max
  Peptide Sequence Number=SeqID_122068
atgaagtcaattacatggggaaccagcccagaaacaattttaatgcaggaggattttccagattctagcagtatcaacagaagagatagtggaaaaatcaccctggtttctatggctaaccagaagagcacaaagtctgccataaagaatctggatgtccaagtgggacaaatcgcaaaacagttggcggataggccgtcaagcagctttagtgctaacactgaaaaaaatccaaaggaagaatgtaaagctgtcatgacaaggagtagaatggcaacccatgtggatgaaagaaaagctgaaaagaagatggaggaacataaacaacagttggctggtgaactggcgctgaaaccggttgatgatttagttgaacttgaagaaattgttaaggaagtagaaggtgatgaagaaggagagacaccaataaaagattgcaagagaaaataa

SEQ ID NO: 30384 - DNA, 438 bp, Glycine max
  Peptide Sequence Number=SeqID_122069
atggtggccagagtcgttagagctaatgacaatgtaatccttttgggtgctggagaagatggttcacacgttaggatgaccactatttgttggctcttgcagctagagaagattgcttggatccgatcattttcgtggatccgtgacttaaagaggtgttgccaactattgtcaacacttgggctttgttgcacatgcttggagttggaattgtatttctgtgatggtatgaagaatagagttggtagagggtcgtggttggggcgagtgtgtgggagaaagatgaagggatgggtaattacaagaaaaattgttattatcgacataatattttccatggaatgtattccatcagaaatgtctgcattgttagagatagggggagcaacaacatggaacaacttaaggctaaagcttgaagcccaaggaaaattttga

SEQ ID NO: 30385 - DNA, 553 bp, Glycine max
  Peptide Sequence Number=SeqID_122070
atgagtgacagtgcgagcgagaccttgacagaggagaacttcgaccgacctcgagggagagacttacaatatcggtgtcagagcagagtgaatgagtgtgcgagggagggcatagtggttcgagagaggtcgagggagaatgagaacgaagaacagctgcaaagagctcaagttgcgatcaagggaattcaagattctcgtatgaatgcgaagatcaagttgtgggagtcttgtttctggttctttcgctacttcactgcaatcaagaacactcaagaaatcatgtcaaacacaatcaggattgagaaattcaatggaaagaacaacttcaatctatggcgcatcaagatgccttctttgttgaagaaacaacatgtttgggctcctgttgcttctgcatctgtgaagaaaccagtgacttctgattcaaaagaaaaggcatctgcttcaaagactgaagaactcacggaacaagaagaaaaggctcactcactaatcttgctttctatgtctgatgaagttttatatgaagttgctaatgaagaaactgcaa

SEQ ID NO: 30386 - DNA, 348 bp, Glycine max
  Peptide Sequence Number=SeqID_122071
atggatcaacttgaagatgtcattgcagaactcacctcatcccatctctccatgtccaccaaaattggtgatctcattcatcgtacggcccaattagagacaaaccagcacacccaacactcatgggcttcgtctgccactactcctcatacttccccaccatctgatactcaacatcgtttgaagctcgaagttccttgcttcgacggctctgatccgactgggtggatcttcaagatcacccaattctttgaatatcattccatcctagaccaagaacgtctcaccatttcctctttctacatggataccttagcctggtttcaatggatgtctaggaatgcttag

SEQ ID NO: 30387 - DNA, 531 bp, Glycine max
  Peptide Sequence Number=SeqID_122072
atggcgagttctcagacatacgtagaggaacagattagcttaggaaaaaaaatgcttgttgaagaaagcggtgggaacaagggcattacttacagcatctttgagttattggaaagcaagccttcactttttccggcactggttcgactcccttctcaaataccagatgaccaaggggtagcgatatggtctcacattaaccggagatgcgttgggtataagggtaatggtatggttggttgggcgagatggtgggaggagtatttctgggttaatgtgtttatggtggacatttgttgtggtgaggttgaaggcctaagggttttagccactgcataccaagtatcacatcaacgccacacagggaaagaacatgaaattcaacagggaaggaatgaccctgtatctgcaccgcaatgtcattacagagatggtgacattctagttcgtcaccatttccaactgttatgcgcaacaagtttgtgcttttcgtgtggaggcccaaagcttaaaccaaatggtgctgaatga

SEQ ID NO: 30388 - DNA, 399 bp, Glycine max
  Peptide Sequence Number=SeqID_122073
atgggttctccacctgcctccgctcctcctcctcctccttctacttcggacgcatcggcttcaccgtctgccgtgaagcggacacacaaagcctcacgtctacgatcgttgtccactagaccacctggtgctaagagaccagtggtgcatgttgatcctgctaccgggaaggccaacggtccccacaggaagaaattaagaacatatttggggattgtggcgcgtgataaggtggacatcacctacgagaattggaaggaggtccctactgctcagaaggacctaatttggaaggatattcaggcggaatttgatatcccaaaggcttctaacagatgtgcgcatgaaggcaaaggccatccagaagcagaatactggcccccacaagctcctggctga

SEQ ID NO: 30389 - DNA, 1431 bp, Glycine max
  Peptide Sequence Number=SeqID_122074
atgaggctgaaacatcacttcggaccaacgacgcaagtagcaaacaacattgtttccaagtacacaatctacccttcactgccttatttctttacagtcgttgtcgaaaatgatgaagaggtagttagggatacatcttctgctgcaaccttgaatgatgtggttgctgcaataaagcatttggctcaacaaatgcaaaacattgaaaacgagaacaaaaaaagactcgatgccattgacaagacaaaaacatcaatgctgaaggccatctgcacattggctaaacaagactacaaggactcaacaaaagatggtgacgaggatgtggcaatgagtgggactcatgacaatacttttgtctatcgccaaccattacattgtcaaaatgcgaataagagggtgtccaacccaactatgaaatgtaccacaaaccaagcatacgaaaaatcagatgcaactttgaacaatattgaaaccatctttatcccgggggacgatgatgatgatgagtttctaaggccgtcaaataggggaatgaaggccaaattcgtccatgacgaaaacactaccacctactcctctctgaaaacaatcaagttgtcaggacctgttagaacaaaggagaatgtggatgaaagtgaaacatttactaacaagatcaacccaagatcacaggctgaaactgttaaggactcctcaataccgcctagaaagttgtcattccccaatgataagtctgttagtgggagttcgaagaagcagaaaattgacaaccaagatcaacctacttggaatgcttcaagataccaatatagtaaaggaacttcattgggaaacatcaacaacaacaaggcaacctggatgtttcataggcctcggcccaattccagaaacaacttgggcacacaagcccactttcagtcgttgtgtcccaataagccaattagggaggagccaattaccgcactaggagtgtttggtgtatgccctcagcatttgcggtatgcaatacattatgtgctggatgtaattgatgggactctcgtggaaacagtcatgctgcattatggaaaggattggatgccttcatttgcaaacttaaagatggccaatgtgttgctgagtgttttggaaagtgtgtttgaaacacaagatttaatttttggatttgttggaatggataactgggatattgtggaacccaagggaattcctaattgtggatccagtgaaaagtcagcattatggatcctagaatggatgcaaatggaggattcattttttagtctcttgtatggagtgctagatgaaaaggccgtcagaatgaaggtgacaatgatcctgcttttagggacacacaaccagtacaaagcagagttgattacaaatgcaaagcgcacttggcatgactctattcatggaaaacattga

SEQ ID NO: 30390 - DNA, 1071 bp, Glycine max
  Peptide Sequence Number=SeqID_122075
atgtcaatgacactatttgtgaaaaatacggcatttgcaaggacaaatgagcccaattttgtcagagccacagagacccgtcatgggacgatgtgcggaaaaaggcacaggccatccataagcaaaacagggcccccccacgtgttgtctcgagggggttatgaattgttagaacagaagttgatggctgacaaaacaaataaaaaacaagaggaagttgctcaatccggaagcactaaagcgttgttcgatcctccatctcccatcagccgacacgattcgttggaggagcaggcgtcccaaggttcttttgtcccacatgggcgtcaggatgtcttaatcgctgccattgggcgaccagaacatggtggtcatgttcgtgctgttggggccggtgtcaccatcaagcatttctttggaccggctaaaaaaacctaccataattcttcctccattgatccaaaagaactagagcaactgactcaacaaatcagggaccaactagaggagtcgatcacagaaaaagtcacgcgacaggttggtccctccgttgctcttgtcaacactaaggagagttgtgttgaacactcagggaaccatccacagacgggtgactcagacaaatgtgggctatacattgaaggcaagccttcccgcctggtagccataggaagactttatgaggaatccacaacggttcacaacatggctttgttgcatgggcaagtcaaggttgttgttgaggagattatacatgcagatgctcctgtgcctgtacccattgaccagtttgttgtattcaacagtgcattgaaaggagttgatggtactccacaacctaaatcgaaggctgccggtcctacctggattgtcgttaaatgtaataaacaaaaaggaagtactgagtgtggctattacgtcatgcactggatgtcaactataatcttagcaagtttcaccaataattgggaaatgtattttaatgatgttagaccattggaatcatacacattgaaggcacttcgcatccagtgggcaaactattatttgatagttagaaatgaaacttag

SEQ ID NO: 30391 - DNA, 195 bp, Glycine max
  Peptide Sequence Number=SeqID_122076
atggcggtggctctgggacctgcagtccttggcagggaacaagatctgcgtggaccgcttcttgacatacattacatggcttgctacaacttatgcctttatataggttacatagataataagatatttttctacatccatcaagaagtttctacatactacaacatctccataggtgtcgaactctctagataa

SEQ ID NO: 30392 - DNA, 270 bp, Glycine max
  Peptide Sequence Number=SeqID_122077
atgatattggactgtatgatacctgcactctcagttgtcttcttaataagtggtgtgcattcttctgaagctcacatgttctggtggctatacagaaatccttatagagtggacaatccatccaagccaaggccaattattctctggttgcagggaggacctgacaatccagttggaactggttacagttttgtggaggattatgagtggctccctaatttttgctacaagtgttcttccttagtttcaaatttcaattttggtagatga

SEQ ID NO: 30393 - DNA, 549 bp, Glycine max
  Peptide Sequence Number=SeqID_122078
atggcgcaggccattaagaaacaaaacattgtccctcacgtgttgtctcgtggagagcaccctggtcgtttccgtgttgctggagatagtgtcacaatcaaacaatactttggatctgcttcaagaagctcccgcaagtctacgtccatggctcctgaagacctagagcaattgacacaaaaaatcagggaccagctggaggagtcgatcatagaaaaagtgactcaacaactaatgttgttcttcggccagatgcaatcacaagaacttgcattgcctcctgagcctaagattggtccttctgctgcttgtgttagcataaaaggaagttatgttgatacctcggggcaggaatcagacatgggtgactcaaagaaatatgagttgtatgttgatgacaatccttcccgcttggtttcccttgtaagagtttatgagggatcaacgaccatccacaacacccgtttgggcaacgatcaagtcaaggttgatgttcaggaagttcgacatactgatgcttgcattcctgtacccactcaagaggtttag

SEQ ID NO: 30394 - DNA, 162 bp, Glycine max
  Peptide Sequence Number=SeqID_122079
atggttaagtcagaattgctgaagcaccaagatagggatgaaaagcttctagctgcaaggtgtgtatatgagataactcagatcactgcacctgaaaagctccctaaacccatgaaattctcaagacctccttataggtatcttttagttgattgtcggtag

SEQ ID NO: 30395 - DNA, 291 bp, Glycine max
  Peptide Sequence Number=SeqID_122080
atgggggatgatggcaaaggttcaagtgttggttgggttggaaaaggcttgactctaatggtaggctttttgggcttgggcgcaaggtttgagtcagattctgaaccttttctctttttagggtcaaatagaggttgggttctttgctttttggttaaggatcgtggttgggggtcagaagatgaaggctggatctttgagcttcaacgatgtcttttaatggtgattttccaccatggagatgcagcgaaagacaaaggagaagaggtgagaggaggtgccatccactag

SEQ ID NO: 30396 - DNA, 321 bp, Glycine max
  Peptide Sequence Number=SeqID_122081
atggttgcctttgttaggcagtatcagtacaattttgatatggttccggataggatgcaactacagaacatttgcaaaaagggggacggatctttcaaagaacacgcccaaaaggtggagggatctggcggcccaggtggtacccccaatgatggaaagggagacgatgatcgtgatagtagacacgtgaccgatttggtcttcgccagcaaaaggatcgatgtgggtccgaaaagaggcaaatttgatcatcctactaggacgactgagaaaactggggcaaatgaagagggtgagaagagggagaaacccatgctgtga

SEQ ID NO: 30397 - DNA, 198 bp, Glycine max
  Peptide Sequence Number=SeqID_122082
atgctttccaaagtgaggatgaggtggaccacaattactgacccacacaaatccctccgacgagaaatgaggtcaagttgctcaacatgcagttggaatgtaaatgcaaaaatgatatttgcttggcattgtatgttgacgtgtaacaacttcctagcctggcgacgtgacctcataggtatggaggtgcagaggtag

SEQ ID NO: 30398 - DNA, 383 bp, Glycine max
  Peptide Sequence Number=SeqID_122083
tttctcatgaggggaaatacttgtacttgggggcatgtcactcagtttggaacttccttgagactcaggctgatcaccaaggggggaggggagttacatgtgcacgacatggtgacctcgacacttgttgcctagttttcctaagtgagagtgttgggtggacatgcttagactatttcctgatgaatggtaccacattgcaattgagagttgaggtcagatatgatgttttgatcattgctaatcgaactacagtgtttggcaccagttatagcgcaaggccaaggggtcgcgcaggttttgatggttgtttgtcagttccagaaacaaaaaccataaggaagcagaaaaatggtcatttcctagaattttttggaccctag

SEQ ID NO: 30399 - DNA, 834 bp, Glycine max
  Peptide Sequence Number=SeqID_122084
atgggctccgacgggtgcagagaaacgcgagggactggaaccagagaagcgacatgcaaaccgaggcaggattttaacattcaaaaggaaaaagaaagaggaagcctttttaaaataaaaagccacgttctctctctcttcacccactcagaaaaatttagaagctctcgtcaccttctcacgttgcttttcttcttcccttctcatccaccgtcgttgcccattaaagctccaaactttgctcaccatttctactccaaatcacaaaaagaagtcattttcggagtcgtgaagcgcacctctacattgtgggacttcaaatttcagcttggaggggttgatggggacccggtgctgagaggaacgaggataagggctacgtgggggtacgcgagctcagttgatggtgggcaactggggatgagtggtacctggagatatgtcgtgggggtcaggagaccttggggacgtcagggggtgctattgcccaaaaccaagcttgaccaatcccgacccaacccgggcatagcgagctcctggcagtcaaccaataaaaaaacaaagaccacaaagcaaggaggcttgtgtggtggctggccagctatggattttgagcgatatctggaatatggcctctggcttagaaatgaagataggatgttgaggtggcctctggcaatcgattaccaatgctgtgtaatcgattacacagagcaacagggcactggtttccatgttctgaagctgtgtaactcgagtttggcctttggtaatcgattaccaacgggtgtaatcgattaccagagaagaaaacccttgaggcataccttttaa

SEQ ID NO: 30400 - DNA, 225 bp, Glycine max
  Peptide Sequence Number=SeqID_122085
atggccattgagggctttacaatgagaagaggggtgaaagaaagaaagggagtgaatgaaacccctaggagaggggctccattggagcttgtaggcctaggatcttcttcatcaatggattcctttgcttcttggaagatgaatggcagcggaatggagaaggaagagagagaggagacactacttcaaggagaagatgagtctagaagaagctcatcaccatag

SEQ ID NO: 30401 - DNA, 198 bp, Glycine max
  Peptide Sequence Number=SeqID_122086
atggcggtggtggtggaggttgagaaggtgggggtgaggattgaagaggtggtggtgtcggagccaaggttggtggtggaggatcaagggatgcagcgagcattcgctaagcgcatcactcatgggctaaatgcgaggaagactctggaagaagatgagctatacaggttcgctaagtgcaccgcttcatctcactaa

SEQ ID NO: 30402 - DNA, 357 bp, Glycine max
  Peptide Sequence Number=SeqID_122087
atgaatcgattgcctcatttggtaattgactgcccaagccaatttcagaagaaggaagattctcagcctgatccaacaccttcatccattagtgatgcaagctccattggagcttgtaggcctaggatcttcttcatcaatggattcctttgcttctttgaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatgggctttgaaatctgaagtttaa

SEQ ID NO: 30403 - DNA, 447 bp, Glycine max
  Peptide Sequence Number=SeqID_122088
acacttgttagcattgccacacctcttgggcttgagtttattcctcaagtaaagaatttgttggatgagggtttggttcgcaagagcttaaatcctggtgctttgtcggtgcccaaaataggttttattaggcaccaaatcccaaaaataggtggtatgatgaatgttttgagtggtgcaaccctcttttgtaaaatcactcgtgcacccaacatcttcatgatttatgtacatagggactcattaggtagtgatcaaggggttcccatgaaccctaagagaataaaggtcattcctgagtggctcactccaccaagtataaggaaaatttggggcttccatgacttaacaatcttttacaaaaggtttgtcccatatttttctatacttgtagcaccactcattgagttggtgaggaaccatgttccttcatgggaagatgcctag

SEQ ID NO: 30404 - DNA, 472 bp, Glycine max
  Peptide Sequence Number=SeqID_122089
attcacttacattgtgaactatctccttggtcttggaaaaacgcttgaagatgaagagatgaacatcaagattttaaattgtctcaaaggaacttgggaaccaaagattacaacaatcaaggaatccaagaatctatttacaatgacgatggaagctctcttcgataaattgctagcctatgaacatgaattaactcaacaatcttatgcagaagaaacagaaaagaaaaggaaaggaataacactgaaagtcaactcctcaagggaagagtatcaagacagttccaatagtgataagataaaacatggtgatgaaaagaaagggaagaaggacagaaaagaaaagaaaacctacatagcatgcgaagatagtgcatcaacaacttccaactcttcaagtgatgaagaaattgctaacacgtgcttaatggaaaaatccataaatgatccgtcaacaagtgaagaaattgag

SEQ ID NO: 30405 - DNA, 180 bp, Glycine max
  Peptide Sequence Number=SeqID_122090
atgtctaagcttgatgaatcttttgcaaatgtaagactggtcgaagacattggaccactgatagaaccatctaaaggaacagacacgtccaatcaaagaaatgatgtttggaagcttgtagaactacctcaaggaaagaaagcagtgggtgttcagaaacaagctggacgaggcaggtaa

SEQ ID NO: 30406 - DNA, 450 bp, Glycine max
  Peptide Sequence Number=SeqID_122091
atgcaaccagttatacgtgcatcgctggtcctgtgttctagcatttacattcttacagcattatttggatttctcctatttggtgagtcaacacttgatgatgtgctggccaactttgatactgatctgggcatcccttatagcagtctactcaatgacattgttcgtatcagctatgccctccacctcatgcttgtttttccagttatcttcttctcactgcgcttcaatttggacgatcttatctttccttcagctaggcccttggatttggataagtgtaggtttgtcttgatcaccactggactcattgctttaatctatgtggctgcaaattttgtacctagcatctgggatgcatttcaattcacaggagcaactgccaccgtttgccttgggtttattttccctgctgcaattgctcttaggtgggttttcttacttatctaa

SEQ ID NO: 30407 - DNA, 195 bp, Glycine max
  Peptide Sequence Number=SeqID_122092
atgggggatggtcagccttgcagaatggcagagttcattgttgggattctcattggtggagggatcttaggaagatatatcagcacaatgacttcaagattatacatcaaaatatggcttggaaggcagcagaatgatcttatttcaaccatgggaagcttctaccagaataattggaattgggatctgaagtag

SEQ ID NO: 30408 - DNA, 321 bp, Glycine max
  Peptide Sequence Number=SeqID_122093
atggataagagcttggaggaagaaggagatgaaagaatgggctcatacttagcccatggacccgaaatctgccctaaggctcatgagaaccatagggcattcgcttgcatctctggcccaatctacttggagtcttctatccaatgcccttgcggggtaggattgcatcacattggtacgaaagttgttgagggtaatgatggcaatccaatgacacctgagacattaggtggacgcctagccatttttatagtaccaaactgcattggagaggggccaaaggcttcaatgcctgtcacaggcccaatgaccataagttga

SEQ ID NO: 30409 - DNA, 222 bp, Glycine max
  Peptide Sequence Number=SeqID_122094
atgaaacgtcttaaagaaagcgacattgtccgcgactcagccattgttgctaaggatgttgagcatgttgatcatccagctcatgaggaacgtactgacttaaatttggcctctcatgcgaggaaggtagagaaatttggaaggcttgcaccagagattgaaggcatagtggtgataggaaacttatatctgctttgtggagaggtggtagagggaaactag

SEQ ID NO: 30410 - DNA, 318 bp, Glycine max
  Peptide Sequence Number=SeqID_122095
atgactccattgatgaagaatatccaaagcctacaagctccacatggaggcacatcactaaggaaggtgaggtttggtttgctccccctacgtctattgagaaaatgctccagactcaagatccaaaggattatcttgagttcctacagtctaatgaacatcagagaaaggaatctcaattacttttttctccacttttttctttatgtgcttttgcacacactctgggaatttatcagcaatcctcatctttatgaaggtagcccttcagctgagtggctccagatgatggctccatcaaagaaacctccactctag

SEQ ID NO: 30411 - DNA, 528 bp, Glycine max
  Peptide Sequence Number=SeqID_122096
atgttaaaagttgcatctaatgcattattagattatgctatactaagagctcgtttctctggtcttgaacttgatgaaaaaccactgccaaatagagagcatcatgaagtggggcgtcactatgagactctaaaccatacctttttcattgctgaaactcctttcaacagagtctgcccttggaagagagattttgctattgagtctgactgtaacttctctttcatggttcaattgccccattctagattcgcctttactcacctagtgcaaccaattattgaagaggtgaattataatgcagaagttgatgctaatttaaatactctagcagttaaggtttatgatcctccaccatctggggagtatgttcgctgtgtagaagaggcctttctcataacaagggaagctcttggtagccttgatttccatgctccaattaacttatcatctggtgatgaatttggtgatgagttcttgaggaagtttgatgaagaagttgccaaacaaaagggggagaagatgtaa

SEQ ID NO: 30412 - DNA, 1512 bp, Glycine max
  Peptide Sequence Number=SeqID_122097
atggtgtctccgaagcagctcctgggcaccatcgaatctgcgcttctcggcacttcgcctccgatggcggcgcaccgcgtcgaactcttgcacgctctccgcacttctcgaacctccttgcagtcccttctctcgtatccccccccaaagccctctgatcgaagtcaagttcagtcaaagtcagtcagacttcctgattctcctcctatttcacttgatgaccaggatgttcacattgcgctcaaattgagtgacgatctccatctcaatgaagtagattgtgttcgtttgcttgtatcagctaataaagagtggggcttaatgggaagggaaccactggaaattttacggcttgcagcaggactctggtatacagagagaagagatttgataacgtccctccatttgctcttaagggctgtggtgctagatcagggactgcaagatgatatattggtagacattcaaaagtatttggaagatcttatcagttctggacttagacagcggttgatttctcttatcaaggaactcaatagagaagagccttctggtttgggtggtcctcagtgtgagagttatgttcttgattcaagaggctctcttgtggagaggcaggcagtggtctctagagaaagacttattctggggcattgtcttgtgctttcgattctggatagtgcttctgaagttagtgagagcaatgccactgtaaaacatcaggattctatgattttccaaccaaatcgtgtgcaaaatcggttgtggtattgttttgctgcaagtctctcatactctcaatctctcttgcttgcttcgtctctggctctctgccatgatatgatggggtctgcttcttctcatctgcgtctcacactcttgaagcttttactttcttcttctgccataggtggtgctctgggtacagtgcctgataaagcatctgtcctttcttctaatacttccttcagacacgaatttcatgaacttgtaatgactactgggaatgatccacatgttgagggctttgttggtggcataaggcttgcttgggtggtacatttgatgttaatacaagatggtgttccagctagagagactatttcaagtggttcatcaaatgaactgggttatcttagtcaatgcttggaagccattttctcaaataatgtttttcagtttttacttgataaagttcttcgtactgcttccttccagactgaagacgaagatatgatctacatgtacaatgcttatctgcacaagctgattacgtgcttcttgtctaaccctcttgcaagagacaagataaaagaatccaaggagcggattatgagtgtgcttagtccataccgagttgtgggatcacatgattttgcacaggacagtaattcaagttctctacatggcactgagatgggccctttaccatttaattcaatcttggactttgtgagcgaaatttatcaggaaccagaaactggatacaatacagaatgtaatttctactag

SEQ ID NO: 30413 - DNA, 954 bp, Glycine max
  Peptide Sequence Number=SeqID_122098
atggcttccacttcatctcttcctcctccaccaccgttgtctccggcagtgacaccttctccaattacattatttggtataatgaagttcagctggtcatcaaaggtcatggtttattggattttctggttgctccgatcactccgtcgcgatttgatactgtcgctgatcacgctctgggagaaactccatgcgcatttttactctattgctcgcacgaagaaaaggcagctttgtatggatctgcgcaatgtctctctggaaaattacaggatcattgattatcttctccacattcagacgcttgttgattcgctcacttccattggtgattctgtttcgcagaattcggttcaatccgaactggtttttttgcacacccctacttctaacaatggaggttacattaactccggtaattacaacaattttggccgtggtggtggtggctggaataacttctaccacggtggccacgagggaggttgtggccgtggggcacatggtggtggaaagtttgttgatgtacaatgtcaggtttgtcacaagtatggtcatgaggcaacctattgtcatcaatctctaacctatggattataccaactcatcttctcctcaactcttaatctaaaacccaaacacccactcaaccttcacaatggctttctaccactgctcaacctcagtatactacctttttcacccttacccgccccaatacatgacaccttactattatcccccacctctagttcagccttacccctccacctcctcaagacctataccccaggatgcacaatacttcctttcactgatgagaatcctgaaactagccaaatacaggctaaaggcccaagtggagaaggacaaagcccccgagtggagaaggatgaaggcccaaaggcaaagacactatcaagactattaattgttgctgaaggcccagattaa

SEQ ID NO: 30414 - DNA, 219 bp, Glycine max
  Peptide Sequence Number=SeqID_122099
atgaaactagagctaaggatcaacaatctaccctatcggatcatcctaactctggcaacaatggtggaaacaacatggttacgacacttacctcgacggtggacggtgatgaagctccctcgacagtggacggtggcgttgctctttacggaaacctcctcaatgcacctcgcaacctcttcacggcaagctcctcttcacaacaacaatggtggctga

SEQ ID NO: 30415 - DNA, 444 bp, Glycine max
  Peptide Sequence Number=SeqID_122100
atgttcctttcgccaaagttgatggaccttgaattggaccatgaaaatatagaaaaaagggttaccacagaccctaagagaataaagttcattcctgagtggcccactttaccaagtataagggaaatttggggcttccttgacttaacatacttttacaaaaggtttgtcccatatttttctatacttgtagcaccactcattgagttggtgaggaaccatgttccctcatgggaagatgcccaggaaaagggtgttaagggaagaagcctagagtttcaagaatctctggatttgaggtcaaatgcttttcaagggggatgggatgatgcaatcctacccccaagggcattggatagaagacttcaagaagattgggctagagatgcaggagaaggccctaaagttctcatgagccttagggtagattttggcatgggctaa

SEQ ID NO: 30416 - DNA, 117 bp, Glycine max
  Peptide Sequence Number=SeqID_122101
atgactgtgaaaaagaggctaagttttgaagtgcaaaaagtggcagttggggctaagcgcgcatccaccgctaagcgtagatttagcacgcttagcgcgaaggagaatctagcatag

SEQ ID NO: 30417 - DNA, 249 bp, Glycine max
  Peptide Sequence Number=SeqID_122102
atgctcaagacccctttggctatgcatttcggctattttggtgtaaaaacacgttttcgtgaagaaaaatcaagtcgaagtacttccgtaacgcttccggaagcgattctgtggaaattcttcatcgttcttcgtcgttcttcaccgttcttcatccgttcttcggtcattcttcgttcttcaacggttttcttttcttccgtttttaacgtgcttttaaccatttatttaagccgttttctcgtctaa

SEQ ID NO: 30418 - DNA, 1476 bp, Glycine max
  Peptide Sequence Number=SeqID_122103
atgtctgcccaagaagttgcgctgactttacagcagcttaagcagcgcctcgccgaatatgactatcattattacgtgctggatgcaccgttagtcactgacaatgaatacgatggcctttaccgtcaattagtcgagattgagcagcaattccctgagcttgttacgccggattctcctagccagcgggtaggcgggcaagcactttccgcttttgccagcgtccagcatcgccaggcaatgttgtctctcaataatgctttcagtgatgatgagctagaggcttttgaccgtcgtgtacgggagggagctggcgtctctatagttgagtatgccgttgaacccaagttcgatggtttggcgattaccctaacctatgagcagggtttgtttgtgcaaggtgccacacgcggtgatggatataccggtgaaaatgtcacgcataaccttaaaaccatccgggcgattcctagccgtctcaatatgaccaatccaccagcgttgcttgaagtccgcggtgaggtcctcatgctaaaaaaggactttgaaaagcttaaccagcaacaggcggcggttggcggcaaattgtttgccaatccacgcaatgcggctgccggtagcctgcgccagctcgactctaatatcacagctaaacgccccttacatttttttgcttatggcttaggtgccagtgatggtgtcccagaactgcactctcatgccgaagccatgcaatatctggctgatttacgcttccctgtctctgtgctgcgaggggtaaaaaccggcgtgcaaggcttacgtgattattacgcggaaattggtgaaaaacgtaaggacttgccatttgatattgatggcgtcgtttacaaagtgaacgactttgacatgcaggaaactcttggatttgtgtcgcgcgcacctcgctgggcagtcgcccataaattcccggccgaagaagcgacgacagtggtcgaggatatcactgtacaagttggccgtaccggtgccattacgcccgtggccaggctgaagcctgtgttcgttggcggtgtaactgtcaccaatgctactctgcataatgaagatgagttacgccgtaaaaacattttgattggcgatacggtggtggtgaggcgggcaggggatgtcattcctgaagttgtgctggtaaagcctgaattgcgcccggacaatgcgcgtacttttgtcatgccaacggtatgtcctgaatgcggctcccatgtggttcgcctggaggatgaagctgttgcacgctgcacagggggcttgatttgccctgcgcagcgcaagcaggcaattacgcattttgcttcacgccgtgccatggatattgaaggtttgggtgagaagttggtggatcaactggtcgcgcgtgagttgattcaccatttggatgatatttaccacctcgatttgccggtcttggctggcttggaccgtatgggccgataa

SEQ ID NO: 30419 - DNA, 505 bp, Glycine max
  Peptide Sequence Number=SeqID_122104
ggtggacccttgggtacttgtacctatcaccttgagaggactacatgtcctcgccatcagaggactgcatgtcctcaacttgagaggactacatgtcctcgccatcagaggacctcatgtcctcgccttgagagggttgcacgccctcaccatcagaggactacacgtcctcgccttgagagggctacacgccctcaccttgggactacacgtcctcaccatcagagggctgcacgccctcaccatcagaggactacacgtcctcgccttgagagggctacacgccctcaccttgggactacacgtcctcgccttgagaggactacacgtcctcaccatcagagggctgcacgccctcaccatcagaggactacacgtcctcgccttgagagggctacacgccctcaccttgggactacacgtcctcgccttgagaggactacacatcctcaccatcagagggctgcacgccctcacctctagaggactacatgtcctcgcctga

SEQ ID NO: 30420 - DNA, 261 bp, Glycine max
  Peptide Sequence Number=SeqID_122105
atggacatttcgtgctgtgctcatttcaaaatttctgctttgtcccatcatccggctttccaactagccattgtacctgagattgcgataagtccttcttcttctttggagcttgttcttggtcccaagggaaacggggtgacaaagagcagcttgcttctccaattggatcattgctcgactcgatgggtaacttctagtggtttgccggggaagctcttgtttttctttcaggagttggttggtggcatggacacctag

SEQ ID NO: 30421 - DNA, 435 bp, Glycine max
  Peptide Sequence Number=SeqID_122106
atggcggaatatacattatcggtttatctggagaagagtgaattcaatcgcggccctcatcttgatggcgcggagggtgcagaggcgatagccgcctttatttcgcggcctgagcatgaggaagcactggctagcggattagcgcattttaccggattacccttgattgatctgcgcgaagacagcgcggtagtcacctcttatttacagttaatttatctggatgataaaggcgaatcacgcatgctggccaatcacggcagctctcctggctatcgcatacaccgcgttgtagtgaatcgctgggagttaaaacgcattgcgggccaatggaaaattcatcgcaggacgttgattcctgtggacggtagcggtttatcacgcgcattgctttcccaggggctgaaagatgtattcagccggcaatcacgataa

SEQ ID NO: 30422 - DNA, 571 bp, Glycine max
  Peptide Sequence Number=SeqID_122107
atgagtcatcattcatctagtgttaatggcgagggtactagtcataaggaaaccttatctaaaatcttagatgagttgagttccctcaagttatggaaagaaaaactagaaataaaagaaaaaggaaaagagagggtaaatataaatcaagatgaaaggaaacaaataagggaagaacaaagaaggaaaatactaaaagagttaagaaaagaaaaacaagcctcctatagtagccataactcttgcaagagcctaagtgaagaactttgtgactattatgaaggaaggcataggtcacatcttagacctcactcccatagaagagaaaatgaaagaaagcctcaagaggctaacattagcctcccatacttccatgggaaggacaatgtagaggcttacttagattgggaaataagggtagagcaaaaacttaaaagaaagtctactttaaaatcttatgattctcacttatatccaaagaaagaccaaggtctaggcatctcaggggcagcaccttctaagcccaaagatgataaggggaagacaatagaaaagcaaccccctgaggctg

SEQ ID NO: 30423 - DNA, 486 bp, Glycine max
  Peptide Sequence Number=SeqID_122108
atgtgggcctttcatactggccgacaaattgattgggcacatttagtctggtatcgcatgcataaggcattgcgattaaatgttcccttaccgtatccacacttagtcactttgttccttcaacattttaacatccctcttgattctgaaccttatgttccaatcaagagatctttcttgatcagtgatgttgtggttgcctcctttggttaccgcaaagagcatgatggctcttgggtaaaaaagggtgctcaaccaaatgatgatgaaggacacgtaccggttgaaggggacttttctctccttcagagtattttggacaggtttgatggacttcaaacctatgttggtgagaggtttgatgctttggaacgacaaatggacatgcgattcgatgcaatggactcaaggatcacaaaggttgaagaagatgtcaccatcattcgcgactgccttgatttacctctaccaccatcatcagtttag

SEQ ID NO: 30424 - DNA, 597 bp, Glycine max
  Peptide Sequence Number=SeqID_122109
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgatattcgcactgcctaccgcaaactcgctatgaggtggcacccggacaagtgggctctgaatcccgcaaccgccggcgaagccaagcgccggtttcagcaaatccaagaagcctactcaggttaccttgcaaattgcatcatcacggtaccgagctcgaattcgtaa

SEQ ID NO: 30425 - DNA, 948 bp, Glycine max
  Peptide Sequence Number=SeqID_122110
atgcaatctcagggaattgcactgcctccggagccttcgcttggtccctcagatcctcaagtaagcacaaaggagagttgtgttgatctctcaggaaacgatcctaagacgggtgactcaaataggtgcggcttgtacatcgaagcaaatcctgcccgcatggttaccctggggagagtttatgagggatccactgctgttcataacactcctttgttgcctggccaagtaaaggtgggtgtggaggaggttaaagctccaaatgctccagttcatgtacccactaatgaggtttccttagtggggcaggcaattcacaccttccttacttggccgacacatttggtcaagtctttatcacagcagacagctgtgtctctggcaaaaccacctcaaaagctggatccgaaggttaatgatctgctttatctgatgacattgatcatccccgagcttttcttgaggccttaccaggtcacatgggatgccaccgtgtttggggtctttaatccagacttcccgctctacataaagcacgaagacctctccaaaatcgcacatggtggtcaatgtctcagcatatcagtgttacagttgtggattctgcatttgactgatacaagtatgcgagcggggaattctgatatctatggattcctcgacccacaatctattcagaggtctgggcaatcgcagtttgagactgaaagttacataaagaattggatgcagagttcaaaacatgatgtctaccttggagcctacctgaatggcggacactggcagatggtggtcatcgtgcccaaggaacacctagttgtctggttttgttcattgcataacaggccagacaactaccttaaggggataattaacagtgctttaaaaggtcttgatgatgctccacagcctaaatcaaaggttcttgctaggtggattgtcgtcaag

SEQ ID NO: 30426 - DNA, 687 bp, Glycine max
  Peptide Sequence Number=SeqID_122111
atgtggcagcccctaggaggtttatctttgaggccctacaaaagggaggtcgtgattccccatagtgggcgtaaggaggattcctgtttgctgcattccggcgagctgcatgacatggaaacgtgtttgggagtagaggaattgttacagcggatgatagatcaaggtcaactggaagttggcaatgaaggaagagaggagcagcacatatgcatgcagtccacggatgggagcactgttgcgaagcccaaacccttggtgacatacttcaccaagggcacagcttcgcaaaagcccggacaccccttggcagctaaacctgtccctttcccgtaccaaaatagccacgcagtcccatggagatatacacctccgagggggaaggaagaagaagccaccgacgtcagcttgttgtcggctaaggtaacaaatatcacgggactgagtggtgtgacccgtagcggttgtgtgtttgcacccccggacctaccagtccaacccgcgaacgtcaaggggaaagcaaaagtggtggaggaacaagatgatgaaatacccctcgcttcgaataaagatattccggcaaaaggtcttctggagaaaaaggatggtaaaaaggaggtgtcgctagaggcagccagcgagttcctccgtataattcagcagagcgaattcaaggttatcgagtag

SEQ ID NO: 30427 - DNA, 328 bp, Glycine max
  Peptide Sequence Number=SeqID_122112
attttgtaccattgtcggtaatgatcttcctaaggagtctgtaccgacaaatcagctccctcttgatgaaactgaccgctgcactcctcgtgacattggtgtaggaagccgcttcgacccatttggtgaaataatctattgccacgagaatgaagcgatgaccgttcgaagccttgggttcgatggaccctacgacgtctatcccccacatggaaaaaggctaaggggaggacatgacgttcagaggatgtggcggagcattgacattgtccgcgagcgcttgacatttatggcatttccttacatggtttccatggtgagccagtaa

SEQ ID NO: 30428 - DNA, 547 bp, Glycine max
  misc_feature (42)..(42): n is a, c, g, or t
  Peptide Sequence Number=SeqID_122113
gaagtgtttggaggaaagggcaaaggccttggaaaatcaagncgaatggctttcttgtatggacatcttggcgcttttgatctttggagttgtcctctgtccgaatatggaagggttagtggacctagcagtgattgacgctttcctcgcctttcatcatggcaagaaaagcccagtcgtcgccattttggccatgtatgacatgttcgaccggggatgcccgtctatccgctacaaggtcaccgctcgtgcgtcgaaaaaggaaaggcgaattgggaccaactcttggctagcatggagggaggagtgccatcagacgaaagcatcacgcctttcatcgcacggggtttcggtgaccacaacgcgagggtactccaaggagttcgcaaggcatgggatgcggcatgaagaaaggacagagagcttaggggaagcagtaatgggatcatcggcggctatcataaaaagtgatgaggtacaagccctaaaggcagagcttgaaagagcccgggtagtcgaagagaagttcaagtccatagccatcaag

SEQ ID NO: 30429 - DNA, 630 bp, Glycine max
  Peptide Sequence Number=SeqID_122114
atgatcggaaggctgctagccggttcattagctcttgaaagccgtatccttcattatctaattgtccgtatcttactccccagatcttcaaaccttgcacaggtttctgaagaagatctaatagtcatgtgggcctttgataccgaccgacaaattgattgggcacatctagtccggtatcgcatgcataaggcattgcgatttaatgctcctttgccctatcctcacttatttactttgttccttcaacattttaacatcccttttgattctgaaccttatgttccaatcaagagatctttcttgatcggtgctgttgtggttgcctcctttggttaccgcaaagagcatgatggcacttgggtaaaaaagggtgctcaaccaaatgatgatgaaggacaattaccggttcaagaagactcttctctccttcagagtattttggataggtttgatggacttcaaacctatgttggtgagaggtttgactccttggaacatgaagtggacacacgattcgaggagatgaactcaaggattgcaaaggttgaagaagatgtaccatcattcgcgactgctttgatttaccttcaccaccaccatcattttagacattactattattattaa

SEQ ID NO: 30430 - DNA, 297 bp, Glycine max
  Peptide Sequence Number=SeqID_122115
atgactttactttctctttatggtttcctcaccgttgagaaccgcagaactcattctcagtcacaagttcgaatccacttccatcaaccagatcttccattgaataagaacggatcaaacaaagcaccaccaaatcaaggagctgtgggtgattcttcctaccaaggcggaagtcctcaaccaacactcaatctcggctctacgactaggctacgaaacgaaagcgaagggtccgcaaggcattcgatcttcaagcgaaagggacgggagggtatcaagtctaggaagaaggtttga

SEQ ID NO: 30431 - DNA, 384 bp, Glycine max
  Peptide Sequence Number=SeqID_122116
ttattttggaaccctagcttttacgtttttttcaaacccccaacaaggaagaaccacaacttaggaaccaacataagtcatcattcacctcagttccataggagagaaaaggaaagaaagcctcaagaggctaacattaacctcccatacttccatgggaaggacaatgtagaggcttacttagattggaaaataagggtagagcaacaacttaagaggaagtctacttcaaaatcttatggctcttattcttatccaaagaaagaccaaggtcaaggcatcttaggggtgacaccttctaagcccaaagatgataaggggaagacaatagaaaagcaaccctttaaggctagtatgcaagagaagactagctctataatgtga

SEQ ID NO: 30432 - DNA, 354 bp, Glycine max
  Peptide Sequence Number=SeqID_122117
atgagggaaagaaatgttctcattgccaaactagcaaccttaagggagaaagaattggaaaaggagtattatgacattctaatgaaggacacatctacaataagtacactccagctgtcataccctattttcatctggggactatcgttcgttgatcttttgatccttgctagtcgacttatggtgttgaacacaagttacagtgaaagcaaggaaccattcagtattttgatcaggaatgccaaagatactagaaaaaaggggcaaaagagacattttattgagtttctaggatcctggctcacccatgctagcctctggctcgcctgggccagccaattacttcaagagtaa

SEQ ID NO: 30433 - DNA, 715 bp, Glycine max
  Peptide Sequence Number=SeqID_122118
atggtaaaactaccctggttgataagctgctacagcaatccgaacgtcgaagcgctgccggacttcggaggtgatgagcaccgtatctatgttccatggttgactctcgtctgcggtaaagaaggtaagttcgttaccttcgccagatccgcagacgcgcttgtcaaaaaagctggtgcacaacgttgcgctgacgcgttgaagaaaccgaagacgccgatgcgttctcacaaagtttctgcgcccgggcgcgcacctgtccggattgaaaacatggtcgtgacaggtttcgagatggcgaacagctggacttcccgatccagggtttacgcttccgcgctgaacggtagcgggtcggaccagaaacatggaagacatgacgcaagccgctgtaccaggcgattgttgaccgtgtaccggcgccgtgacgttgaccttgacttccggtccggctgcagatgcatctcccagctcgactacaacaactacgttggcgtaatcggcattggtcgccagcgcgcgaggaaaacccgcagcggtaaagtcggtagtactgactcactggtctcgagcgttcgagagcgacgtagcgaagctgttccggcgcacggtgctgaagtttacgaaggtcagattatcggtattcacagccgttctaatgacctgacggtaaactgcctgaccggtaagaaactgaccaacatgcgtgcgtccg

SEQ ID NO: 30434 - DNA, 579 bp, Glycine max
  Peptide Sequence Number=SeqID_122119
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccgacccagttccagagtccctttcttctcattcgcaaagcccttccctaccccatttgcaaatttcttcatccatcactgccagatgtcttattcgcttacaacctccagatcttcactccacgctgccaccaccacccaagattgtcgccacctgtgccatcgattgtgcctccctttggatgcagcaatgtgcaaactga

SEQ ID NO: 30435 - DNA, 519 bp, Glycine max
  Peptide Sequence Number=SeqID_122120
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccatcagcagtgcgctaccgccaaaaatgccggcacagatcagcagtaaatcgcttaccgcgcacagcagggcaatcatcagatgatactggcggcggatgccctggttcatcacaaacgcattttgtggaccgaggggaaggatcatggccgcacccaatgcaagcccttgaaagtaatacgataacatga

SEQ ID NO: 30436 - DNA, 231 bp, Glycine max
  Peptide Sequence Number=SeqID_122121
ggatcgcgcctgcaagacacccagtggacccgacgaagtccaacaggagtgcctgtcgcccccagaaagatcatcaggccccctactaatcgagctttcatcaagaagtactgcgtccccaggcaggcgcagggcgaaacaccacagcagcctggggatggccggcagcgggcaacagatgcaccgccatcacctctagagttcatctcaactcatccacaaaaaggttag

SEQ ID NO: 30437 - DNA, 606 bp, Glycine max
  Peptide Sequence Number=SeqID_122122
atgtattatcctggtcatcaccaacatcaatcatatgcggaacccaatgtacctccagtgcatgttcctagatttatgtcccaacatcatccatcacaagcacaatatcaatcaacaagtttttctggtcatgcgtctcaaggatgtcaacaaagttttcaaccactgggtttctcatcatatatacctcaatactcatttcaagtcccttctatctcaaatgtttttgatggctcctcacaaatgtttgtcaccactttcaacactccaccatctgcatataatcttgcaccatcaagtttttgttatcgtccatcattacctactcaaatacgtgacatgagtcacgaagatgaggacaaggatgaggataacaacaataacaacgatgacgatgatgatggtgatggtgttgatgatgatgacaacggtggtcatcatgttcctcaacaacaatggacaattacacgtcagcatcctagaacaagaggagatagaggctgtagaccgagagaacaacaaacacagacaaattcaatccaacaagatgagatacccagacgcatatctagaagaactagttgtgggacatcgtctcattattag

SEQ ID NO: 30438 - DNA, 321 bp, Glycine max
  Peptide Sequence Number=SeqID_122123
atggggtgcaaggaaagtctgatcattgctattttggctgatgctatgacacatttgaccgaagatgcgaaaagagcggtgcaagaatcgtctgttgcacacctactctttatggatgactggtctctcacctctttcatcatgaaagtagacccatctgtcccctgcaaggtcaccacacatgcaccgagaaagggaaggccaattgggagcaactcttggctagtatggtggggacatccattaattggttcccccgatggaaggaaggaagagccagagtttcgtcctcatgcaaggggttctcaaacatccccttga

SEQ ID NO: 30439 - DNA, 168 bp, Glycine max
  Peptide Sequence Number=SeqID_122124
atgccgatctccccctacggaagtatcagttggggtcactcccacaagacacccagtggactcggagaagtccaacagggccttggggattccagttctggttacgagcctctatcagtcctacagggtgcccgtactccccgacaaggtcatgccatcgcaacatag

SEQ ID NO: 30440 - DNA, 398 bp, Glycine max
  Peptide Sequence Number=SeqID_122125
atggtcccgaggaaacttgcctcaaagagatccaggaaggataaagtggccgaaggaaccagttccgctcccgactatgacagtcaccgctttaggagtgctgaacaccagcagggtttcgaggccatcaagggatggtcatttctccgggagcgacgcgtccagctcagggacgacgagtataccgatttccaagaagagatagttcgccagcggtgggcatcactggtcacccccatggccaagttcgatccagacatagtccttgaattttatgccaatgcttggcctacggaggagggcgtgcaagatatgaggtcctgggtgaggggtcagtggatcccgtttgatgcagatgctatcagccagctcctgggatatcctttttccatggagag

SEQ ID NO: 30441 - DNA, 274 bp, Glycine max
  Peptide Sequence Number=SeqID_122126
atggcgaattcgtcagattccattgtgtcttccacaatggaatctgataatgagttacagacagagttcgaaaaggtaaaatctttgatgattccatcatacatgattgagttgcgaaaacttctggataggtatcctacatctgaactgaattctttctggttaaagaatctctttctagttgctctggaacaattaggagattctctagaagaaatacggagttttgctttaggtggcaacatgctatggggtggtggtccccacttatggg

SEQ ID NO: 30442 - DNA, 189 bp, Glycine max
  Peptide Sequence Number=SeqID_122127
atgtttattcaaccttactcgtcgcttacgacacccccaccacatgtagagcatgcaatttatgattgggcagacttggagatcaactcaggagcacagcataaatctaaaaatcataacgagtcattggaaatatctaacaacaaccttttgtcgcaacctacccttcggcaggagggcgacgcgtga

SEQ ID NO: 30443 - DNA, 504 bp, Glycine max
  Peptide Sequence Number=SeqID_122128
atggcgccgaccaggcaccctatggacccagataagtccaaccgggccctgggatttcccgcactgatcacaggactctgccagtcgttcggagtccccgtggcacctaccaaggtgattcggccgcccatcacccaggcttttattgagaagtactgcacccagagacaggctcagggtgatgctccacaggccgcaggcgcaccaccaccacctcatcaggctggcccggctgggtcatttgacatggagcagtatttacagcatttggttcgccagcaggcggccaaccaccgggcacatgtacagacccatgattggcttcgcttctttttcatgccctactccagaccagttcatggcagaggtcgcatggcccggggattggcccgaggcccaagcaggagaggcacccccagaggctcccgacgatggagaggaggccacgaggatgaggagatggccgatttgcttgacttcttgggagggagtggagctacatga

SEQ ID NO: 30444 - DNA, 537 bp, Glycine max
  Peptide Sequence Number=SeqID_122129
atggggtccgatcatcgtctaccttcgaccaaagagggtggtcggcagatggggtacattcagacagttcctccgccaccagttcatgattcgttgacaggtactgataaagacgaccggtgggtacagtttgcagatcatgtagcgcctacaggggagctctgtgtagttcctgggcaggtggccccaaactacatggagtggttttttcagatttcacacctttttgtgacgccgacggaggactctgctgagcccagacctgtgccttcccttcccactcatgatgatgacttcgtggagccacctgtcgcccaggtttcagtcacgtcagatccccctgcgcattctgtggttgattgcacagcatgtgtcaggatgggaaggattgctgagcatttggagcatgtcatcaaccttaggatggtgactgcagggactgacttatatgatatcatggatctttgcttgaggatagctagagatgacgacccagatgacagtcttaggccgcgacagagaccccgcatatattag

SEQ ID NO: 30445 - DNA, 147 bp, Glycine max
  Peptide Sequence Number=SeqID_122130
atggaagatattgcttcactagattcttccaatgaaaggcctttggcttcttcactttcactagaggaaggtgaagtagtatgccttatcttggctactataaatgtcttggcccctcataatctggattttgtggtggggcattga

SEQ ID NO: 30446 - DNA, 720 bp, Glycine max
  Peptide Sequence Number=SeqID_122131
cttcagacacagatccaaacagaaatcgccattggaaatccaagtgaaggagatgtgagggatgcaatagagaaggttttggctctagacaaggcttatccactccccttgttgggtggtgcaatgctcgaaaagtttccagcaaagtttgaagcagctagatggtggccaaaaagtagattatcgagcaatgacaaagacaagataatggatattaagaacaacaataataatggatggaatgtggagttggaagaggaaatgagggaggttattaaagtgttcaagagaaaagacatggaagactatgagaggttagggaatattgcactgaagataaacaagggttttgttgtttcagcacctttgctcacaggaattgctgcactagggtctgtgttttcaggagatggattagttcttgcccttgctggggcattggccacggtggttaatgcttttgagcatggagggcaagttggcatggtgtttgaaatgtacagaacctgtggtggattttttcagctgttggaggagacaattgaagccgcaattgaagagaaagacttagacaaaagagaaaatggagagctaattgaaatgaagatggctttgcaattgggaagaagtgtgtcacagctgagagaacttgccacaaaatctgcttcatgtcgtattgaagggagggagatacatgaattcgccagcaaactcttctaa

SEQ ID NO: 30447 - DNA, 375 bp, Glycine max
  Peptide Sequence Number=SeqID_122132
atgaaagtcgcacaggatacgagaaagaagcgcaaagggaacacccaagcatctaaaagggaagtcacccaagctaaatccattgggatgaaatttaaaattggcatcatccttgaggctgctcatatctttggaaaagtactccaaacaaagcacaaacaaataaagggagagaggatccccttgtctaagaccccgctgccctttgaagtggccataaatggatccattgactgccacactaaaggaagtggaagaaacacattccatgatccaagtacaaaactaagcagggaagccaatggacttaagcatccaatccaagaattcccaggaaatggaatcataacaaattacagcaagatatgggtataa

SEQ ID NO: 30448 - DNA, 315 bp, Glycine max
  Peptide Sequence Number=SeqID_122133
atggaagatggatatgctgtttctagtgaagttgggcaggttcatttgcggatgaggaagatgttgccggttgaggtccttgacactgctttcctgacctcaatgattcgaccatctaaggttgggatgattcctccacccaggattgtacctattgctggagaggtcataattgttctattgtggctgattttgctgctgaggttgaggaggtctattgtagaagtttacagcataagcttcaggctgttcaattgcttcaaattgttgcacataagggcaaaggtctgtgtggtggtctgcagaggagcataa

SEQ ID NO: 30449 - DNA, 585 bp, Glycine max
  Peptide Sequence Number=SeqID_122134
atggccaagttcgaccccaagatagtcctagaattctatgctaatgcctggcccacggaggagggagttcgggacatgcgctcgtgggtgagaggtcagtggattccctttgacacagatgccctcagccagttcttgggcgacccgctagttttggaggaaggccagcaatgtgagttcagccagaggaagaacaaggccaatggtttcgatgaggaagccatcgcccagctgttgtgcatactggggcaggatttcacccggaccactgtagggaagcgggtgcggatcatgcgcaccagcatgaccactttgacccagacatggatgacgttgttgctcagcaatgtcttgcctagctatcataattccgacctccctctacctaagtgccagttggtgtatgccatcctaacatggatgagcgtccatgtggcccaggtgattgctgatgccatttatttgtttgcaagtatggcgccaagtaggcaccctctggaccctgataagtccaacagggccctgggtttccgtgctgatcacggcctctgccagtcctacgaagttcccatcacccccagtatg

SEQ ID NO: 30450 - DNA, 265 bp, Glycine max
  Peptide Sequence Number=SeqID_122135
atgtcgctgcatgttctttatctttatgcgttttctggatttcccccagggatttcccgtctgctgtatctctcgttacaatctttcaaagaaatgaacgggcaggatcatcttgagctaccttctggggtggggaccaaacatggaaagcagaaaccaatcaaggtacttaggaaaggatgcaagtgggatggggtcacgaccgactggtcgttgccttttctctgcgctaaacaaacagagaacgtcgctgcaaggcagcccc

SEQ ID NO: 30451 - DNA, 126 bp, Glycine max
  Peptide Sequence Number=SeqID_122136
atggagaaaaatgaagaaacaacaatggaagaaaagcttcaatggggtcctttaatggtgattttccaccatggagatgcagcggaagacaaaggaaaagaggtgagaggaggcgccatccattaa

SEQ ID NO: 30452 - DNA, 198 bp, Glycine max
  Peptide Sequence Number=SeqID_122137
atgagaataaaaatacacgaagcacaatgtggaccaccatggcaaaataggggagatgcttgccgcccagctcgcccaggcgagctcagctcgcccaggcgagccaggttgcttccctccagaagcaacagccttcttgaggaatattctggagggcccaagtgggcctgggtgctatttgcacccccattttactaa

SEQ ID NO: 30453 - DNA, 141 bp, Glycine max
  Peptide Sequence Number=SeqID_122138
atgatgcaatcctaccctccaagggcattggatagaagactccaagaagattgggccaaagatgcaagaaaaggtcctaaggtagggtaccctagaaatgtaggatttttcagcccttgtattttagggtacatagactag

SEQ ID NO: 30454 - DNA, 216 bp, Glycine max
  Peptide Sequence Number=SeqID_122139
atgaagaaagaaggaagccttagattttacaaaccaaagctcggctatatcttctgtgatatggatggaacattgttgaacagcaaaagtcaaatttcttctacaactgccaatgctttgagagaggcgacttccatgggtgtgaaaattgtgatagctacagaaaattgtgataagatcatcatggtgattcttaccaagctacaaattttatag

SEQ ID NO: 30455 - DNA, 142 bp, Glycine max
  Peptide Sequence Number=SeqID_122140
tgataaaggggttcccatgaaccctaagagaataaatgtcattcttgagtggcccactccaccaagtgttgaagaaaaaagcttagagtttcaaaaacctcgggatttgaggtcaaatccttttcaagggggaagggaatga

SEQ ID NO: 30456 - DNA, 324 bp, Glycine max
  Peptide Sequence Number=SeqID_122141
atgaaaataggcgtatcacgaggccctttcgtctcgcgcgtttcggtgatgacggtgaaaacctctgacacaggcagctcccggagacggtcacagcttgtctgtaagcggatgacgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 30457 - DNA, 424 bp, Glycine max
  Peptide Sequence Number=SeqID_122142
gacacttgttagcattgccacacctcttgggcttgagtttattcctcaagtaaaggagttgttggatgaggatttggttcgcaagagcttaaatccttgtgctttgttggtgcccaaaataggtattattaggcaccacatccctaaaataggtggtatgatgaatgttttgagtggtgcaaccctcttttgtaaaatcactcgtgcacccaacatcttcatgatttgtgtacatagggaatcatttggtagtgataaaggggttcccatgaaccctaagagaataaaggtcattcttgagtggcccactccaccaagtgttgaggaaaaaagcccagagtttcaagaacctcgggatttgaggtcaaatccttttaaagggggaggtaatgatgcaatcctactcctcaagggcattagatag

SEQ ID NO: 30458 - DNA, 335 bp, Glycine max
  Peptide Sequence Number=SeqID_122143
gaatatcacccacaaagacacccagtggacccggagaagtccaacagggccctgggggatcgcgcctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagcagcctggggatgggcggcagcgggcaacagacgcaccgccatcacctctagagttcacctcagctcatccacaaaaaggttag

SEQ ID NO: 30459 - DNA, 446 bp, Glycine max
  Peptide Sequence Number=SeqID_122144
cacccggtaggactgatagcggcccacaaccagagcttgaaacccaagggccttgttggacttctccgggtccactggggggagatcggagttgtggtggtgtgcatgatccatactcatctccttgcagcggctgggtgaaatcctcccctagtatgcatagtagttgcacgatagcctccctctctggttatgcttgcacagttggtcgccctccaatatcagggggtggccccggaactgataaaagaaaactactggcccctcacccaggagcgcaggccttgattaagcatcaagggcggaggaccttgagttctctgaaggcacagatgtggagtcctatgaaggcgagagcatgcaaccctatgaaggtgagggcatgcagccctcagaaggcgaggacttgtagtcctctgaaggcgagggcatgtagccctctgaag

SEQ ID NO: 30460 - DNA, 291 bp, Glycine max
  Peptide Sequence Number=SeqID_122145
atgacccgtaccaagaaaattgggcagatgacgtttgaggcagcaaaggaaattgctgagaagattgattctttagaggagcaggcgtcacagggtttgtttgtcccccatggacatcaggatctcttgattgctgtcattgggcgaccaaaacaccctggccgtgtgcgagctgctggagccggtgtgaccataaagaaatactttggatcggctccacgaacctcccacagtttgtcctccatggctcccgaagaactcgagcagctaattcaacaaatcaggaactag

SEQ ID NO: 30461 - DNA, 243 bp, Glycine max
  Peptide Sequence Number=SeqID_122146
atgtctttctttctctttccgagaaggtaccaaaggataagaaataggttcaagtgttggcttaggtgctgtcgcaacctaccctttttgcaggcgagcgaggcgaggctcacgggtgcgtcttccaaaggaggaaaatgcacggagtcaccaccaacgtttattgaaaggaaaacgttagaaaaaccaaaggaaatcggtcatgaagaatattccagatttgggagttgtatttacgtttga

SEQ ID NO: 30462 - DNA, 415 bp, Glycine max
  Peptide Sequence Number=SeqID_122147
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaaggattgcattggagctattgatggtacacatattcccgcatcagtaaacggacgagcat

SEQ ID NO: 30463 - DNA, 417 bp, Glycine max
  Peptide Sequence Number=SeqID_122148
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaaagagtgctattcacatgacaacccaacaaaccatagaggccatcaacccggagaaagtcgggaaacctgtcgtgccagctgcattaatgaatcggccaacgcgcggggagaggcggtttgcgtattgggcgctcttccgcttcctcgctcactga

SEQ ID NO: 30464 - DNA, 325 bp, Glycine max
  misc_feature (205)..(205): n is a, c, g, or t
  Peptide Sequence Number=SeqID_122149
agaaacgcgaggaactggaaccagagaaacggcacgcaaaccgaggcaggattttagcatttcaaagccccacattttcagaagctctctctccctctccctcacgttgcttttcttcctccctcattcaccattgaagctccacacaaagcttcaacctttggccatcatttctgctccaaatcgtgaaaggagagcattttcnggggtcgtgaagtgcgtggctatgagtgggacttcgaaatttcaggatttgatttgggcaagattggatgaggggaagtgtggttttcgaaatatgctctttgtgcagattttgctgtaa

SEQ ID NO: 30465 - DNA, 546 bp, Glycine max
  Peptide Sequence Number=SeqID_122150
atggagaggaacatcatcctatatgtcacagagtacgatgagttccgtcgcgagctcgataggcggagctggcataaagccttgaccatgcagctcgacggtcacattgatgtggccctggtcaaggagttttatgccaatatctatgaccctgaagataaatcccctaggcaggttcgagtgcgggggaagttgataaagtttgatgctgagtccctgaactcattcttggagaccccagtgatcttggagcctggggagcactacaccacatactcccgattctgtcattcgtgcccaaaccctcaggagttcgccgccagactctgtattctagggtgcggttttgttcttaatactgaaggggcaccctggaagctcctgaggaaggacctcaccactctggccaagacttggactgtgctctcatactccaaccttgcccccacatctcacacgtccgatcttaatatggacagggcgaggttggtatacggattggtaatgaagatggatatggacttgggctcgctcatttctggctag

SEQ ID NO: 30466 - DNA, 465 bp, Glycine max
  Peptide Sequence Number=SeqID_122151
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccaattggcaccctgctccacagttcctcatcaccttcaaaagcaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 30467 - DNA, 183 bp, Glycine max
  Peptide Sequence Number=SeqID_122152
atgggttgtcaatggccaaaggctaaaactgtatcatggaaaggaatttatcaggacacaggacactgttcatttgatcgccaagtgagtcctttcgctaagcgcctgcttcttgctaagtgcataatcacttatgcgctaagccacgagttcaagcgcttagtgcaccaacctggcacctga

SEQ ID NO: 30468 - DNA, 297 bp, Glycine max
  Peptide Sequence Number=SeqID_122153
atgtcggtggcctcttctttcctttcacttggagatacatacctccacgggactgcgtggctgtttcggtataggaaaggaacaggtttagctaccgaggggtatcagagcttttgggaagctgtgtccttggtgaaatatatcaccaaaggtttaggccttccaaaacttctctcatctgcggactgcatacatatatgctgctcttccctcccctcatcaccgacttccagtcgccttgatctatcatctgctgcaacaattcctccactgcttaacatgtttccatgtatgtag

SEQ ID NO: 30469 - DNA, 219 bp, Glycine max
  Peptide Sequence Number=SeqID_122154
atgaagcaaagtgccctcatcacttgtctttcacaaacggaatggagaaggaagagagagaggagatgccacttcaaggagaagatgagtctagaagaagctcaccaccataggaggccatggataaaagcttggtggaagaagaagatgaatgaagggagaggaagacaagagcacgaaattttgtgctctgaaagagctttgaaatctgaagtttaa

SEQ ID NO: 30470 - DNA, 150 bp, Glycine max
  Peptide Sequence Number=SeqID_122155
atggacacagactccaccggggatttcctggaagccagtgtgcctccgctcatgaagaaactggctgccaacctcctcaatgtccttttatcgttgtcggcaatctctggcgggtattctttgctttcgacatatcgcttgatgtcgtaa

SEQ ID NO: 30471 - DNA, 651 bp, Glycine max
  Peptide Sequence Number=SeqID_122156
atgaagacccttatgcacatttggcaacattcattgaaatctgtttacactgagaagccaagaagtggctccattcattttaagggtaatagtctaaagacctgggaagaagttgttgagaaatttctgaagaaatacttcccaggtttgttaagaaagacccccagccatggactctctgagccaacccaacttaacatattcatagatgggctaaggccacaatctaagcagttgttagatgcttttgcaggggggaaaataaaactgaaaacccttgaagaagcaacgaagttgattgaaaacatgtctgccagtgatcacgccattctccgtgatagagggcatcaacccactaagaagagtttactggagttatcaacacaagttgtaccatatgtggtggtactcatgaatccagtctttgcattccttttgaagagcaaacgcaagaggttagctacatggggaatcaacaaaggcagggatacaatcaagggtccttacaaccaacaaggacagtggagatcacaccctgataatcaattcaacaaagaccagggtggaccttccaacaggccgcctcaacaagggcctaacatttttcagaggacaaccaagctggaggagactctgactcaattcatgcag

SEQ ID NO: 30472 - DNA, 336 bp, Glycine max
  Peptide Sequence Number=SeqID_122157
atgtcatccgcctttgcctccaagactatcaagtctgttggccaacagagacaatcaaagtcatctacttcctttttgaagacttcaatgtctttcgaccaagactatcacagtctccttggcctccaagactatcaagtctattcgccagcagagacaatcaaggctatcacagtcttctttgcctcagagactatcaaatttgtggaagcaacgacttccaagattattttgatgatgccaaagaatcaagagttaagcaagttccaaagaatgaggagtcaaaacgcttctagaatcaagtttcaaagaatcaagattcaagaacaatcatga

SEQ ID NO: 30473 - DNA, 48 bp, Glycine max
  Peptide Sequence Number=SeqID_122158
ggcgaatgctgtgaaatttccccggacgcccgaaatggactaggatga

SEQ ID NO: 30474 - DNA, 318 bp, Glycine max
  misc_feature (50)..(50): n is a, c, g, or t
  Peptide Sequence Number=SeqID_122159
atgaagcgaaatgtggaccaccacggcaacataggggagaagcttgccgnccagctcgcccaagcgagcaaggttgcttcctccagaagcaacagccttctggagggcccaagtgggcctgctttcgaagaagttacggaaacccacggattgcccaaagacacctcttttcgacttctgccacattacggaatttcacggatcgcgcaaacctacttccttttgatttctgagacgtctcgggacttcatttactgtgcaacaaaggatgccaagtatctcaaagcggctaaccaaaggttgcatgtcatcaagtaa

SEQ ID NO: 30475 - DNA, 408 bp, Glycine max
  Peptide Sequence Number=SeqID_122160
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccatcacagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 30476 - DNA, 726 bp, Glycine max
  Peptide Sequence Number=SeqID_122161
atgacgactgaggccgcaaaggaaatcgctgagaagatcggtacacagggatccttcatcccccatgtacgtcaggatgttctcactgctgctattggacgtccagagcaccttggacgtgtctgtgctgctggagccggggtcaccatcaagcaatacttcggatcggctccacggacgtcccgcagctcatccttcttgcctcctgaagaattgcagcagttgacccagcaaatcagggaccaactagaggagtcgatcacagaaaaagtgactcggcagctcatggcattgttcagccagatgcagtcccagatgcaatctcagggacttgcactgcctcctgagcctttggttggtccctcaggtcctcgagtgagcacaaaggggagttgtattgatctctcaggaaatgatcctaagacaggtgactcagataggtgcggcttgtacatcgaagcaaatcctgtccgcttggttgccctggggagtgtttatgagggatccattgttgttcataacactcctttgttgcctggccaagtaaaggtgggtatggaggaggttaaagatgcagatgctccagttcctgtacccattgttgaggtttccttagtggggcagacaattcacaccttccttgctaggccgacacatctggtcaagtctttatcacagcagctgtgtctccggaaaaaccacctcaaaagcttgatccggtggtag

SEQ ID NO: 30477 - DNA, 381 bp, Glycine max
  Peptide Sequence Number=SeqID_122162
atgaagtggaagataggccgcaccaagaaaactgaccgaatgacgtctgaggcagcaaaggaaattgctgagaagattgaaagattcattggaggagcaggcctcacatggttcctttgtcgcccatggacgttaggatgtactgactgttgccattgggcgaccagaacacgctggtcgtgtgcgtgctgctggagccggtgtcaccatcaagcaatactttggaccgactctaaggacctcctgcacgtcttcctccatgggtctcgaagacctggagtagctaacgcaacaaatcagggaccagctggaggagtcgatcacataaaaagtgactcaacagctaatattatccttcagccagatgcaatcccagtttag

SEQ ID NO: 30478 - DNA, 153 bp, Glycine max
  Peptide Sequence Number=SeqID_122163
atggaggctggatctttgagcttcaatgaggtccttcaatggcaaaggagaagaggagaagggaggcaccatccacaagggaataagccaaggaagaaggagcttcaccaccaagaattgacttggataaaaagcttgaagaggatgctttaa

SEQ ID NO: 30479 - DNA, 330 bp, Glycine max
  Peptide Sequence Number=SeqID_122164
atgactaggggcaatccaggtgatttacaaccctttgatcctgaaatagatagaacctttcatagattagttaggcatagtgtgcatcctgatcattctgtgcattttgagcattgtgagcattttgagcattttgagtattctgttgctggtgaatctgaatattctgattttgagcattcaactactaattttcatattgagaacatggctcaacctccacctcatgagaggactcttagggagatggctgcacctgatttcacttatgaagcttgtgcattcaatatcctgatgagggtgttccatatgttctcaagactggactaa

SEQ ID NO: 30480 - DNA, 264 bp, Glycine max
  Peptide Sequence Number=SeqID_122165
atgccggaaatcaaaaggaagtattgttacgcaatccgaccacttgggccttccaggatgttcctccagaaagaggttgcatctggaggaagcaacctggctcgcctgggcgagctgggtggcaagctcctccccgattttcctataaataaggggaggagtgaaggagaaaggggttcagcccttctggtacttcgtaatcacttaaaattagtgaggaaaattgtttccgtgaagaaaatccaagctgaggtgcttccgtaa

SEQ ID NO: 30481 - DNA, 423 bp, Glycine max
  Peptide Sequence Number=SeqID_122166
atggagaagatcacaaagggatcttcctccaccaccaccgctgctggtcaccgctgccaaggaacctctagagacccacccacaccagttcctccatctatttcaactcctcgatcatccacattattttcctcagatgatcaacatcagaggtactacgctcaattctgtaatagagtcattctagatcctaagtaccttgaccttgaattttttgatgaagaaacatttgattgttaccaaatttgggatgatgttctttactctgaagtgcatagtattcccattgttgttgatcagtccttgttttattcgttgactaagctacccagtcaaggtgttccttttaagggaactcttgttgacgactggaaatttgattattctagtcatgatgctcacagaatggtctgcaatgactag

SEQ ID NO: 30482 - DNA, 744 bp, Glycine max
  Peptide Sequence Number=SeqID_122167
atggaaaattatgacgttgctgtaataggctctggccctggtggatatgtagctgcaatcagaagtgcacaactgggttataaaactgtaatcatagaaaaatatacaacattgggaggtacatgtacaaacgttggctgtattcctacaaaagcattactggatagtacccatcactacgcagaagcacagcacgggtttgggagccatggaattatgctcaatgaaattaatcttgattttagccaaatgtataaaaggaaatcggaggtcgtaactaaaaatacttccgggcttgaatttttaatgaataaaaataaaatcacccatattcaagggatggcccgatttattaatgattccactatacagatcagcggaaaggaaggtgaacaaactgttgtggctaaacattatatcattgcaacaggttccaagccttcaactatttccgggattgaaattgataagaaaagaataatcacttctaccgaagctctttctcttcaggaaaagcctaaaacgatgataatcatcggtggtggggtaatcggtgttgaaatggcctctatttttagcagaatagggactaaagttaccattctcgaatacgcagatcatcttatttccacaatggatcacgggctgggcaggagccttcaaaagattcttaaaaaagaaggaattgaaatacatcttaaccagtctgtttataaagcggaaaatcttggagcttcggcaaaa

SEQ ID NO: 30483 - DNA, 200 bp, Glycine max
  Peptide Sequence Number=SeqID_122168
cttgtttatggggctgaactaggccagcttccttccataagtcatgtggattttaggatttgtgtccagattgctcttggtcaaggatactcattacatgtagatatacagtatcttgatgctagatgggaagttcttgttgtgcttcctctgcgtgattgttttgcccaagagatcaacatgctatgccgccttgatgg

SEQ ID NO: 30484 - DNA, 750 bp, Glycine max
  Peptide Sequence Number=SeqID_122169
atgtccttttgggggaaggaaaccgtatcttttctccgggtttcttccctccttgagcaagattgtagttgtggtcagggattcggcaagagagttggatcgtgtaaagcaaactcgaaacggcgtagtgggcctaccacggaagtacttagaaggcaaggcaaaggatatggcgaatcaagaggagtggtcccgtttatggacgtattagcattgctaatatttgtgggtgtcctctttccaaacatggatggtttggtggacctagccgcaattgatgctttccttgcatatcaccataacaaagagagcccggcggtagctatcttggcggacttatttgacacatttgaccgaaggtgcgagaagagtagcgcacagatcatcttctgtttacccgctctttgtgtatggttggtttcgcacctactccaacaagacataaggcatccatgtccgctccgaagccatcgctcatgtgtcaaaaagagaagagtagattgggaccaacacttggctgggataggaggcagaacaatcaactggtttcctcgatggaaggaaggaaaggagggagttatcttctcatgtggggactacccaaacatcccgttgataggaacgaggggttgcattaactacaatcccgcacttgctataagacagttaggataccccatgaggggagcaccgacggaagagagcctttctcctttccttgtgagagatttcggcgcgcaaagtttcaag

SEQ ID NO: 30485 - DNA, 249 bp, Glycine max
  Peptide Sequence Number=SeqID_122170
atggctacagccaggtgggcactcaagcatcccgtttatggcattgtgatactacggttgggaatttacacaaacagacccaacgtttccaagacaacattcctaaatgaaaaactctacacggttccgaaatttcaacaaacactattgacaacaacgaacatttcgtttctaaacgaccatttagaggaaacactgggtccaacaaagataggagaaaatcactcaaagtgtatcaatctcacacag

SEQ ID NO: 30486 - DNA, 373 bp, Glycine max
  Peptide Sequence Number=SeqID_122171
atgttggtgcgcatgatccgcactcgtctctttgcagcggcacgggtgaaatcttgcctcagtatgcatagtagcagtgtgatagcctccctctctagttgtgctcgcacagttggccctcctccaatatcagggggtggcccaggaaccgtgtggatgtcgagcacactgaaaatgaggacacgtagccctctaaaggtgagggcgtgcagccctctcaaggcgaggaggtgcagtcctctggagatgagggcgtgcagccctctgctggcgaggacgtgtagtcctttcaaggtgagggcgtgcaaccctctgatggtgaggacgtgtagtcctctcaaggggaggacgtgtagtcctctcaacggtgagg

SEQ ID NO: 30487 - DNA, 436 bp, Glycine max
  Peptide Sequence Number=SeqID_122172
atgggaggaactaaaaggcttttagtgataattcccaaggtgatcatatctctcttgatggtttctagaggtatcatccccttagaaaaacatattgtggcagtagggactaccaacaacaatatgtcatcaaagagaaaaactttagatgagggttcactgttatcaagcaagtcagagacccagcatgtaagagaaatcataatattgcacaagattagaaggcctaactctctaaaaacagtccccaatggagtcgccaactgtcgcaatctacccttcgatgggagggctcgcgggtgcgtcttccatgaaagggaaatgtgcgtagtcgccaccaatgtttattcgaggaaaacgtcggaaaaatcggaaatgtgtggtcttcgaactttaagtgtgacaggttcgggagttgtatttacgcacggggaag

SEQ ID NO: 30488 - DNA, 577 bp, Glycine max
  Peptide Sequence Number=SeqID_122173
gaagcggaagagcgcccaatacgcaaaccgcctctccccgcgcgttggccgattcattaatgcagctggcacgacaggtttcccgactggaaagcgggcagtgagcgcaacgcaattaattggaagacaaaggagaagaggtgagaggagacaccaatcactagggaataaaccttggaagaaggagcatcaccaccaagaatgtgccttggataagaagcttggagaggatgcttcaatggaggaaaagaaagagaaagagaaagagagaggggagcacgaaattaaaggaggcttctatggaggctggatctttgagcttcaatgggatccttcaatggtgattttccaccatggaggtgtagcgcaagacaaaggagaagaggtgagaggaggcgccaaccactggggaataagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30489 - DNA, 401 bp, Glycine max
  Peptide Sequence Number=SeqID_122174
tgggagacaagttggaggcttgccaaaagtccaaaaggagtttgtccgaacaattgggcaagacggaagaaaacatgtgggccatcattgaccaatacaaagagaagctaagtctagcagaaacccatgaacaaagactagaggatgagtatgcaaaggtattagtcctgcaagcagaaagggaagcaagagagagagtaatcgattcattacacatagaagcaatgatgtggatgaataggttcgctttcaccttgaatgggagtcaagagcttccgagattgctagccaaagccaaggcgatggttgatgtatactcggccctcgaggaagttcacgggctccttgattattgtcagcatatgatcaatctgatggcccacgtagttaggaatcgctaa

SEQ ID NO: 30490 - DNA, 328 bp, Glycine max
  Peptide Sequence Number=SeqID_122175
atggggacaaatcaaaacggcaaaagattttatcaagtcaaggttaagggtctagatgtcaccagcctcaaggaattgggacgattgatgggacctctccaaaggcaagccttccgcaaagtgtacggaaagattctagatttgaccacagcggaggtatttacggaagctgttgtatccctcgcccaatactatgaccagccgttgagatgcttcacgtttggggacttccaaatggtaccgactgttgaaaagtttgaggagatactaggattccctcttgggggaagaaaaccgtaccttctctccgggtttcttccctccttga

SEQ ID NO: 30491 - DNA, 303 bp, Glycine max
  misc_feature (127)..(127): n is a, c, g, or t
  misc_feature (172)..(172): n is a, c, g, or t
  Peptide Sequence Number=SeqID_122176
atgacggtgaaacctcggacacatgcagctcccggagacggtcacagcttgtctgtaaccggatgccgggagcagacaagcccgtcagggcgcgtcaccgggtgttgccggtgtccgggcctggctnaactatgcggcatcagagcagattgtactgagagtgcaccatatncggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 30492 - DNA, 249 bp, Glycine max
  Peptide Sequence Number=SeqID_122177
atttcaaagctcatttggagcacaaaatttcgtgctcttctctccctctcccttcattcatctccttcttcctccaagctcttatccatggcctcctatggtgtggcgtctcctctctctcttccttctccattccacttccattcatcttccaagaagcaaaggaatccattgatgaagaagatcctaggcctacaagctccaatggagcttgcatcatgtggtatcagagcatcttcatctaggtga

SEQ ID NO: 30493 - DNA, 222 bp, Glycine max
  Peptide Sequence Number=SeqID_122178
atgagcccgggctccgtcacggaaaaactctatttttatgttgccgagtaccagccgaaagaccgaaccggcacaggcggcgggatcaaggcagagggagaagatatcgacgtgctggaaatgcccctggaagaggcactacgcggcattgaaaccggcaagatagtcgacgggaaaaccatcatgctgctttatcatgttgcgctgaaaggcattctgtaa

SEQ ID NO: 30494 - DNA, 360 bp, Glycine max
  Peptide Sequence Number=SeqID_122179
atggcgcctactaggcaccccctggacccagagaagtccaacagggccctggggtttccggctctaatcacgggcctctgccagtcctacgaagttcctgtcacccctagcaagggcgatgcacatcaggacgcgggcacaccaccgccacctcggcaggccgattcggcttggccactgggcgtggagcggtatctacagcatttggttcgccagcaggcggccaaccaccatggacatgtgcaaatacatgagtgtctctaccagttcagccttagtcagcaggggcagggttctgccccttttgtatgccctaccctggagcagtttggggctgaggtcgcatggcctggagactga

SEQ ID NO: 30495 - DNA, 273 bp, Glycine max
  Peptide Sequence Number=SeqID_122180
atgtggcggaaatcgaaaagagatgtttttgcgcagtcccaattaggcccacttgggccttccagattcttcctccagaaggctgttgcttctggaggaagcaaccttgctcgcctgggcgagctgggtggcaagctcctcccctattttgctataaatagggggaggagtgaagggagaaggggttcagccttcttggcacttcttattctctcgaaattgctgaggaagattacatccgtgaagaaaatccaagccgaggtgcttccgtaa

SEQ ID NO: 30496 - DNA, 291 bp, Glycine max
  Peptide Sequence Number=SeqID_122181
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatttttcagaagaagatagatctcctccagcatcaagccgttgcagcccagaaacgcaaattgctatataatcatggaggctgcacgagttctgtaccaagtccgggattgaagagttattttgtgagttttgggacttga

SEQ ID NO: 30497 - DNA, 717 bp, Glycine max
  Peptide Sequence Number=SeqID_122182
gagcgtcctaagttgaagttatcctctcatgagaggaaggtgcatagtttaggcaggcctgtccctgccattgaggggctagttgctgggacaggactaagtcctctgatcgcgtgttcgatatacactggcgatcgaggacttttgtcgtcgtttatcgagcggtcgcatcaggagacttctagtttccatctccctgtgggagaggtgacgatcacactggacgatgtcgcgtatcttcttcattttcccgtggttggcgacttccatgcctttcagcccgtgcacgtggatgatgctgtacagatgctggtggagttactgatagtccctgcagaggctgccagggttgagacagcacagtgtcgtggacccgatgctaggcaggacattggacaactacggctcgcctttcgtgacttcagtcaggctgggaggtatgcatggggagtagttgtgctggtgcatatgtacgatcacctgaatgatgcttctatcagcaccagccgacagcttggtggttacatcacgctgttgcagtgctggatatacgagcactttccctcagtcgcaaagtccattactgatccagactacgacgaggattcaccgcgtgcctggagcgcctggaccgactctggattctggatgtctgttggatcccatatggggagcaccgaccggtccgggacttccataggatttcatgctattccg

SEQ ID NO: 30498 - DNA, 516 bp, Glycine max
  Peptide Sequence Number=SeqID_122183
atgtcgggtgatcgagaacgtttcgccgttccgcgcacaggcgccgacgccggcgctgcagcaaaaggtggcgctggcggtggggcgtttgagcaatcagaagggcttcgatcgcctgatcgcgctgtggcgaggggtggcggcgcagacgccgggctggcgcggcaggtgagtctgctgccggccaccgccgacgtggcggactattatcgccaggccagcctgtatgtgatgacctctcgctatgagggattgccgatggtgctgatcgaagccatgagtttcggcatgccgctggtggcctacgactgcaagaccggcccggccgagttgatagacgacggcgtcaacggctatctggtgcccgatgacgacgccgccgcattcagcgaaggggtgatcaaactgatgctcgatccgggtttgcgcgagcgcttttctgtcgccgcgttagagaagtctcgtcgtttttctccggaacgtatttatccccagtggcaacagctcaccgagtga

SEQ ID NO: 30499 - DNA, 100 bp, Glycine max
  Peptide Sequence Number=SeqID_122184
atggagatgcagcggacagatacaaggagacagatcgtgagaggaggcaccatccacaaagggaataagccatggaatgagaaacttcaccaccaagaga

SEQ ID NO: 30500 - DNA, 312 bp, Glycine max
  Peptide Sequence Number=SeqID_122185
atgttaatgtgtaatcatcaattctcgtgtgttggcccgattgaattattatgcaccattggtagaacaccagatggtatattaaacttacttcaagccactatgactcctactcatgatgccctgctatattacaacgagaggtggaacatgccatgccaacatgactttgtcggttactcgttcacaggaaaaaatccaaaaaaatttgacattccttttggatgtaccatcgatgaactgaaggatttgatcaagcaagttgcacctcaagggattccccttatgatattcatgaatcacaaacggtaa

SEQ ID NO: 30501 - DNA, 261 bp, Glycine max
  Peptide Sequence Number=SeqID_122186
atggacaacaagaagaggaggcccattatttgtagaaccaagccaaacctcaacaaaactttcaaggaagataccaaggctatagaggtggttcaggttcaagtcagccttatggttggagaccacacaataatgcatattctggtccaaataacacttcttttgcaagtccttctaacaactcgtatggaggttcttcaaataagggtccacaacaacaagctcagccagatagaatgtccaaaatggaagatactttaa

SEQ ID NO: 30502 - DNA, 1044 bp, Glycine max
  Peptide Sequence Number=SeqID_122187
atggattgggaccagctcttggccgggataggaagtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgaggggagcatcgacggaagaaagcatgtctcctttccttgtgagggatctcggcgcacaaaattccaagactatacaaagaatccataaagcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaagagaatacaattaccgcaagagcccttgaacgagagaccaagagggctcgcaaggaagagtatggccggaacaaatttcacggagccctatggggtagcaataatgaactcaagttgcgaagggaggacagggaccagtcgcgagcacatagcatgcgcttatgcgagacagagaccaacatgttagctatcatcaccaagtaccaagaagagttaggtctagccacggcccacgagcatagaatcgcggatgagtatgctcaagtgtatgcggaaaaagaggctagaggaagggtgatcgactctttacaccaagaggcaaccatgtggatggatcggtttgctcttaccttgaacgggagtcaagaacttccccgattgttggccaaggccaaggcgatggcagacacctactccgcccccgaagagattcatgggcttctcggctattgtcagcatatgatagacttaatggcccacataattagaaatcgttag

SEQ ID NO: 30503 - DNA, 165 bp, Glycine max
  Peptide Sequence Number=SeqID_122188
atggtacctttgacatcaattcgagggcgaattcttcccaagaaggagggtatgataaaggactatctaaggagaaagagtttggcttgggtgggctcaacatggatagaccaatcattagaacaaggagtaagagatttcaataagagtttggcgagagactaa

SEQ ID NO: 30504 - DNA, 539 bp, Glycine max
  Peptide Sequence Number=SeqID_122189
ggcttttttcgttcgtcaagctttcgagcagctctttcaactgccgcctaatctcctctcccaacataacatgctcaagaaccgagagccgcccagggactgccggagggagcttgcttataaaaagaagataggccggttgcccgaagggctatctgatccgatcaactgcgtaagccgtagcgcgctagcgcgcgtactcttcctctatgagcgagactccatccaaatctgccactcgttgggcgacgccctcttttctatgaacaccccaccactgaatgatgaactttgccagtcttcgcctccgacccgaccaggagagaacacagagtcaagccaagcccttacccgccagaatggaattcatatctccttcgtctgggcaagtgtactagcatatgagtttccagcttttgaattaagctctcgggcattgattgaggaagtagcccaaccttttttcatctacgcaaagaggaattacttcttattttattcgaccggaaatggtgcatctagatcgattcctaaggctg

SEQ ID NO: 30505 - DNA, 186 bp, Glycine max
  Peptide Sequence Number=SeqID_122190
atgaccggtcacaatggttcgcatatcatttggctcatacttgcaggttcaagtggccaaacgctaacccataaggaaggagggaacatggttaatgttcccctcaaaacaaaaatgtgtgccaggttagctcgcttgggcgagctgagctcgcctgggcgagcaacccgtgcattcaaaatataa

SEQ ID NO: 30506 - DNA, 378 bp, Glycine max
  Peptide Sequence Number=SeqID_122191
tcgttcagggttcctgtcacacttagtaaggccccagacgcaccaccgccacctcctcaggctgacccagctgggtcatttgacacggagcagtatttacggcatttggttcgccagcaggcggccaaccacagggcgcacttgcagacccatgactgtctctaccagctcagcctcagcctgcagagccagggttttgcttcttttccatgccctactccggatcaattcagggcagaggtcgcatggcccggagattggcccgaggaccaggcaggggaggcgcccgcagaggctcccgacgatgcatatgaggcccgcatggatgaggagatgacagatttactcgatttcttgggagggagcgaagccacatga

SEQ ID NO: 30507 - DNA, 288 bp, Glycine max
  Peptide Sequence Number=SeqID_122192
atgcagaactatcaatatgcaaagagatgtgattctgtaaaagcgaagaccaacagaaaacgtgttatgcagcagaagcgacatggtcatgctgagtcatcttcacaaccaacagttaattgcacttcagaatataatatgattgtttctgattcatcagaaagtgaaaattctgaatccacacaaggttcaggctctaattttatgactcccttcgaggattgtcaatctccaactaatcagcctgtaatcaacactgaaggtaatgactataattctgatttctag

SEQ ID NO: 30508 - DNA, 265 bp, Glycine max
  Peptide Sequence Number=SeqID_122193
atgggctcacaaatctaccctaaggtttatgagaaccctaaggccttctttatcaactctagcccaatcctcttggagcctcttgctcatggctctggtaactggtcctttcctaaggaggattgcatcaggctaggtccaccaaaccatccacgcccactatgccgattcgagtttgctttacgcgatccaatcctctacgccaaagccctgaacagaactgcaatcttgctcaaggagggaagaaacccagagaaaaaatacg

SEQ ID NO: 30509 - DNA, 438 bp, Glycine max
  Peptide Sequence Number=SeqID_122194
atggcgcctaccaggcaccctctggacccagataagtccaacagggccctgagatttcccgctttgatcacaggactctgccagtcgttcggagtccccgtcgcacctagcaagagacaggcccagggggatgctccgcaggccgcagacgcgccgccacctcatcaggctggcccagctggatcgtttgatacggagcagtatttgtggcatttgttgagcctcagcctgcagagccagggttttacctcttttccgtgccctactccggaccagttcagggcagaggtagcatggcctggagattggcctgaggcccgggcaggagaggcgccaacagaggcaccagcagaggctcccgacgaggcagatgaggcccgcgaggacgaggagatgaccgatttacttgatttcttaggagggagcggggccacatga

SEQ ID NO: 30510 - DNA, 774 bp, Glycine max
  Peptide Sequence Number=SeqID_122195
atggatctcaatcgaaaagtcattactaatgacaataataaagaaattccttacgttgttaatacattaatatttacaatagcccaacatttcattggagacccatctctctggaaagataggtctgcagaattattgtcaaatcttaagtgtagaactttagctgattttaggtggtacagagataccttcctaaccagggtctacactagagaagacaatcaacaacctttttggaaagataaatttctacccggtcttccaagatcattaggagataaggttagagataaaatccgtagccagtctgctaatggagacattccatatgaaagcttaagttacggtcaattaatttcttatgttcaaaaggtagccctaaaaatttgtcaagatgaaaaaatccaaatacaattagccaaagaaaaagctcaaacaaaaagggacttaggttctttctgcgaacaatttggcctactagcttgtccaaaacaaaagagaaaacaaacccctaggaaagaaatccatgagaataaaccagtccacaaaaagagatttccaagaagaaaatactcggacaaaccttcaacaaaggaagaaacagaaacttcatcctccatgctctctgagaaaaatctcagcaaaatccaacaacatgaccaactatcatcaatggatgatgatagacaaattaacaccctaacaagagaaccagatctcttgtttcaagcaatcaattctatacctgatccccaggaaaagaaggttttctag

SEQ ID NO: 30511 - DNA, 318 bp, Glycine max
  Peptide Sequence Number=SeqID_122196
atgggggaatacgcaaaagatgaggaattgttgatacattccttccaagaaagtcttactgggtatcagtacaattttgatatggttccggatatgatgcaactacagaacatgtgcaaaaagggggacggatcattcaaagaacacgcccaaaagttggagggatctggcggcccagatttggtcttcgccagtgaaaggatcaatgtgggtcccaaaagaggcaaatttgatcatcctactaggacgactgagaaaactggggcaaataaagagggtgaggatgagggagaaacccatgctgtgactgccattcct

SEQ ID NO: 30512 - DNA, 207 bp, Glycine max
  Peptide Sequence Number=SeqID_122197
atgcaggtgccttatactaggtgtcctatttgtccacagttcaaaagatgtctttggaactgccttactaggaaccctattcaacaaatacatggcagttttcaaggcatacatctacaaagatacggtaaatttctaacgcatccattgcctaagaaatctcgggcagtaagtagacataaccgtaacgtgaataatcatcaataa

SEQ ID NO: 30513 - DNA, 126 bp, Glycine max
  Peptide Sequence Number=SeqID_122198
atgaggtttcaaaaacaaggcaaaacaaatagacataaacgaggttcaagaagcattaaaaacaaggtcattatggagctgcgtaagaaacggcgtacgacaaataaaagctttggaactaattaa

SEQ ID NO: 30514 - DNA, 378 bp, Glycine max
  Peptide Sequence Number=SeqID_122199
gtctgcttcacggtagacgtcgaagccgatgcgtccgaagtaggaggaggacgaggaggagaaggagaagaaggaggaggaggtgaaggaggaggaggagtggaggcaggtggagaacccatgatcttttatacaataacatacaaaataggattaatgaatagagggtcagtcataagttttttttggaaggcaaaaaaaagaaagaggggaacaagcaacaatttgaaggttgtacattcaggaactaaagaattcaaaatagctagtaataagagggatttgtttttgggattttctgagcaccaagagcggctacgcaagaagcttgcagttgaggagggaaggatatttgcagctaatgaacaactttcttaa

SEQ ID NO: 30515 - DNA, 174 bp, Glycine max
  Peptide Sequence Number=SeqID_122200
atgaaggaagcaaaagaacatcacctggatgaagatgctctgatatcacatgatatagctccttgtggagctttggaatggagatggaagaatgatgaatggagatgccacttcaaggagaagatgagtcaagaagaagctcaccaccataggaagccatggataagagcttga

SEQ ID NO: 30516 - DNA, 156 bp, Glycine max
  Peptide Sequence Number=SeqID_122201
atggagacgttttatggatgcaacctaaacatgtttcagaacatgtttggaatggggaatcagacagaaaatcgcacatcagacgagctgtcccgatttatcaagttgggagtcagaccacaggaaggtgaacttcaaggtagtgtggtccaataa

SEQ ID NO: 30517 - DNA, 858 bp, Glycine max
  Peptide Sequence Number=SeqID_122202
cccaacatttcattggagacccatccttgtggaaagataggtctgcagaattattgtcaaatcttaagtgtagaaccttagcggattttaggtggtatagtgatactttcctaactagggtttacacaagagaagatagtcaacaacctttttggaaagaaaaatttctagctggtcttcccagatcattaggagacaaggttagagataaaatccatagtcaatctgccaatggagatattccatatgaaagtttaagctatggtcaattaatttcttacgtccaaaaggtagccttaaaaatttgtcaggatgacaaaattcagaggcaattagccaaagaaaaggctcaaacaaagagagatctaggttctttctgtgaacaatttggtctaccggcctgtccaaaacaaaaaacctcggaggaagaaacagaaacttcatcctccgtgctttccgatgaaaacctaaacttaatccaacaagatgaccaactatcatcaacagatgatgatgatgggcaaatcaatactctaacgagagaacaagatctcttgtttgaagcaatcaattccatacctgacccccaggaaaagaaggtttttctggaaaaactcaagaaaacattagaggtaaaacctagacaaaaggattttatcacgaacaacaaatttgatgtaagtaacatactcaagagattagaaaattcttcaaccaaaccaacgacaatccaagatctccaaacagagataaacaatctaaaaagagaagtaaaagaacttcgtcaacaacaagaaattcatcagatcattctttctcaacttgaggaagatagtgattctgaaagtaccaacaaca

SEQ ID NO: 30518 - DNA, 125 bp, Glycine max
  Peptide Sequence Number=SeqID_122203
atggctttttccggaggggccctggtgcttaccaacatggatggcgaggagctacctttacccgggcagaatcaactggtcgtggtcagatgccaggatgaagttggaggccgaaacccatcaag

SEQ ID NO: 30519 - DNA, 405 bp, Glycine max
  Peptide Sequence Number=SeqID_122204
atgaccatgattacgaattcgagctcggtacccgtaggaatggaggctcatctgaggcaaatgatctctaggaagctatttaggaaagctagaaagtcaaaggcgaatgctacctggggatcctctagagtcgacctgcatgcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 30520 - DNA, 339 bp, Glycine max
  Peptide Sequence Number=SeqID_122205
atggctggaacaaattccgagaggctctgtggggcagtaatagcgagcttaagctctgaagagaggaaagggaccaatcacaagtccaagagaagcttgtctcagcgtttatgcgagaccgagaccaacatgctagccatcatcagcaagtaccaagaggaattaaatctagccatggcccatgagcacaaagtggcggacgagtatgcccgagtgtacgcggaaaaggaggctagaggaagggtgatcgactcattacatcaagaggcaacaatgtggatggatcgattcgctcttactttgaataggagtcaagaacttcctcgattgatggcctag

SEQ ID NO: 30521 - DNA, 159 bp, Glycine max
  Peptide Sequence Number=SeqID_122206
atggaagaaggagcttctacctccatagatgagccttggataagaagcttggagaggatgcttcaatgcctaatctacttggagtcttctacccaatgcccttgcggggtaggattgcatcaagccacaactcagcaccacaactcaacttcatcatag

SEQ ID NO: 30522 - DNA, 160 bp, Glycine max
  Peptide Sequence Number=SeqID_122207
gcaatgtgaactctcccaagacattgaagcatttaatgttgctagtccttgcttgggaactagtcttaggggtggatttctttatggtcttaccctatcttccttgggcgttgaaggtgtagcccccaaaattccttgggcttggtccttacctgtgaag

SEQ ID NO: 30523 - DNA, 402 bp, Glycine max
  Peptide Sequence Number=SeqID_122208
atgaagcgcatttttctgttgtggctcctggcgctgacgtgccgggcacaggttcagccagccgaagaccctactgccctgctggcccggttgtggcccgaccaggctgagtcgctcaccgaggagcatgctgaaaacctgtatcagctctaccagcaaccgctcgacctcaacgcggccggggaagaacaactggcgtctctttttctgttaacccctgcccagatacgcagctttctccgctaccggagagaggcaggtccgctcgtttccctttatgaactacaggccgtgccggacctgaatattcccctgatccggaagctgctgccctttgtccgcgtaaaaaagtacactccgcaaaaagccgacacacgcttctgctgcggtatgacaggatag

SEQ ID NO: 30524 - DNA, 978 bp, Glycine max
  Peptide Sequence Number=SeqID_122209
atggccatgttcgatctagaaatagtccttgagttttatgccaatgcttggcacacagaggagggcgtgcgtgacatgagatcctgggtaaggggtcagtggatcccgtttgatgccgacgctatcggccagctcctgggatatccgttggtgttggaagagggccaggaatgcgagtatggccagaggaggaaccggtctgacgggttcgatgaggaggccatcgcccagctgctatgtataccggggcaggattttgcccggactgttgcagggaggcgagtgcgaatcatgcacaccaacatgaccaccctgacccatatatgtatgacgttgctgctcagcaacatcctacccaccgatcataattccgacctccccatgccgaagtgtcagctggtgtatgtcatcctgacacggatgagcatccatgtggctcagttgatcgctgatgccatctatatttttgcaggtatggcgcctactaggaaccctttggacccagataagtccaacagggccctgggatttccctcgctgatcacaggactctgccagtcattcggagttcccgttgcacctaccaaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagcctcagcatgcagagccagggcttcgcttctttttcatgccctactctagaccagttcagggcagaggtcgcatgtcccggagattggcccgaggcccaagcaggagaggcacccccagaagctcccggcggtggagaagaggcccacgaggacgaggagatggtcgatttgcttgacttcttaggagggagtggagatacgtcactgggagatccccagattcat

SEQ ID NO: 30525 - DNA, 276 bp, Glycine max
  Peptide Sequence Number=SeqID_122210
atggaagagaggtctttactttcagaaatagcagttaccttgggctgccattccgcacttaaacatcctaaaaatttattaatcaaatcttcattaggaaagatttttcctagagaagcaagggtattggattcttctcctatcttcttctgtccacttatctctaggtttttgggttgtagtgcttgtgcttacatctactatagtgggaaacaagggattgaggaggccatgaatcttgaagtggttagactttctacaagaaacctgctctaa

SEQ ID NO: 30526 - DNA, 552 bp, Glycine max
  Peptide Sequence Number=SeqID_122211
atggacgatgcgattcagatgctggtggacttgttgatggtctctccagagtctgctagggctgagacagtccagtgtcgtggacctgcaaccaatgtacatgttgtctacttagaggcctttcgtgacctcagtatgacggagaggtatgcctggggagtggttgctttggtgcaattcgcggactccactgctgatcaggagtacgacgaggattctccgcatgcgcgtaggtggattgcaacgaagaagactgtgaagagcatttgtacgccggcgtacatggagcacttggaccgactccggattctggatgtctgttggatcccgtatggagagtatcgatcggtccgggacttccacgtcagatcatgctattctggtctcttgcggtgggggcctattgctgtttattaccaaccagagagggtcatgcggcagtttggatacacgcagaccattcctgctcctcctatcgattcatgggtgtcgtatgatgatatacacgataggtggatgcactactcggatcatatcgttcctgtaggtgag

SEQ ID NO: 30527 - DNA, 150 bp, Glycine max
  Peptide Sequence Number=SeqID_122212
atggttagaagtcgagacaaagttaaacggcagaaatcaaccaagggaaggatgcaaatggaggatagggtcacgaccgacagatcatcgtcccttcccggtgctggacaagtggaaaacgtcgctgcaaagcagcccagtatcctttaa

SEQ ID NO: 30528 - DNA, 744 bp, Glycine max
  Peptide Sequence Number=SeqID_122213
atgagcgatacgcagtggctggaatggggcaggaaaaacccatattacggcgtgtattccgaagaccgatttcacacttcaaatatcgaggcaacgaagggggaattcttcgcaaccggggaagccaatgtctcttggatgctgggtcgtgcggaacagtattgcgggccgttaggtaaagggcgtgttcttgagttcggtgccggggtggctcgaatgagcataccgcttgcgtcccgttttgaaaccgtaatcggcgttgaactatctccagacatgcgtgccgaagccgttaagaattgccagttatacaatgtcaaaaatgtcgaaatggtcccttcagacgacgatttaagtcacgcttcgggcgaatttgacctcgtcctcagctatatcgttctccagcacgtagatgccaggaggggagtgatgctgatcgacaagttgctgtctaaggtcggccccagcggtgtcgccattctccaggcgagcgtcaaacggcctgaacgccgcttgtcagaccgcctacgctatcacctgcgccacaatgtgccagtgctggcggcaacatatagattcctgcgtggaaaaggctggaatacactttcaatgcgaatgtcggaatatgatcctatcgccatcctcgcggtgttcagtcggaacggaatgaaggacgttttgctttccgagcattatcaaggtgatgtccttacctttcatttcacggcgagaaagggcggctaa

SEQ ID NO: 30529 - DNA, 222 bp, Glycine max
  Peptide Sequence Number=SeqID_122214
atgaccaaattttgtctccgcatgtcatcgggcccgccgcctctggatgataaagggtgcatgtcacatgacctcagggtcagtgcggataaccgtaaggtgtctccgcgggctaccagctcttgggtcatggtaacaaaaagcggtgcggtcgacaaaagcgaggctcttgctcctacgtatcctccaatgaggaactcagacctacgtagttctggataa

SEQ ID NO: 30530 - DNA, 120 bp, Glycine max
  Peptide Sequence Number=SeqID_122215
atggaagctctcgagaaattcaaatggctaaaggcccaagtggagaaggacgaaggcccaagtggagaaggactaagcccccgagtggagaaggatgaaggcccaagtggagatggatga

SEQ ID NO: 30531 - DNA, 609 bp, Glycine max
  Peptide Sequence Number=SeqID_122216
gtagctgtgtctccggcaaaaccacctccaaagcccgatccggaggttgatgatccgctttatctaatgacattgaccatcccagagcttttcttaaggccttatcaagttagatgggatgccaccgtgttcggggtctttaatccaaatttccccctctacataaagcatgaagacctctccgaaatcgcacatggtggtcaatgtcttagcatctcactgaaacatccacagtccattcagaggtttgggcaatcgcagtttgagtttgaaagttacataaagacttggatgcagagttcaaaacgcgatgtctatcttggagcctacctaaatggcggacactggcagatggtggtcatcctgcccaaggaacacctagttgtctggttttgttcattgcataacaggccagacaactaccttaaggggattattaatagtgctttaaaaggtcttgatgatgctccacagcctaagtcaaaggctcctgctaagtggattgtcgtccagtgtaatatacaaaaaggaagtactgagtgtggctactatgtgatgcactggatgtccaacatcattttaggaacttttaggaataattgggaagcg

SEQ ID NO: 30532 - DNA, 606 bp, Glycine max
  misc_feature (35)..(35): n is a, c, g, or t
  misc_feature (86)..(86): n is a, c, g, or t
  Peptide Sequence Number=SeqID_122217
ggggaaacgcctggtatctttatagtcctgtcggntttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtaccttgtctgactcagaccaatttcaaggaacccgatgaactaagcaacgtcactttcctcccaacggctatttacaaagacaaaatccaacggttctcatcgccccggcggttgccgccctacaccattcaacggtattcgtctaaggttgccgaccgcaacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30533 - DNA, 453 bp, Glycine max
  Peptide Sequence Number=SeqID_122218
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccgggggggcttttcgttgctgactatggtatggttcagcaacaacccctattgaattattcggtcctactcgttatcaatgggatcagggatactttcagcaagaaatatatcgaagagttggtgctggactag

SEQ ID NO: 30534 - DNA, 577 bp, Glycine max
  Peptide Sequence Number=SeqID_122219
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggttagacacgacttatcgccactggcagcagccactggtaacaggattagcagagcgag

SEQ ID NO: 30535 - DNA, 369 bp, Glycine max
  Peptide Sequence Number=SeqID_122220
atgtccaatctttctgaatttgggatgatcgaccctcttgatgagtcaatctcttgcattctcataagggtggacccgtgggtacacgccctcaccttcagagggctgcacgccctcaccttcagagggctacacgccctcgccttcagaggactacatgtcctcacctttagagggctgcacaccctcaccttcagagggctgcacgccctcgccttcggagggctacacaccctcgccttcagaggactacatgtcctcaccttcagagagctgcatgccctcaccttcagagggttgcacgtcctcgcctttagagggctacgcatcatcactttcagagggctccatgtggcgtccctaaattaa

SEQ ID NO: 30536 - DNA, 327 bp, Glycine max
  Peptide Sequence Number=SeqID_122221
atgaagacaggggctaagatggtctctggtaatcgattaccagggaatatcgtgatggcggcgcagctaatccgtgatcgagtagagatggagtgcctaaagggagcttgggagaccctcgaaggcaacacgaggtgccgatttcggggcaccattcgattcacggctacttctttggtgcatccagatgaacctgcacggacgcttcagcgcacggtggagtggacaactccttggattagttttgtatattttttagggtgggcgtatctaggactgactgttaggtttactcttttgttttgtatgggtagacctgatgtatag

SEQ ID NO: 30537 - DNA, 282 bp, Glycine max
  Peptide Sequence Number=SeqID_122222
atgcaatggcggttccaaagtcagaaaagatgcaaagacaagctgaaactaacaagaaacaagcatagaaccatggttgcctcgaaggaaaatgaaaggttgaaatgcttaaataagaaatgctctcgggaacggaagcttcgcacagactccaaacattttctcaaagatcccaatggtcagatcgtggaaaagtgtcttgtgaagctgcagaccgaatttcgaaaagatccaactgttaacgaaggctgggaagggtttttaccgaggcagctcatgtag

SEQ ID NO: 30538 - DNA, 222 bp, Glycine max
  Peptide Sequence Number=SeqID_122223
agaagaagaatagagaggcgtcggaactttaacaatggaagaagatcacaagaagactctcaagttcttagatgttacaaatgcaaccaacttggtcacatcaaagctaattgtcctttaaatgaagaaaggcctgagaaaagtgataagaaaaggtattatgaaagaagaaccaagaatgcctacattgcatgggacgacaatgattcatccgatggttaa

SEQ ID NO: 30539 - DNA, 534 bp, Glycine max
  Peptide Sequence Number=SeqID_122224
atggccaagttcgacccagacatagtcctcgaattttatgccaatgcttggcctacggaggagggcgtgcgagatatgagatcctgggtgaggggtcagtggatcccgttcgatgcggatgctatcagccagttcctgggatacccctttagtgctggaagagggccaggagtgcgagtatggccagaggaggaaccggattttgcccgaactgctgcagggaggcgagtgcgaatcatgcgcaccaacatgaccaccctgacccatatatggatgacgttgctgctcagcaacattctgcccaacgatcataattccgatctgcctttgccgaagtgtcacctggtgtacgccatcctgacacggatgagtattcacgtggctcagttgatcactgatgccatctatctatttgcaggtatggcgccgaccaggcaccctttggacccagataagtccaacagggccctgggatttcccgcactgatcacaggactctgccagtcgttcggagtccccgttgcacctaccaag

SEQ ID NO: 30540 - DNA, 147 bp, Glycine max
  Peptide Sequence Number=SeqID_122225
atgatgctctcctacaacctaaggcaaggtccagtgctggtgcagatgatggatcctgagaaagaggccggtccaacactggtgcagatggctcaagctcaggctaaggagatggctctggtactacaacatcctcctgaacaataa

SEQ ID NO: 30541 - DNA, 396 bp, Glycine max
  Peptide Sequence Number=SeqID_122226
atgaataaaaaatctgcacctgttgcaagagtctgtggtctatgttcttctgcagatcaccatacaaatctttatccttctttgcagcaatctggagtcaatgagcaacctgaagcttatgctgcaaacatttataatagaccccctcagcagcaaaaccaacaacaacagaataattatgatcttttaaggaacatatacaatctaggttggagaaatcatccaaatctgagatgggcaagtcctccaaaacaacaacaacctgtccctcctttccagaatgctactggtccaagcaagccatatgttcctcctccaatgcaacaacagcagcagcagtcacaacaaagacaacaattaactgaggctcctcctcaaccttccttagaagagtaa

SEQ ID NO: 30542 - DNA, 312 bp, Glycine max
  Peptide Sequence Number=SeqID_122227
atgaggggttaccttatgatcacccgcacctttcgtcaaccaggggcaaacgagcccgttgacgcgcagagactaacatcgtcttctgcaccttttgccatccagggacagcgagtcaggtggcaggcggagataccttatggtcatctgcacctttcgtcaaccgaggggaacgaattcgatggcatcaggatgatgttggtcgttcgcctggcgacgcgtgagattcttctctactgggtagggacgatcgagtgcaatggcgaagggaagtgtcatggttgtccaactttgtcgctttcatggcactga

SEQ ID NO: 30543 - DNA, 249 bp, Glycine max
  Peptide Sequence Number=SeqID_122228
atgtcaggacatcgtatccgacatcttggatcctgcagcttcaatgcttcacttgacttttatcttgcattgtacagcacttccagtattctcgagcaggatgtcaggacattgaataatcaacataaaaatacagaaaaaggtgtcgagggaaagagcctagagtatgaagaacctcgggatttgaggtcaaatcctttccaaggtggaggggatgatgcaatcctaccccccaagggtattggatag

SEQ ID NO: 30544 - DNA, 687 bp, Glycine max
  Peptide Sequence Number=SeqID_122229
ggacgggggaagcccgtctgatagcgctctgtgcgcgtactccgaaagggaatcgggttaaaattctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggctgggcacgggggcccatcccgaacccgtcggctgtcggtggactgctcgagctgcttccgcggcgagagcgggtcgtcgcgtgccggtcgggggaccggattgggaacgggcccttcggggcctcttccccgggcgtcgaacagtcaactcagaactggggcgaaagaaatcaaccaagcgcgggggggttccctccagagtttcgcctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 30545 - DNA, 827 bp, Glycine max
  Peptide Sequence Number=SeqID_122230
gcccgtcgaaagcagctcgccatcggcggcattgccgggtgcgagatcgaaggagatgcgaccgccggcgtgggccggtgccggagaaccaagaggtgcgaggcccccgacgagcatggtaacagtcatgagtttcaatatgttgcgcgtcattctgatctccatccgtcagcaccttgccgatgatcgaacatcgcatttcgcaactgaacctgattggaactgccccggcgcccttcacggggataatttacgggcatgtcttggcttagtcgccatcaacctgctttgtgcagctgaagctccggccatcgataaccatatcgagcaccgccttatagcgggctcccttcgcatcgagcgttaccgcgctcagcagttgcggacgtccggctgcggcatcaaagtcgccgccctgattgatcaccgaatgtccgccgcttcccgatttttcgacgtgaaagccgtaggtcccgccggcagtgacatcggctccggcaaaggcctccagcttcgccatgcccgcctgcgacgttgccctgatctcgcagacgtttccagccgtcgactcccgtgcggtcgatatggccgcaacggtaccggcgggaagcagtgccagcgcaaggatcgccgccaggcggcgcttatgactgatgctgtggggcatggctgggcaggcttgcacgaaggcggcgacattgtcgttgccgccctggctcacattggcgctgcatccgcggcccacctggacaccggccgcgatgttgccgttgccgtcctgcgtgaggatggtggtgtgattggacaaaactggccgggccggccac

SEQ ID NO: 30546 - DNA, 231 bp, Glycine max
  Peptide Sequence Number=SeqID_122231
atggcgaggagttgccctccaaggagcagaatcgtctcaggccacggtcagaagtcaagacaagtcaatggtagaaatcaaccaaggtacatagggacggatgcaagtggggctagggtcacaaccgaccgatcgttgccccttcccggtgctaaacaagcagagaacgtcgctgtaaggcagcccagtatcctttgcgtttacagtttcttttactattgtttgttttaa

SEQ ID NO: 30547 - DNA, 345 bp, Glycine max
  Peptide Sequence Number=SeqID_122232
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggacagaggaaacctacccaaaggtccccatcaccctagttgatacgtgggtattagcatcatcggttagcctggcaagtccaaagtctgcgggtaccgagctcgaattcgtaatcatggtcatagctgtttcctgtgtgaaattgttatccgctcacaattccacacaacatacgagccggaagcataaagtgtaa

SEQ ID NO: 30548 - DNA, 311 bp, Glycine max
  Peptide Sequence Number=SeqID_122233
atgacaggtctatcccatagtcggcttgatcatcttacctcatgttcagattcctctttactggatgaagtcagagtgacttatcttggggcggaagttggacttgatatccttgcacagaaacactattggcataggtggaagatgttcgggatctgctcagggacagaagctgatgttctttgtatggctggcattttccatcccatgaacttcgttgacaagttcgtttgcatactgtgctttgtggagaggaatatggatcttccagagtctgaccactggagctcccgaaagtttcttttggtgag

SEQ ID NO: 30549 - DNA, 243 bp, Glycine max
  Peptide Sequence Number=SeqID_122234
gtcgactctagaggatcccccgatcaggacgatgtcgaggacactgtctgtgacaaatacgacatcagcaaggaaaagtgggcccagttttgccagactcgcagagacccttcttgggaggatgtgcgcatcaaggcacaggccatccagaagcagaatactgccccccacgttttgtctcgtgggggttatgattatttggagcagaagctcctggctgagaagaccaagaagaagctgtag

SEQ ID NO: 30550 - DNA, 609 bp, Glycine max
  Peptide Sequence Number=SeqID_122235
atggacccttgggtactagttaccctcactgtcagaggactacacgtcctcgccttgagaggactacacgtcctcaccatcagagggctgcacgccctcacctccagaggactacatgtcctcaccatgagagggctacacgccctcaccttgggtactagttaccctcaccatcagagggctgcacgccctcacctccagaggactgcatgtcctcgtcttgagagggctacacgccctcaccttggagggctgcacgccctcacctcgagaggactacatgtcctcgccttgagagggctacacgccctcaccttgggtactagttaccctcaccgtcagaggactgcacgtcctcgccttgagaggactacacatcctcaccatcagagggctgcacgcggggcctctagaggactacatgtcctcgccttgagagggctacacgccctcaccttgggtactagttaccctcaccgtcagaggactacacgtcctcgccttgagaggactacacgtcctcaccatcagagggctgcacgccctcacctccagaggactacatgtcctcgccatgagagggctacacgccctcaacttgggtactag

SEQ ID NO: 30551 - DNA, 573 bp, Glycine max
  Peptide Sequence Number=SeqID_122236
atgttattccgatctcttgcactaggggcctgttgctgtttattaccgaccggagagggtcgtgcggcagtttggctacatgcagaccattctgatcctcctgtcgattcatgggtctcgtatgatgacatacattacaggtggatgcactacaagaatcatatcgtaccaacaggtgaggtgtgcgttgtgccaggggcgtgttccagtgactacatgaactggttctttcgcatctctcatcctttcatgacactaggccacgcattagatcctttgcctcatggtcacgccccgcagccccgagtcgtccctcaggccccacagacggatatccctcgcgtgccggagccaggagcatcgtcgacatctgcggaggagcccagacatgcagtggaagtttgtgatgacattgttgagaggttggagcgccatctgagtctaggggtggtcacgcctggctcatcgacacatgaggtgatcaaagaatgtctcaggttggccaggagtgtgacacaggaccatcttgtatatgttaggtctagacgcaggcggcgcacggatcaggcgtag

SEQ ID NO: 30552 - DNA, 482 bp, Glycine max
  Peptide Sequence Number=SeqID_122237
aaagtcttgatcaaaacttgtgctattcttcttcattcgcttctcttttagcaaagaatagaaggactaaccacctgaattcttttgtgtctctcttctctcttccaagagaattcaaaaggactaaccgcttgagaattctttttcctaacacattggagggtacatcctttgtggtacaagtagaaggtacatcctttatgaacaagagagggtacatctcttgtggatcagttcaagtggagggtacatccacttggttattcaaagagaacaagggagggtacatcccttgtggatctttggcttgtaaaggattttacaaggttgaaagaaatctcaagaactggttggttgcttggggactggacgtaggcacagattgtggccgaactagtataaatcttgtatttgtcttcttcttccctacactctttaatttccgccgtgtacttttaattcccacttttacttttggttaa

SEQ ID NO: 30553 - DNA, 141 bp, Glycine max
  Peptide Sequence Number=SeqID_122238
atggtgggttacacaccttcatgctttgcggatttggtatttgtcggcgaaaggatcaaagcgggtctagaaagagaggatgagaatgagggagaaacctttgctatgactgccattcctacacggtcaaatttcccataa

SEQ ID NO: 30554 - DNA, 300 bp, Glycine max
  Peptide Sequence Number=SeqID_122239
atggagagaaacgaagaaacaccaatggaggagaaagtaaagctgaaaattagtggaggtttaaggagcacctacttgaagctcttgtgctctgataccacttgttggaagcttgcttatgaagcttctatggaggctagatctttgagcttcaataagatccttcaatggagaagcttcaccaccaagagagtgacttggataagaagcttaaagaggaagcttcaatggaggaagagaataccagagagagagggggaggaggggggggggcgaggtgtgggaattgaaggagattag

SEQ ID NO: 30555 - DNA, 317 bp, Glycine max
  Peptide Sequence Number=SeqID_122240
gatttacacgcgattctcctcaaatttcagccagcccgcatcaattagaccttgcaccttacgcttcagagccctacaatgctcaatggaacgccccggggcttctctgtgacaagcacatgttgcgttcgagtcgtattctcggagaaatggaggttgatgaaccttggctaggggttatggctaccattgaattatcaaactttgtggctgatttagggattgcctttgtggataattgggcggtgggtaaggagaaggtttgttattggctgagtaataacattgttgggttggtgggaaacttggctgtatag

SEQ ID NO: 30556 - DNA, 159 bp, Glycine max
  Peptide Sequence Number=SeqID_122241
atggttacccaaaacaatgagagtagaaattttttgctctgggaccatgaatgtgctaaattgattggtgaaacagctgatgatgtgaatagggtcaagattgaagaatggtatcgcttcgtgagcaattccttcaaggcgctcaaaactattgattaa

SEQ ID NO: 30557 - DNA, 411 bp, Glycine max
  Peptide Sequence Number=SeqID_122242
atgcaagtcaaggtcaatgagcctaggcatcaccagtctaaggaagagttagggcagttgatgggtcagctgccagcggcaagcttttcgcaaaggcttacgcccagtattatgatcgccattgaggtgctaccgtttgtgggacttccaactgtcacagttggtggaagattgaagagacctaaggagaagtcctctagggggaagaaagaggtgcatacctcttctcagataggttctacccctagcattagctcagaatttctaaaaaggtcaaatcttggcacaggattagaccgccaaaagcaagtcgaaaatggggtggttggaatgagagaaaatgtactaccaccaggccttggaaaaagacaagaatcttggcaggtaaaggcgaatgggccctgttcatag

SEQ ID NO: 30558 - DNA, 357 bp, Glycine max
  Peptide Sequence Number=SeqID_122243
atggttgacgagagagagatcaccatgatggtagacactctgccaggttctactatgagaagcgaggttacatggcctccagctttgacggagctatgttcggaaatgaagcagctcatagagaagaacgcggccaccgccgccgctgtcagttcggctgccgaagcagacccgactctcttggcaactgcgcaccatcctccctcaaacatagtaggacgaggaagggacacactggggcacgatggcagccctcacctgggatacaaccgagcggcttacccttatggattgccgcccaactattcaccacccgtcttgcagaagatgcggccacattgcttctcctgtccatga

SEQ ID NO: 30559 - DNA, 947 bp, Glycine max
  misc_feature (919)..(919): n is a, c, g, or t
  Peptide Sequence Number=SeqID_122244
atggccccgaggaaacttgcctcaaagagatccaggaaggataaagcggccaaaggaactagttccgctcccgagtatgacagtcaccgctttaggagcgttgaacaccagcagtgcttcgaagccatcaagggatggtcatttctccgggagcgacgcgtccagctcagggacgatgagtataccgatttccaggaggagatagttcaccggcggtgggcatcactggttacccccatggccaagttcgatccagacatagtcctcgaattttatgccaatgcttggcctacagaggagggcgtgcgagatatgaggtcttgggtgaggggtcagttgatcccgtttgatgcagatgctatcggccagctcctgggatatcctttagtgctggaagagggtcaggagtgcgagtatggccagaggaggaaccgatccgatgggttcgatgaggaggccatcgcccagttgctatgtataccagggcaggattttgcccggactgctgccgggagacgggtgcggatcatgcgcaccaacatgaccaccctgactcaaatctggatgactttgctgctcagcaacatccagcccagcgaccataattccgacctccccctgccaaagtgtcagctggtgtatgccatcctgacgcggatgagcattcacgtggctcagctaatcgctgatgccatctatatatttgcaggtatggcgcctaccaagcaccctctggacccggataagtccaacaggaccctgggatttcccgccttgatcacaggactctgccagtcgttcggattccctgtcgcacctagcaaggtgattcggccgcccatcacccgagcttttattgagaagtattgcacgcagagacaggcccagggggatgctccgcaggccgcagaagtgccgncacctcatcaggccggtccagccggatc

SEQ ID NO: 30560 - DNA, 126 bp, Glycine max
  Peptide Sequence Number=SeqID_122245
ctccagcaggtttgggagtggaagatattccagattttaggtcagagtgagactacttcgaaacaggatggggtttctgcttcgaattcgaagaatttgaattctgttgctgctgagcttatctag

SEQ ID NO: 30561 - DNA, 429 bp, Glycine max
  Peptide Sequence Number=SeqID_122246
accctcgaaggcaatgagaggtgccagttccgtggcacgattcgactcactactacttcattagtacatctggaggaacccgcacgcacaattcagcagcctgtggagtggatactacctacacctactccatatcgactagtggagccagttcaactgatagaggatgatgaggactcactccctgatgttgattctccagaggatatcatggcagcatctgaggcagactctatagaggagagcggccctggagggacagcgaatagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30562 - DNA, 222 bp, Glycine max
  Peptide Sequence Number=SeqID_122247
atgttgctaagtagcaacgtcatttatatctgtgtaagagtggtcatgttggtgagcatgatccacactcgtctttttgcaacggcacgggtgaaatcttgccccggtatgcatagtagctgcgtgatagcctccctctctggttgtgctcgcatagttggccctcctccaggatcagggggtggccccaaagttgataaaaggaaactactggccccttaa

SEQ ID NO: 30563 - DNA, 330 bp, Glycine max
  Peptide Sequence Number=SeqID_122248
atggcagcgcagttaatccaagatcgcgtggtgatggagtgcctagagggagtttgggagaccctcgaaggcaatgagaggtgtcgattccatggcacgattcaactcactgctacttcattggtgtcatcctctgaagaagatcctgaggaggacctagaggagctacctcctgaacctgttgtggatgacctcgacttacctgaggatgatgaagacccactccctgatgttgattctccagaggatatcatgtcagcatctgaggtagactctacagaggagagcggccctggagggacaacgagtagtgaagactcttcatcatag

SEQ ID NO: 30564 - DNA, 567 bp, Glycine max
  Peptide Sequence Number=SeqID_122249
atgacatccttcagccagcttcagtcacagatgcaataccagggacctcctgagcctctggttggtcctggtcccttcggtcctcgggtgagcacaaaggggagttgtgttgatccctcaggaaacgatcctgagacgggtgactctgacaggtacggcttgtacatagaagcagatcctgcccgcctggttaccgtggggagagtttatgagggatccactcttgttcataacactcctttgttgcctggccaagtaaaggtgagtgtggacaaggttaaagatgcagatgctgcagttcctgtacccactgttgaggtttccttagtggggcaggcacttcacaccttccttgcttggccgacacatcagatcaagtctttatcaaaccagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccggaccgatcgcccttcccaacagttgcgcagcctga

SEQ ID NO: 30565 - DNA, 219 bp, Glycine max
  Peptide Sequence Number=SeqID_122250
atgatgatgacaaaggtgatgacaaaaagctcaaagattaatcaaagaacaactcaagtgatcaagatagaatcaaagaacaattcaagactcaagaggaaagttaaagagtcaagaatcaagattcaaggttcaagatcccaagaattaagaattaagattcaaggttcaagatcccaagaatcaagatcaagattcaagaatcaagagaaggcataa

SEQ ID NO: 30566 - DNA, 462 bp, Glycine max
  Peptide Sequence Number=SeqID_122251
atgactatgcagaacatgcagtttcagcaagagaccagagcctccattcagagcttaaccaatcagatgggacaattagctactcaattgaatcaacaacagtcccagaattctgacaagctgccttctcaagctgtccaaaaccccaaaaataagcagcacattccccctcttccattccctccaagagcagtttccaacaaaaaaatggaagaggcagagaaagagatcttggaaacgtttagaaaagtagagcaaattccaagatatgccaaattcttgaaggagctgtgcactaataagcggaagcttaaaggaagtgaacgcattagcatgggcagaaatgtctccgcattgattggtaaatctgttcctcaaattcctgaaaaatgcaaagatccaggtcccttgcagtcaactgatgtgatggattttctcaaggatcagttcccatcattctag

SEQ ID NO: 30567 - DNA, 222 bp, Glycine max
  Peptide Sequence Number=SeqID_122252
atgtatggtctgcttgggccagcagcattttggaaggaaggagcaggctgctgtcataattgctctgctgtggttgattttgctgctgaggttaaggaggtctattgtaaatatttgcagcataagcttcaggctgctcaattgctccaggttgctgcatgggagggcaaaggtctgtatggtggtcagcagaggagcacaaaccacaaactcttgcgacag

SEQ ID NO: 30568 - DNA, 522 bp, Glycine max
  Peptide Sequence Number=SeqID_122253
atgccttatgtggagtcctcagaggagtcattagaaaccgctttccagtctttcgagttggtaagcatttcctccgtggattccatctctgggcaagcttgcctgtccgatgcagcagtgatgatggcccgagttatgttggggaacggttacgaacccggaatgggtttaggcaaagacaacggcggcataactagcctgataaatgccaaaggaaatcgtgggaagtatgggttaggctataagcccactcaggcagatataaagagaagcatcgcgggaaggaagagcggtagtcaaagctcgcggttgagacaagaaggtgaaggaagcccaccctgccacataagtaggagctttataagcgcggttctgggggacgaaggtcaactggtcgcgatatacgaagatgatgttccgactgggaaattggcgagtggaagaatgccccggcatttacgcaacgagcataatgtaaacctttacggttttaaaagctctatagttgtgcctaggctttag

SEQ ID NO: 30569 - DNA, 312 bp, Glycine max
  Peptide Sequence Number=SeqID_122254
atgggtgccaaatacctcgaagtggtcaaacgagggtcgcatcccgacaacggatggtccccggacgaaattaggataaaaggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaaggtattagcaccccacacgtccgtcccaagggacggcagcctttaa

SEQ ID NO: 30570 - DNA, 759 bp, Glycine max
  Peptide Sequence Number=SeqID_122255
atggctagttcctccggcgtgaggctgttgaaaggaacaatggatgaatttgtgcgcgccggtgtaggtaacaagggaggagtggatgatggtgtaagcaatggccactgcttgactcatggaggctggttgcataacttgaacctctcggcgaatcgccggtgtagttgtttaccatggttcgctgctgcagtttacatagcagtccagtgggatcctcgtatgtggttgatgcgaatcgcgaatggagagcatgaagaaatgccgggcaagacgataattgaccattccgagccattgaatctcggcacatcaagcttcatccgatgcgacgctgtgtgtgatcctgatgccgaaaatgaagtcgcttctgcttttgatctagtgccttccgccatacgtctaagcttgtgctcaatgaaagcaccaatgatacctagctttcgagggctagggaacctccgcgatacccgtgacctttggaagctcgaaggaactcgcaaagagagagaaaacgcgagttcagagagagaaactagaagaagaaaaggactcgagaggaaggaagagaagcttctggatttttctatattccttcaaggagatggccccgagaaagcttcccgcgaagaggtccaggaaggacaccaccagagagggtgtcgcaacctacccttcggcgggagggcgacgcgtgactcgcgggtgcgtgttccatggaaaggaatacgcgcggagtcgccaccaacgtttatttga

SEQ ID NO: 30571 - DNA, 303 bp, Glycine max
  Peptide Sequence Number=SeqID_122256
atgcctcctaaggtgtctagctcctccggcagaggaggaagatccagtaccaaaggaaaagatgttatgttggctctaccagagccaataaccaagaaggcaactacatcatcttctgggtcacctactcagactgggtcatcaacagccagaaatagaaagcttcgaaagatatggaaaagccgaaaacagcaaacaatatccaccattgcagagacatgcctttgtaaagtggtggtcacaattcgatacctcaaaggatgctccagaacaagtcaagaactggtttcagagcaaccctga

SEQ ID NO: 30572 - DNA, 231 bp, Glycine max
  Peptide Sequence Number=SeqID_122257
atggttttcggggcttctgtggcttccgtaatgcttccgaaaaatttccgaaaaaccttggaaaaaattgagtcgaagtgtttgtgtaacgcttccgtaagtgattctgtggaaattcttcatcgttcttcatcgttcgtcaccgttcttcgttcgttcttcatcgttcttcggtcttcaactagtaagttcccgaaatcgaatctttcaattcattttatgcacccttag

SEQ ID NO: 30573 - DNA, 219 bp, Glycine max
  Peptide Sequence Number=SeqID_122258
atgattatgaagggccaagacatttatagtagccaagatgaggttactacttcaccttcttctagtgaaagtgaagaagcaaaaggggaagaatctagtgaagaaattgactcccaagaagaaagggaccttttaatggttagaaggcttctaggaggccaatcttgtgacttgaatttccaaaagcttttgaacgattcgaaagtcattttcaattaa

SEQ ID NO: 30574 - DNA, 246 bp, Glycine max
  Peptide Sequence Number=SeqID_122259
atgtttagaactagagggttaggtcgtgccctaggtagggttataggcagagccctggggagagaggattatcatgattcagatgatgttccccagcgacgaaggcctacagcctccgcacgcaagcaacgagaagttgcccctgttgttgaggatgctcttgatatggctgaagacgaacgtcctgaattgaagttatcctcccatggaaggaaggttcataaatttgggaggcttgctccataa

SEQ ID NO: 30575 - DNA, 417 bp, Glycine max
  Peptide Sequence Number=SeqID_122260
atgacggagaaggagatgataacaatgatagttgacacactaccagtgttctactttgaaaagatggtgggttacacgccttcaagctttgccgatttagtttttgccggtgaaaggatcgaagtagttcaacaatgtcaatactcagccaatattagcccttctcattacccaccacccaatcatccacaagggtcatccctaaatcaaccacaaagcctgcctgtcgtacgtccagtgccaaacacctcccttaacataaaccaagacaccaaccagggagggaattttccagcgaaaaagcctgtagaattcaccccaattccggtatcttatgctaacttcctcccatatctactctataattcaatggtagtcataaccccagccaaggtttctcaacctccattcttatga

SEQ ID NO: 30576 - DNA, 200 bp, Glycine max
  Peptide Sequence Number=SeqID_122261
gtggagttgatactgaggaggaggaaccaatagatttaaggtcaaatcctcttcaagggggaggggttgatgcaatcctcactagagccatgagcaagagactccaagaggattgggctagagctgctgaagaagaccctagggttctcatgaacctcagggtttgtagggtaccctacaaattaagggtacaagtttag

SEQ ID NO: 30577 - DNA, 222 bp, Glycine max
  Peptide Sequence Number=SeqID_122262
gtcgactctagaggatcccaccttggtatgaccaagcaaagatgtcttggtagttctttagcagggccatcaattcttcacggatgggccccatctctcggtccttctgagcgactatcttctccaactccgggggatgtcccacatcctcatctgtcataccctaatttcgtccggggacctttgcttgatgacatgcgacctttctttggtccttgtgag

SEQ ID NO: 30578 - DNA, 173 bp, Glycine max
  Peptide Sequence Number=SeqID_122263
atggctgatgaaccaagaagagttacccttgaagattactctagctcaagtgtgccgcagttctttactagcattgcacggccagaggttcaagcacagaatataacatatccacattcattaattcagttgattcagaacaatttgtttcatggtctgcccaatgaagacct

SEQ ID NO: 30579 - DNA, 364 bp, Glycine max
  Peptide Sequence Number=SeqID_122264
atcgaaagcaagtcagatgtcccaccagaagctcaacatcagaccactccagggtgctggaactacttcacatggactgatggggcctatgcaagttgaaagccttggaggaaagaggaaagatggatcccaagagtggaatgggaatattcctgaggatactctgaacaaagtactgctggtgaagggactgactgcgaacttgatcagcatcagtcatgggatagaagattcaatggcagcagatcaaaggacaactgttacctatggacacctcaagaatccagtcactcctccacatgtctattctccaaagaagatgaagtcaaaatatggcatcaaagatttggacatctgcacttaa

SEQ ID NO: 30580 - DNA, 180 bp, Glycine max
  Peptide Sequence Number=SeqID_122265
atgacaatcgccacaacaaaacaaacattagtccctcaaatttggggatcccacggtcatgtagctccgcatgacaccggactcttgggacacggtaacaaaaagtggggtggtcgacaaaagcagggcttttgctcctacgtatcctcaatttgtgatgaggaactcagacctacgtag

SEQ ID NO: 30581 - DNA, 291 bp, Glycine max
  Peptide Sequence Number=SeqID_122266
atggctttgatgcatagatatgggaggaatttgcggcaacccgcaaaacccctaattggaaggaagaagatgcaggaaatccaaaagaataatgactgtccccatttgctttcctgcgggggatatgatttgctagaaaagaagttgttagacgagagaatgaagaaaaggaaacatgacgcattgctgactgaaaatctagcactcattgaggacctccccatctcccattcaaagacatgtcaagtggaagatggtctacacgaatcgatatgggaagatgacatctga

SEQ ID NO: 30582 - DNA, 525 bp, Glycine max
  Peptide Sequence Number=SeqID_122267
atgcgggggtaccttatggttatccgcacctattgtcaaccagaggcaagggagaccgttgatacgcggagatttacgtcatcttccacacagactacctctgtcaagcacaaacctgtgtggttagggggcaggcggaaatacccaagtgagacggcgagtccgatgacatgcgggggtaccttatggttatccgcaccttttgtcaaccagaggcaagcgagcccgttgacatgcggagatttacgtcatcttccgtgcagactacctttgtcaagcactaacctcatacagatactaacgtcgtcttctacacccttttgtcaaccagaggcaagcgagcccattgacacacagaaactaacgttgtcatctgcacctttgtcatccagagacggcgagttcgatgacatgcgggggtaccttatagttatccgcaccttttgtcaaccagaggcaaacgagcacgttgacacgtggagatttacgtcatcttccacgcagactacctcggtcaagcactaa

SEQ ID NO: 30583 - DNA, 450 bp, Glycine max
  Peptide Sequence Number=SeqID_122268
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccctgctccaagctctttaccatgtcaggtttaggtggaatgttctcagtcttggtctctgcctctggcgttttagctggcagtttgtcttccgggctaggggcactaatggttggtggttcgtcttttgggatgggaacaggttcatcttttcgaatcggggggatcctctag

SEQ ID NO: 30584 - DNA, 495 bp, Glycine max
  Peptide Sequence Number=SeqID_122269
atgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcctttgaggtgcttcacattcgcagacttccaattagtaccaaccattgaagaatttgaggaaattctaggatgtcctctcgggggaagaaaaccatatctttcctccgggtatctcccctctttgagcagaattgcaactgtggtcaaggattcagcagagatctattcgacacatttgaccgaaggtgcgaaaagagtagcgcacggatcatctgttgcttacccgccctctgtgtttggttggtttcacacttgttccaacaagacacaagacatccatgtccgctcctga

SEQ ID NO: 30585 - DNA, 785 bp, Glycine max
  Peptide Sequence Number=SeqID_122270
ctgaaaacgttcgagcagcgccgcctgtgctcatcgtcgtccgccagcatgccggcccacagataaacccgaatggcgtcgtagctgccgacgttcggcttgacgggatccggctgccagccggcgccgacccgccacaccacccagtccggcgagaaaccgtgcggcgcggtgcccagccacagccgttgattgacctggcgcatcgcgcgccacgggccgttcagcgccgcaaaacgcgccaacagctgcggcggcaggtagctgggattcagccgccagcgatcgtccgtcacgaacccgactttgcccggcaacagcatcaggcccaggccgggaatgtcggccacctcctcgcggccgatgcgttgcagcagcagcgtccccagggtttgatagcgccggcttttccacaggcggccggcttcgagcaggttgtaggcgatccacagatcggcgtccgacgccgagttggcgtccagcaccttccactgtttgtcatcgctctcgccccacagccaggcgggcaaacgggcgctgagatcgcccgccgccagattgttctccgtccaggccagcagcagatcgaaggtcggccggtcgttggccaccagggcgaagaacaggccgtagctctgcccctcggaggtggtgattttcccggccactcgcaggccgccgcggcgctgaaggcgcacagcagcagcatgccgagcgacaggcgttgcagcatggcgttcaccgccgtcaatcccgatcttcaggcgccagacgacgccggctga

SEQ ID NO: 30586 - DNA, 210 bp, Glycine max
  Peptide Sequence Number=SeqID_122271
atggaagaaaagaaaattgaaaatgaacgagatgagaacacttaccggttgaagaacgaggaacggacgaagaatggtgaagaacggaggaaaatcttcacagatttgctctcggaagcgttacggaagcacttcgactcgatttttcttcacgaaaacggaaaaagggaggtacttgccgcccagaggcttcttgaggaagatttctaa

SEQ ID NO: 30587 - DNA, 472 bp, Glycine max
  Peptide Sequence Number=SeqID_122272
atggccaagtttgaccctgagatagtcctagagttctatgctaatgtttggcccacggaggagggagttcgggacatgcgctcgtgggtaagggtgtcagtggattccctttatgcagatgccctcagccagttcctgggcgacccgctagttttggaggaaggccagcagtgtgagtttagccagaggaggaacagggccgacggtttcaatgaggaagccatcgcccagctgttgtgcatatcggggcaggatttcactcggactgttgcagggaggcgggtgcggatcatgcacatcagcatgaccactttgacccagacatggatgacattgctgctcagcaatgtcttgcctagcgatcacaactctaacctccctcttcctaagtgccagttggtgtatgccatcctgacatggatgagcgtccacgtggcccaggtgattgctgacgccatttatttgtttgcag

SEQ ID NO: 30588 - DNA, 609 bp, Glycine max
  Peptide Sequence Number=SeqID_122273
atgaaggagaacacgacatgcgccctgttaagactctcgcaggtggaggagagcaaggcgatgatcaggcggtttgacgcgattccactactggtgagcctcctggagagtggagggctccgcgcgaagagggacgcatcgacgatgctgtactcgctgtacatggtgaaggagaacaagatcaaggcggtgaaggcggggatcatgaaggtgctggtggagctgatggcggacttcgagtcgaacatggtggacaagttgacgtacgtggtgagcgtgctggtggagatcatcgaggtttgcgaggactttgatggagaagagcattgctgtgaagatgccgtcgacttcgacgccgacgtccacgtcgaagtagtttgcgatggtggtgttctggtcgccaaatttcttcttcagcgcaactttcaggtaggcgagggcttttctagcgagaatccctcgcatgtttccgctgtcgatggcgagaatgcatatcttgccgcgttggttcttgattatggagatgcagtccacggcggcggcgcgacgacacgtggtggcctgctaggcgcgaccacaagtgctgctctgccaggcacttccttccag

SEQ ID NO: 30589 - DNA, 288 bp, Glycine max
  Peptide Sequence Number=SeqID_122274
atggagtttactgatttatggaagctaaaagtcccaagtaaagtatcactctttgcttggaggttggttcgcgatagattgccaacaaaggttaacttgaggaggaggaacatggaattgaatgatctgtgtaaaaccatgccattatggtgggaagcactctactggctaaacatagtgggcgttttcccggaaatgcccagagaacacttcctccaacattcccatggccacctcaatggtatcagacttcagcaatggcaaacctggtggatctctttgacctag

SEQ ID NO: 30590 - DNA, 219 bp, Glycine max
  Peptide Sequence Number=SeqID_122275
atggtgaggaaagaacaagtagatatgttgtgcttacaagagactaagaaggcagtgatagacaaggccctatgtcaagttctatggggtgatgctgaagttagacggaaaatgcagccaacaattaataggaagggacatgggctgccaaaagaattctatgggatcaagtcaggcaactcagagctgcaagcagtgggggtctctagtgcattttag

SEQ ID NO: 30591 - DNA, 582 bp, Glycine max
  Peptide Sequence Number=SeqID_122276
atgcgggatgtgaataatttaaataacaaaggatctggaaaatctagttactcacaggaacagactaagtccaagctagtttcctcgaaattcaaaacaagtagcacaaaacgccaagagaagaaacacaaagtgaggtcaaaatctcataaacacagagctggtacaagcaaatcaaagaagacagttacacattcttctgtcgaggcaccacttgaggattcttcaaataaaaaagtgattattagaaaatatcggcataaaactgatgggaaatcttcacagatgctgtcttcaacaaagctagaaggaggaaaaaattctcatagttctggaatagaggggaatgatgttgatggggaggcaaagattaaaaaacgtaagagaagaaagaagaaaagacaaaggaataacatagatgttgatgatgcttcacgcttgcgaaggagaacaagatacctcttaatcaaaatgaagctagagcagaaccttattgatgcttactctggagaaggttggaaaggtcaaaggaaaaatatgttcactacatcgcatctaggaatttctgaaatttttacatga

SEQ ID NO: 30592 - DNA, 507 bp, Glycine max
  Peptide Sequence Number=SeqID_122277
atggagcattgtagaaaatataacaatgtgagtgacattcactgggttgtggataaggaagtggatttggaggagggtttgcgtgtatgtgaaacagattttgatattcgggatatggtcatcactgcaaggcacgatggagatgaggtagagttgtactatgaccacaaggttgatgaacagcctatcctatttgaagccgatgtacctgaagatggtttaggtaatctgaatccaattccagaagttgaggaagaaggagataaagatgatggtgatggtgatgaagacattgctagtgaggagcatgatgacattgatggtgacgaggatgtagatgttgaagtgagggtaggctgtgaatggtggactgatattccagaatacaataatgaagtccaagaggatgaagttgaaccagttggttatgaatctgaaaagttagatagcccgagaagtaatggacaagcattaacattacttacctgtggtaatggacaaacataa

SEQ ID NO: 30593 - DNA, 354 bp, Glycine max
  Peptide Sequence Number=SeqID_122278
atggcccgcacgaagaaaactggacagatgacgtctgaggcaacaaaggaaatagctgacaggattgattatatggacgagcaggcgtcacagggatcgttcgttccccctggacgtcagaatatcctgactgctgtcattgggcgaccagagcaccctggtcgtgttcgtgttgttggagccggtgtcaccataaaacaatactttggattggctttgcgaacatcctgtagttcttcctccatgcctcttgaagacctagaacagctgacccaacaaatcagagaccaactggaggagtcaatcacagaaaaaatgactcaaaagatgatgacctccttcagccagatgtag

SEQ ID NO: 30594 - DNA, 1203 bp, Glycine max
  Peptide Sequence Number=SeqID_122279
atgggaacgtttcagagctttagaaaagcctatggagctctcaaggactctaccaaggttggccttgccaaagtcaatagcgaatacaaggagttggatattgcaattgtaaaagctaccaatcatgtggaatatcctcccaaggaacgtcatcctgaaggatgtgcttacagcaatcatctagtacaatatgcgttggccctggctgaaaatcttgctgacttctatgaatactgcaaaggcttggaccttactaggaatttccaatttccaacactgagacagccacctccctctttccttgcaacaatggaagaatacattaaagaagcaccacagacaggctatgttaataagaaagtggagtatcaggaaaatgaagaatcatctaaagaagaatcagaatccaatgaatcagcagagcctcaagcaaatgaagaacaagttgaagaagtcaatgaggaagagtcagtggaagaggaagaagaacaacctaaggaggaggaggtagagcctcctcctttgatatcaactgatgatggtacaaatgatttgctgggtcttaatgaaataaatccaaaagctatggaactggaggaaagcaatgccatggctcttgcaattgtaccacctggtggaaataatccaaacaatcttgctttgagtaactttgatgggactactggatgggaactttcactagttacaacaccaagtaaccattccagtcaagccccagatcgcagattggctggtggttttgacaaactattactggatagtctatatgaagatgaaaatgccaggagacaactccaactccaaaatgcaggttatggacatagtggaacaatggatatacagaacaacaacccatttgatcattacaaccaacaggatccctttgcaatgtccaacaacatagcacctccccctagtgtgcaaatggcactaatgtctcaacaacagcagcaacaacaaatgatgttccaacagcagcaaatgatgtaccaacaagcacaacaacagcacaacaacatgatgatggtcccttaccaccagcaacaaccatataaccaataccctcaacagatgtataattcaagttctcataatccatttggagatcctttaccggtgatgaagaggaggaagtctagtgatgaggataattccagtgggagtggtggtgatgaggattaa

SEQ ID NO: 30595 - DNA, 570 bp, Glycine max
  Peptide Sequence Number=SeqID_122280
atggatataatgatgcaagaggtgttggagcaattgaaggagctgcaaaagggaaacttggagccgcaaatgggatctccggaaaggggagaaggtggagcttcacatttctctggtaacaaaacagagaaaacggagtggagatggagaaatcttgaactgccgatgttcaatggaggtgacgttgcagggagtattggaggaggagtagaagtcgcattggtagccttggaaggcaaggtgttgacatggtttcaatggtgggaaacaagggcagaggatcaatcttggtgggatttcaagaatgctttgtcacgaaggtttcaacctgctctagcacagaatctgtttgaagtgcttttgggtttgaaacaagaaggtactgtgtcggaatacagagatacgttcgaagaaatttcatgccctctcaagattgggaataccaattactttaagggaaatttcatgaatgggttaaaagaggaaagtagggtggaattaaggttgcacccgctgaaaaccttggaggaattaatagatttggcactattgattgaacctacaacatga

SEQ ID NO: 30596 - DNA, 621 bp, Glycine max
  Peptide Sequence Number=SeqID_122281
atgttaactagttgtttctgtaactgcatgatcaccttcagcagcaggccaagttctgaagctactgttgccagtgaaaatcagggacaagcaggacagcaacctcaacagcagcagcctgcacctcaaagacaagttgttgttaggagatttcaaattgcatttcaaattgatttgttgcttatgttgaagctggcagctgtgatctttttgtttaaccaagatggatcaaggcagaggcttattgtccttgtgttctttgctgctcttgtatatttgtaccaaactggagctttgacaccgattataagatggctttcacgaggtatgcagagagcagcagcacctcctcatccaccaagacctgcagccagggctgaaaatgttcctgctcccaggccggagggtgacaatgctgctccagcagagggtcaacctgaagccgagaatgggaaccagcccgctaatgatgcagaccaggcagtcgagaatgaaaatgttgcagaacatggcaatgtcaatggtggtaatcagtggtggggcattgtgaaggagatccagatgattgtctttggatttatcacttcccttctccccgggttccacaaccatatggattga

SEQ ID NO: 30597 - DNA, 1164 bp, Glycine max
  Peptide Sequence Number=SeqID_122282
atgggagagctcaccatcacgctggatgacgtctcctcgcttctccatctgcccgtgattggagatttacacgcctttcagcccttgcacgtggacgatgcggttcaaatgctggtcgacttgttgatggtctctacagagtctgccagggcagagacagcccaatgtcgtggaccgtacgtacgcctgcaatgggtacgtgatatatatgagcgccgatgtcagacatgtcattggaaaactgcggctcgcgcatatcttctctattttctgggttgcactctgtttgctaataagagtgcaaccaatgtgcatgttgtctacttggaggcccttcgtgacctcagtatgacagagaggtacgcctggggagtggctactctgatttatgagcactttccctcggtcgcggagtccactgctgatcaggactacgacgaggcttctccgcgtgcgtgcaggtggattgcgacgaagaagactgtgaagagcattcgcacgccgtcgtacaaggagcgcctagaccgactccggattccggatgtctgttggatcccttatggggagcatcgggaggtccgagacttccatgtcagatcatgctattccgttctcttgcactgggggcctgttgctgtttattaccgatcggagagggtcgtgcggcagtttggctacacacagaccattcctactcctcctgtcgattcatgggtctcatatgatgatatacacgacaggtggatgcactatgaggattatatcgtaccagcaggtgaggtgtgcgttgtgctaggggcgtgtttcagtgactacatggactggttcttccgcatcttcatgacaccaggtcacgcattagatcctctgcctcatggtcccgccccgcagccccgagtcgttcctcaggccccgcagacggatatccctcacgtgccggagccaggagcatcgtccacatctgcggaggagcctagacatgcagtggaagtttgtgatgacattgttgagaggttggagcgccatctgagtctaggggtggtcacgcctgactcatcgacacatgaggtgatcgaagaatgcctcagattggccaggagtgtgacacaggaccatctaatatacattaggtgtagacgcaggcggcgcactgatcaggcgtag

SEQ ID NO: 30598 - DNA, 351 bp, Glycine max
  Peptide Sequence Number=SeqID_122283
atgagggatgaaggtggatgttgttttggtgtgggagttggacgctttcagagaggggagacaagagtttcatcagttgactcattatctgaagaagatgaagttggattctccttgttgccagtgaaggagattgtccattccttctcaccaaacttgggattagcttttgtagcccgtgccttgattcatcttaggatgggacaacttgggtggcaatcttttgcttttgaagagctatctgcacaaatccctcatcctcttcatcagtttcacttaggtcttttcaacctttgtggtattatcttttcttcggttggacactcaagtccacctgaggagcttgcttga

SEQ ID NO: 30599 - DNA, 246 bp, Glycine max
  Peptide Sequence Number=SeqID_122284
atggaagaagccgggagtttgttgagagaaatgctccagtacaagaatgcggcagagttaattaacattatcaacaatgaggttgatactgaatcaataagtgatttccttgccactttgtgttgtctactgataatcaaggattccacaaacaacagaagatttatgaatgaaaggttttggttcaagatcaagaagagttccacattcctcttgcaaaagtggtttgaaatttggaccttgtga

SEQ ID NO: 30600 - DNA, 342 bp, Glycine max
  Peptide Sequence Number=SeqID_122285
atggacgtgggatcgtggagttcttctccctcgaagatgaagttccgattctccttccaagatcgcctcatctgcagaaagaattctcaagaaaacaggacgaacagttctctatggtccaccccctccgacatgatggtcgccgacctcagcctcggtcctcagtctttcatggcttggtggtgtcacacgccctcaacggcgacgaagaagccgcgcttatatgaaagcacttctaagagaaagaagatgtggagcgcaaaccttctcaattttcaccgactattttttgtcgcaccgttcatagacttgacatggatattgagatttgtctacttctaa

SEQ ID NO: 30601 - DNA, 402 bp, Glycine max
  Peptide Sequence Number=SeqID_122286
atgtatcatgaaaatatgatgatacatgagaaatatgcatgttcaaaatggttcttccgtccatctaaagttgacattgttattgagataaaaatatcggcggctaaaaactatcataaaatgtggcacagtggcttggaggttgcggatttgagttgttttaggcggatctgggtgactaaacttgatggtggtcatgcacacagtgtggtggtttggatggtgcttgggatcgtcggcgtttacgggctatggtggttgtcagctaaggttaggattgaaagatttgaggttgggcctgagagtgttagaaaagcacatttgcttgttgtccacctgaggccagacgtgaaaaagctaaacctgcgcgtaggagtgttgatgtggcttaagtgggactga

SEQ ID NO: 30602 - DNA, 2433 bp, Glycine max
  Peptide Sequence Number=SeqID_122287
atgggatgttcacattcaaggttggatgatgaagaggcagttcgactttgtaaagacagaaagaagttcatcaaacaagctgtcgaacaaagaactcggttcgccactggacacatagcctacatagaatctctgaaaagggtttcagcagcacttcgcgattacattgaaggcgatgagcctcgcgagttttcattagacacggtcatcaccccacctttcacacctgtgaagaagaaaactggcccaggattcattcccatatcagcaaaaccctttgctacaacagggtcaattgagtttggaattggaccaaactctactttgaaagtgaattaccttaggcctggtggtaacccagcaatttcagttgaagaaaggcctcaatccccagaaagggttcgggttgagacatattattctccaatgcagcactatggcattaatggatttttcaacatgcaatcctcaccggtgaatccctcaatttttgcttactctcccaataataggcctgttatccctccaccttcacctcaagcttcccaatgggatttcttttggaaccctttttcatcattggacagttatggttacccttcaagaagtagcattgagcaaactgcaatggatgatgaatacagaggacttaggcaggttagagaagaagagggaataccagacctggaagaagatgaaactgaacatgaagattgtgttggaaagagaaatgtagcagaagaaagaactacacacgatataaatgcttccaaagaagaagttattgttgaagatgttgatgatgatgatgatgaggaggaggaggaggaggaggaggaagaggaggaagaaacagacatagaagatgaaactaaaactgagcatgaggccaaagattcacaagctcatggtagtgcaagttttgaagtagcaaaagctcaagctgctggtcatattgaatccagacatagggaaatgacaattggtaaacaagaagctgtggaagaaacaccaggttttactgtttatgtaaaccgaaggccaacaagcatggcagaagtgatcaatgatcttgaaactcaattcacagttgtctgcaatgcagccaatgatgttgcagcattgctagaggccaagaaatctcagtatttattgacatctaatgagctttcagcatctaagttgttgaacccagtagctttgctccgatcagcttcttcacgctcttcttcatcaagatttttgatgaattgttcaagcactagcacggaaggttgtgagggcactaaggatctctcagcagaacattgtatgttatccggtagtcaccactccacattggatagattaaatacatgggagaagaagctctatgaggaagtcaggcctctttgcatatgcaagggtaaggctgcgtacaacatccctcccccataccttcgcatagcgaagagcctctgggcaatgggttactttggccactttcttctgcaacagtctggagaacgtgtccgaattgcatatgagaagaaatacaagcaactcaggaaccttgatgtaaaaggagaggacccctcttgtgcagataaaataagagcaaccattagagaactagatactcagataacagtttcaatacactcagttgaagctatttcaaggagaatcgaaactttaagggatgaagagttgcatccccaacttcttgaattggtgcacgggctggaaaggatgtggaaagtgatggcagaatgccatcagacacagaagagaaccttagatgaggctaagattcttctagctggcacttcttctaaatcacgtgccagaaaacagtcttccatgtcaatgactgatccaaacaggctggcgcgttcagcctccaatcttgaattcgagttaaggaactggagaaatgcctttgagtcatggatcacttctcaaagatcctacattcatgcactaactggttggcttcttcggtgcatgagatccgagcctgacgtatcaaagttaccttgctctcctcgcaggtccagcggcactcaccctttgtttggactgtgtgttcagtggtcaaggcgcctagatgccatacaagaaaaggcagtgcttgatggcttagacttctttgctgctggaatgggctccctctatgcacatcagttaagagaagattctagcagaatctcatttggatcaaagcaaagcaatggaaatatggaaatggtggaagttggtgaggtggaagaggtaatggctccagagaaactggctgaagttgctattaaagtgctttgtgctggaatgtctgttgctattagctcactggcagagtttgctttggattctgctgaagggtacaatgaagttgttaagcaatgggacaatgggaagtgtcaaaatactacttctagtgagactagaacataa

SEQ ID NO: 30603 - DNA, 268 bp, Glycine max
  Peptide Sequence Number=SeqID_122288
atggaagtcgccaacgatgggaagatgaagaagagatgccacgtcgtccagggtgatggtaacctcccctatgggaagatggaaactactagcctccttgtgccacctctccacaaacgaggatatataagtccccgattgccagtgtctactgaacaggcgatcaaaggacttagtcctgtcccagcaactagcccctcaatggcaggaacaagcgtacctaatttctacaccttcctcccatgggaggataacttcaattcaggac

SEQ ID NO: 30604 - DNA, 3243 bp, Glycine max
  Peptide Sequence Number=SeqID_122289
atggcaactgagagtccaattagaatctcagaagctggtggtaaatggccgtctcataaggaagctgcagcttttggttcactgtctcgtaacatggcaacagaggatttgggtatacttctgaagggccataggtaccagggtggtggaaaggatgtggcacccaatcgcagtggcagtgcacctcccagcattgaaggctcatttctggccatagaaaaccttttaccccagcataacaccacccagaatgcaagctttgccaacctaagcagcgctatgcaaaattgtgagtctgaagaacaattgcgagctgatccagcttatttggcatattacaattccaatgtcaacctaaaccctagacttcctcccccgcttacatcctgggaaaatcgccatctaggacgtcatattatcagttttagaaataattggagaatgtctactacggatgatagtggtaaaagttctttacatttgcctcaaaggactctttccacgcacaaggaggagtctgaagatgattcaccccaacagccatatgatcatgaattagttaaggcaagtggaatttggcgtagtcctgatgcagcttcattggcatctcagcacaaaaatatggttgacttaattcaggaagattttcctcgcaccatgtcacctgtatataataagtctctttctgtaagtcacggactagtggataaaccgattgatttagaagctggttctagttcttctcatggcccccctgttactacaataaaggctggtaaacctactataggtgcagatgacataagggtgtcatcaagtgtcgatacccatgccccagttgcaagctcatcatctcttgaatccactggcagcattggtgttagtgacattgcaactgttgagtctcaactaaaggctcttggtgtatctaatgtaccaaattcagaaagtctgagttacgaagaaaaatggaaggcaagctaccagaacaatttgatgcgacacccgggattccagcaacaaaacaatccatatgatgttcctagtgccaattctcaaaatttaaattctgtgtacgttggtagggaacaatttccttttaattccagcaagttctccaatgtccagccactactgcagtcatctggttttacacctcccctatatgccacagcagctgcttatatgtcctcagccaatccattttacactaatatggaggcgtcaggtatatatactccacaatatgttggtggatacactgtaaatcccacagcttttcctccatatactgcataccctcctcatggtgttctacctcttgtcgttgatggagctactagttccaattatactccactaacaccgggggtttcaattgggggaaacatttcgcatggagctgagatggtacagacaaacaagtaccttgggcaatttggatttcctccgcagccttcttttggtgatcctatgtacatgcaatatcatcagcaaccttttgtggaaggatatggtatttctggtcattttgatccactggcacctagagcaagtggtgttagccaaattagtccttatgattcgcaaaaaaggtccagtactggtgcttatttggatgataaaaaattaactgatcagagaacttctgctaatatgaactcaagaagaggtggagtatcgattcctagttattttggacacatgccaaacatgggttttgtaatgcagtatccgagttcaccacttcctagtccagttttatcaggatacccagaaggaagtcctggccttccaggagttaggaatgaaataaaactttcccctgcttctggaagaaatggaggcgtaatatctggatggcaaggtcatagatcttttgacagtgctcatgaccccaaaatggttaattttcttgaagacttaaaatctggcaaaggtcgaagatttgagctatccgatattattggacatattgttgaatttagctctgatcagcatggaagtcgatttatacagcagaagttggaaagttgtagtggcgaagagaaggcattggtgtttaaagaggttcttccacatgcttctaaattaatgactgatgtatttggtaactacgtaatacagaagtatggaagctcggagcagaggagggaacttgcagatcgacttgttggccagatactgcctttgagtttgcagatgtatggctgtcgtgtaatccaaaaggccacagctattgaaatctgtgtggatgttttgattatggatttttgtcactgtggctttgtttctgcacttgaggttattgagcttgaacagaaagctcagcttgttcatgagctagatggaaatgttatgagatgtgttcgtgatcaaaatggtaaccatgttattcaaaagtgcattgaatctattcaaaccaaaaagattagctttatactatctgcatttcgtggtcaagttgctactctatcaatgcatccctatggatgccgagtcatacagagagttctagaacattgcatggacgagagtcaatgccagtttattgtagatgaaatcttagagtcagtttgtgctcttgctcaggaccagtatggagaaacatcaaacaagggtcgccagtcattgatcagtgaagaacaaaggttgtcagagaacaaaggtcgctggtcaccagagaacaaagagaagggtgcacaggttctcttagcccttagggcacaatgcagtgctgtagcggctgtggcacacgcatttgactacatagcccttaacaatagtaaagcaagggaagttgatcatgtcttggagagaggaaagcctcaggaaaggagccaaattctcagcaagttgtcaggacatattgttcaattaagccagcataaatttgcttcaaatgtggtagaaaaatgtttggagtatggtgatgccactgaacgggagttgctagttgcagagatatttgggcatgatgaccaatgtgataatttattgacaatgatgaaagatcaatttgcgaattatgtggtccagaaggtcattgatatctgttctgaaaatcagcgagcaatgttgctttctcacgtaagaatccatgctcatgctttgaagaaatacacttatggaaaacacattgtggctcggttggaacatcaatttggaggtgtgtactctagtactttggttgacaaaatagaaatcctagttctctttggtattcttgtcacatataactga

SEQ ID NO: 30605 - DNA, 543 bp, Glycine max
  Peptide Sequence Number=SeqID_122290
atgaagacgccacaatctgcatctaaattgaaaagctgtctttcagttatctgtgctcgttgtgattttgagcctagaaaagggaagaaggtaaaggtaagagaaaaaaagaaaggaggtaacaaggaggaaaaaaggaaagttgttgacgtccttgaatctcatagcatgctggagaatgaccatgatgaaggggaagggtttgacaatgagtctcctaggagcaaagttgtggaaagtttgtggcaagatcctgatgtcaatgattctggattaacagaaggttctgaaactgaagaagatgttgggtttcattcagatgaagaggatattggaattaatggccaaccaatttctgaagattcattgcatttgagctctttcgatttacatttgcaacataatttatccaaagaagaaattgacagccaaaggaataggaaatttagctgggagactccagctattggcatgtcaaattgcaagtggataggtgtagaagcaaatgactttgatgttttgatgatgatcatgatgatttga

SEQ ID NO: 30606 - DNA, 180 bp, Glycine max
  Peptide Sequence Number=SeqID_122291
atggcattgaacgagaaattaggtctggggaaatcgaacaagacagaagatgattttgaaatgtctggaaacgtggaagaacaactcaccggcgacagcgtaggtccgatactccggcgaacggcgtgggagctgaggctagggttccgcggcggcgagggaggttctttgaacttttaa

SEQ ID NO: 30607 - DNA, 2037 bp, Glycine max
  Peptide Sequence Number=SeqID_122292
atgggagatccttgcttctttgtggtcttatcgtccttgctgctcctcatagttagtacacaaacaagctcagctcaacttactcgcggcttctatctaaacacatgccccaatgtggaacagttggttcgttcagctgtggagcagaaattccagcagacctttgtgactgcccctgccactcttagacttttcttccatgattgctttgtgaggggttgtgatgcttccattttgctcgcatctccaaacaacaaggcagagaaagaccatcctgatgatatttcactcgctggggatggctttgacacagttgctaaagccaaggcagctgttgatagtgaccctcaatgcagaaacaaagtctcttgtgctgatatacttgctctggctactagagatgtgataaatttggctgggggaccattttataaagttgaactgggaagacgtgacgggagaatatctactattgccagtgttcaacgccagcttcctcaccctgatttcaatttagataagctcaattccatgtttagcttccatggcctcacccagacagatatgattgccttatcagttgattccagaattgccataaacatggaccctgtcacacctcaaaagtttgacaaccaatacttcaagaatctccagcaaggaatgggcctattcacttctgatcaggtgctggccacagatgaaaggtcaaggggcacaatcaacttatttgcatcaaatgaacaagctttttacaatgcttttattgaagctattactaaaatgggaaggataggtgttaaaacaggaagacaagggtgtggcatgatagaatcagagtggaactgtgaaaaaaaagtgagagtagttgtaacaagagggactcgatccggtggtgaactagaagtgggtgatgattatagcagaatgattcgaagaggacataataggcctgccatcttcttagcttcatacttggttacctggcacttgacacagttggccataaattgtgcaacgtcttctcgaagccctagccagatgaaattttccatgattcttgccaaggtcttagtaaccccgggtttgaatcacttggttcaacaactccttaaggctgtgatgatctgtaacaatggtgaaatggtgcccggtaagggcttactgaagaaggctatggggtgtccctactgtaaaaggacgacacccatgccaatgcttgatgcatctgtctcaatggtgaacgggagcttgaagtctgggctctatgggggtagccttgaccatgggtgcaacaatggtggcataaccatggataaagcgacgatagaacccagcgaggcccataaagcttcgaagagctttaatggaacacgaagtgggccattgttgaatcacaacaattttggaagcaactggttcaacccctttatgcaagaccaggtggctgagatggtggagatgatccttaggaatgccgctatagatgagaatgtcgtcgaaaaagatgatgatgaagtgtcggagccctgtaacaggtctagcatggagaagcaacgcgcaccatcgagttcatccaagagctcgtcaattgtgggaatcgggaatcgatccttaacggtgagggcattcaaggctcggaaccatggtgacgtggaagcacgtggcattgccaggtttacggcacaagcgtcgaaggtgaggttgagtcatcatccccattctagcatccttatttcctcgcaattcgaccaggctaccttagtgaaagaattgtatgacgtagaggtctaccgtgaaggaggctatctggaggtcgatcgtgaccgcctcacaaagccaacgacactccaattgttggtcgttacccaccataaccgaaagaggagtagtggtgcgaaaagggagtccgagttgggtgacgaggtgctattggatgaaattgtgggtgctcccaccgtccaccaggaagagcaccacctggccagaaatcttacccaccactctgatggtctcgagtgccaaatggctcgctaa

SEQ ID NO: 30608 - DNA, 850 bp, Glycine max
  Peptide Sequence Number=SeqID_122293
atgggacggggttggggatacccgatacccgacgggtacggggatgagacaataaacttaaactcatcgggtatcgcgtacgggtatgagaatatgttggagagtcaaggggaggatcatgatccaaggagaaagaggacgacaaaggatcgtcccgttgatgtggaatttgcaagcatgggaactaaaattgaatattccataaatcttctagcatcctcagtagacagcaacaacttcattgtgggtggtgtggatgtctgggagcattatcagaacaaaggagagactaacaaacattgtagtattggagtgaataaattgcaagatccaatggataggatgcttgacagaaacaacatagagtccatcaaaaagacaatgcagatgcatgaggaaatcttcaaataccaggaaaggagtggaagctgttctggagagaccataaaaaggcaaaggggttttgacctagaaaggcctgctgagagagacatttttggtggcggctgtgatgaacatgaggcaggacttagctcctacactgcactagagagatgcaaaataagcagcaacaatgatgatggttatgatgaagacatggaagtggatttgactctaagcataggaggaggaagccaagttaatgataagaagaatagtagtagtaagaaaccttatctgcttccattagggtgctcagactcacccaatgggaaaactagggagctaaattcttctgtctctttccaatcagatagggtgggagatttcagtgaccccaccacccctatgagcagctcaagtgtgacatttgatcaagagagaaaggggccacattggctttctcaag

SEQ ID NO: 30609 - DNA, 156 bp, Glycine max
  Peptide Sequence Number=SeqID_122294
atggagagagacaagcggtccgagagatccacggcgagggacgtggtggaggcgaggaaggagctagctatagtcccacaaattgcacagattaagaaagcaaggatttcgaaaaggataaacaaaatccaaactgaattggccctactctggtag

SEQ ID NO: 30610 - DNA, 926 bp, Glycine max
  Peptide Sequence Number=SeqID_122295
atggctggggacaagggaaccatcactcttgaagagatcaagaacgagactgttgatctggaagttggttcatactctgagcactgtgtccttgttgaggcatgtgcagtatttggctataattgggcatacagtagggaacgtattccaattgaggaagtgttcgagcagctgaaatgtaccagggaaggtttgtcctccacggaaggagaaaaccggcttcaaatatttggacctaacaaattagaagagaagaaggaaagcaagtttctcaagtttcttgggttcatgtggaatccgctttcatgggtcatggaggctgcagctataatggccattgctcttgcaaacggcgaagggaagcctccggattggcaagattttgtaggtattgtttgcttgttgctgatcaactccactatcagtttcattgaagaaaacaatgctggaaatgctgctgctgctcttatggccggtcttgctcctaagacgaaggttcttagagatggtaaatggagtgagcaggaagctgcaattctagtccctggagacatcataagcatcaagctaggtgacattattcctgctgatgctcggcttcttgagggtgatccactgatggttgatcaagcagctctgactggagaatcacttcctgtgaccaagcacccagggcaagaagttttctctggctcaacttgcaaacaaggagaaatcgaagccgttgtgattgcgactggtgtgcacacattctttggaaaggcagcacacttggttgatagcaccaaccaagttggacatttccagaaggttcttacagcaattgggaacttctgtatttgctccattgcggttggtatgctagctgagattatagtgatgtacccgattcagcaccgcaagtacagggatggaattgacaacct

SEQ ID NO: 30611 - DNA, 1707 bp, Glycine max
  Peptide Sequence Number=SeqID_122296
atggctttggtttcccagctttcaatgtctagtgcttatattgacactgggtttgggcctaagcctaaccactcagctgaacagggtagtttgataagagctgctgatgtggcatgtcgaggtccatttgctaagagaaggcatccattggtggactcgactgttgtttcagagattagaaggtgccttgacgaaggggttgaattccaaggtgagttgctgaactttaggaaagatggatctccacttatgaacagattgcggctgacgcctatatatggagatggtgagataactcatgtcattggaatccagttcttcacagaggcaaacattgatcttggtccccttccgggttctacaattaaggaatctactaaatcatcggatcggtttcattctgtgctttcctcgttgaatcctcttccagtgggcgatcgtaatgttactcgtggagtttgtgggatattgcaattaagtgatgaggtattgtctctcaagatacttgctcgcttaactccaagagatattgcatcagttgcttctgtttgtaggcgattgtatgagctaacagaaaatgaagacctttggagaatggtgtgccaaaatgcatggggcagtgagactacacgtgttttagagactgtgcctggtgcaaggagacttggatggggacggctggcaagagaactgaccactcttgaagcagcagcatggaggaaactgactgttggaggtgctgttgaaccttcacgctgtaattttagtgcttgtgcagttggtaatagagttgtcctatttggtggtgaaggggttaacatgcaacctatgaacgataccttcgtattggatctcaattctagtaatcctgagtggcaacatgtccaggtgagttctcctccccctggtcggtggggccacacactttcttgtgttaatggttctcgtttggttgtatttggaggctgtggaacgcagggcttgctcaatgatgtgtttgttctggacctggatgcaaagcctccaacttggcgtgaaatttctggattggctcctccacttccgagatcttggcatagctcctgtactcttgatggtaccaagttgatagtttctggtggctgtgctgattctggggtacttttgagtgatactttcctccttgatctgtcaatggagaaacctgtctggagagagataccagtggcatggactccaccttcgcgtctgggtcacacactatccgtttatggtggtaggaaaatactgatgtttgggggtttggccaagagtgggcccctgcgttttcgctccagtgatgtattcacgatggatttaagtgaggaggagccatgctggagatgtgtaacggggagtggaatgcctggtgctggaaatcctggaggcatagctcctcctcctagacttgatcatgtggctgtcagccttccaggtgggagaattctgatatttggtgggtctgttgcgggccttcattctgcttcccagctttacatactagatccaactgatgagaagcctacatggagaatcctaaatgtaccagggtgccctccaagatttgcttggggacatagtacatgtgttgttggagggacaagagctattgtgctgggtggtcaaactggggaggaatggatgctaagtgagctccatgaactttccttggcaagttctgtcatctag

SEQ ID NO: 30612 - DNA, 420 bp, Glycine max
  Peptide Sequence Number=SeqID_122297
atgagaaagggggtggaagaaagaaagggagtaaatgaaacccctaggagagggggttctatggtggtgtgtcctgtcccttggactggtggagcccaagcggctctggtccctgcccttgctgaaagagacgctagagaaggagaaggaggtactggaggaggaggagttatcgtcatggatcgagcaggcggagatggttctggaggagaaggagaagcagatggaggcaaaggaagagaagatgaagcgaatctacgaggagaacaaggagctgaaatggcatgtggaggcgcaaactgggaagtaaatttacctgctgaagaagtaccaccagagcatcctgagcctgtgttgggcattaactttgctagggatggcatgcaagaaaaagactttagactggctatctttagttga

SEQ ID NO: 30613 - DNA, 1428 bp, Glycine max
  Peptide Sequence Number=SeqID_122298
atgaagcactcacactgcgggtcattagggttgggcgcaaagagctacgctggtggtagagtgaaagccacacatctttcttccttgcacctttctcttgttcttacatccttcctactcctacctttgctctcgctttcctacaatggaagtgttcttcgttctgcatcccttgctcttgatttccttgcgcttcttgctagatatgctccttggatgggtctcccgttcaaggtaggttccttgtggccaggaagggatgactacgttgtggagagtggtaaaggggctaagaagatcaactcgtaccctactcgattccaaactcgcgagtctatagaggagttgaaaaggaagatcaacataatggccttggatgacatcgagttgttgatcgtggagccttgtagcaccaaggagcacgtgtttatgagggcgtcaaaggacgagaccaactttgtgtacatggctatgattacaagaatttgtatgaaggaaccttcaaaatctgacccaacaaagaaatctgtgaaggttatggaggaaggagtcaaggggggcaatgtcaaagtggagatcgtccatttggatggacagaatgtggcggacaagggagcggaagagaataatgccgacaagggatccgctggtgtgatggataaggagaaagagctagaggaagaggtggttcagagggataatccaagtaccagagggtcgagtatgaacaaggctatcctctgctaccatgaaggcaacgaatgtgataagatggactatgtggggccagtggagagtgcttggacaccatcgagatcttccttggtggacaagaagactaaggcgatggttgcacgagtgaaggccatgaaggttcaggtgagcaaaaccaaacaacttgttgtggaattggctaagagtaggggattagtgaggaaactggaagaggactctcgcttagcgtgttgggaaaccctagaagaggatcggtcaaatatgtgctcgcccagcgcaccgcaagctcgctcagcgagtcgtttgtctcttctcgcgctcagcgtgcccagctcgcaagtgaaagatattggcactagggttgaggggaatttggaaactacagaagacaaagttgcagatctgaagaagaggattgagaagctgaggagcaagttacaaaagaaagaggaagcgaagtgtgcagtgacggtcgagttggacgagactcaacgtcaggttaaggtgttgcttttgtctttcggccctggacaacttgatgtaaactttgatgtcgtggatggcgagatcatcagggagttacaactctgctccgagtctgagggggaggaggagaaggaggccaaggttcgaattcgacctgttgttttcttgaagaagctgaggttcggattcgacctctcgttggcttga

SEQ ID NO: 30614 - DNA, 363 bp, Glycine max
  Peptide Sequence Number=SeqID_122299
atgctggatcatggttgttacgacatagctcaagttggaagaggaatattgatttcctggatcactacacctctgagaggattccaaacttttgtcatcctctctcttggaaaggagaagggtggtgatgttgttgcagagggcggcaatgtgtggggtgaagttaaggagaaggcgtgtgatgaggattcaacatcggtgatgaatgaagaggtgggggagttctacgtcatttaccttctcccgaaaacctctgctcttgttcagctgccaacggtggtttctggtgactgcatcggaaaggaagaagaaaaagaagctgatgatggcgctgccgatgctgcaggacacagtcgtggttga

SEQ ID NO: 30615 - DNA, 885 bp, Glycine max
  Peptide Sequence Number=SeqID_122300
atggtttggtatctctattgggtgaccaatcatgaggttctaaaaacagaagactactttagcctattgattgctgctatatctacagatttatatgggatccgagtcaaactagcaactgactacagatgccagtctaacatctctcaatcccaggtaccttcgacttttcaagataacctgttggtttccgaactctgtcaggctgtaaaatatcttggagaaaaaatatttaacctgatttatgacatagaggcgcataaggatcttataacttcttacagagacaataacaatcacaacatactgcatttggctggaaaattggccccttcagatcaacttcatgttgtatctggtgcagccctgcagatgcaaagggaattattgtggttcaaggaggtggaaaagatcatacaacctctattcaaagagattaaggattctgaaggtaggacacctcaaatgttatttactgaggaacacaagggtttagccaaaggagagaagtggctgaagaacactgcttcatcatgcatgctagttgcaacacttttatccttctcccttttccctacacctcaacccttctcccttcctctctctcatctctccatcgcttctcatcctcttctcttctctctcgtctccctcagaccacccaatctgttacggattttttttttacataagggaatcatcattcggcgaagaatcatggttttcccaccaaaccagtctcaaaaaaacgatgatctcgaacccgttcaccgttggatcatcgtgaaatttgattatcatgttcgcaacacaattccgagcattctcaccgttgggaatttcgatatcatgtctgaactgagagaaaaatccttcgcattgtag

SEQ ID NO: 30616 - DNA, 1557 bp, Glycine max
  Peptide Sequence Number=SeqID_122301
atggcgtggccaaaactcatcaaatttgcttatcataggttcaccacaagaaaatttcatggcactgccaacagaatgagctcaaattggagacatcttatgaagaaagagttacaaagtggaaacagtgcaaaacaagaagaaagtcatccccaccaccctcaccctgtttgcatatacagggttccatcaaacatgcgccaggtcgaaccgaaagcctacagacccaacaacatctcgatcggtccttgtcaccacggagcaccgcatttagaaaacatggtagatctcaagaaaaggttttatcgccgcctctttgatccgaccaacgatgaaaatggagccaaactagatgaggcttttaagttccttgaggagcaagaatccgaggtacgaggatgttacatggaggacatcaaattgagcagcgatgagtttctacaaatgatgttagtcgattcctctttcgtcgttcagctcttgagggatctatccgcgttcaaattcggacacatccctcatctcagcagcacatggatgcttcccattattcggcgtgagatgatcatgcttgaaaaccagcttcctatgtttttattgagcaagctgttcgagctgactagtactgatgatcctccctcgagtctcaaagagctcgctcttcggttcttttaccctttgttacaagtagattcaaacaactttccagaatgtgagaaagttgaggagctaagagggcttcactttctcgatcttcttaggtcaagcattaggccgaaactaggagaaaacctgagaaaacctcaacatcacatgattcgctctgtaacagaacttatggaggctggtgtgaagatcaaagcagatgagagtaaacaattgcttgacataagctttgggaaaaagtacggttttctaatgagggaactcactattcctcctttgtacatcaatgatcacagaggaaccgtgtttcgtaacatagtcgcgttcgagaattgtcacaaggattgcaacccggatgtaacaacctacttgttcttcttcaatggactaattaactcttctgatgacgtctctcttcttcactacaaaggggtgcttaatcattctctcggcaacgacaacaccgtgtctgaattgatcaacaacattaccaaagaaatcgttcgcgacaaaaatgagtcctacttgtacaaagtggtgaataaagcgaattcgtactttggttccttctatgcgagaaaaagagcttctttggtgcatcattatttaactagctgggtggtgggggtttcgactattggcgcgttgttggcactttacttcactttcattcagactgtgtgtggatttgcagatgcgttgaaggccttggaaaataaaaactttggatctctctttgttgatgcgttttgtatcccagttcgcggtactcctacaactaacagtgaaagtgaaaatagtacaagcgaagatgctacaacaaaatcagaaagtaatggatggaagttcatccagtggttcttttgggttgaaaatgtacttcaccgatga

SEQ ID NO: 30617 - DNA, 573 bp, Glycine max
  Peptide Sequence Number=SeqID_122302
atgggggaggttagcatcaccctggatgatgtggcgtctctgcttcatcttcccattgttggcgccttccataccttcgagcctctgcatgtcgacgaggtcatgttgatgttggttgagttactagaggtctctggagaggcacccagggccgagacagcacaatacgctctccgtgacttgagtcagagtgggagctatgcatgggcagttgttgtcctagtgcatatgtacgatcatttgaatgatgcttgtaggagcagcagccaacaacttgctggttacatcactctcttacagtgttggatatataagcactttccgtcagttgcagagtgtatggttgattcggactatgatgagctacgatgggggcccattgctgtcagaaatcgaccagagaggatcatgcgccagtttggatatgtccaaagtattcctatagaggctgtcaattcatgggtgtcatttgaagaaatagacgacaggtgggtgcactactcataccatcttgcaccagcaggtgagatatgtcttatgccaggtcagtgtgcgcctgagtacatggactag

SEQ ID NO: 30618 - DNA, 756 bp, Glycine max
  Peptide Sequence Number=SeqID_122303
atggcagaaaatttcaagtctgtagcttgtgatttagagtgcttgaagtctcaatgtttatattccactaaattgatacagccatggcttgagaagatatggtctgagatagtttttaaagattgtgctatgtttgtgctacatctttgtcacatgggtattttactagaaacaataacagggatgcatgtagaaaatggtttgctttcacatggcttgtgtgaatcgaactctatcataagtgatttgaaggaacataattataggacaaagcaagagcttcatatgtgcaaaatcttgaaagggaaactgctggttgacatcaagaacaattttgatcgtattaataagaaagaagttgaagctagagaaatcaccatcaagctaaataattttgctaaaaacatatcagacctacaacttcaggaggagatgatgctgcaaaggtcgaatgaaatgggatcccaacttgctaaactgatgagggaattggatgtgagtaatatagatattgtgacatcccttttagatcaagagaaactactgaaacagaaagtagtggccattgagtgtgaggctgaattttttatggcaaattgggtgaacttgttgaagctaacagaaagaatggagataacagagagcttagaagatgaaatcctggaaatgaacattgtttttagccaaatgaatgattcatttacaaaactgagtagtgatctggatgatgtcactaataagagggatcagctttag

SEQ ID NO: 30619 - DNA, 906 bp, Glycine max
  Peptide Sequence Number=SeqID_122304
atgactcgctctatgaggcagatccgctcagcaagtagcatccacttagcgaggcatacagctcgcttagcggattgggaaaccctagaagaggataagctagagatgtgctcgcccagcgcgcagccagcctgcctaacgaggatgttgtctcttctcgtgctcagtgcgtcttgtctcgctaagccaaaattcacttactttcgcttagcgagccttcggaagctgaaaggtccaagagcctttaaaacattgaagttggcagaaataaggagaaggggtgtcattgctcaaatcaaccatgcaattggagcggttggtgttgtgagcaaagaatgcaaggtagtggtagctcaatatggaaaaaccatattggataagctgataaatgaggttctctctgtgtctgccgttagggataatatcttggaggctgtcaaagttttaattgacggtgcttacgtaagcactgtccttgaaagcttgttgttttctaagacggtgtgtttttacccgtcgttgaaagttaacactttcaacgacgttagcttctacgacggtcgtcgaccgtctttgtatgtggcaatcgcttcattcacacctcatttgccacctatccttgaagagcccactatgacagctggtgttgatggattgacaagtgcaccaattcgtcccaacatagcaaaaacccttcaagctgaaaatgtttcgtattcagcttctttgatcactttgatcaaggccaaccaagttcatggtttgtctcacgaagatccttacactcaattggctaatgctgtggagatatgcaacacaatgaagatagctcaggcgaataacttgcgtacttgggaggaagttgtgttcaagttcttgaaaaaatattttcctcaaccaatttga

SEQ ID NO: 30620 - DNA, 1423 bp, Glycine max
  Peptide Sequence Number=SeqID_122305
gcttctccacctgtccaaaccaggcatttcaaccggtgttgttcctactgctgctgcagctgctgcatctctaatgtctgatggtggggaggaagccaggcacaggtacctcacccaatgtgttccacttcacaaagcagcactaaaaggagactggaaagaggccaagaaaatactagaccaagaccccacgctactcaagtctgccataacaaaggggtgggcaacagtgctccacattgcagtcggagcaaaccatgaatgctttgtagaggagttggtgaaactactttcacgcgaagacttagaactgctagatgacaagggaaacactgcattctgctttgctgcagctgttgggaacgtgcacattgctgaaatcatgcgcataaagaatgaatcgttgccaactataaggggtggagaaggagtcactcctcttcacttggctgtgttacaaggacggagtgaaatgactcggtatctgtttgataaaactagagaaatactctatgatgatgattggattacactgttcctcatttgtgtaaactctgggctctatgagcttgccctggaaatgctaaatcagagggaatcgctagcttttgcccggggtgataactacgagacagctttgcatgttttggctcgaaagcctttgaattgtggcaagaacatgaaggaccctccggtccttaaacttacaagacgcatctgggatatatttcttacccttgatgactctgagatgatggatgcaataagagaaccatcccaagtaacatttattgccgcagaagaaggcaatttcgagtttctatctgtgattatgagcacttatccggatttgatttgggaattgaatacgatgggtcgtagtataattcacgttgctgccttacaccgacatgctagcatattcaatttgatacacgaaattggcccaagcaaagatttcgtgttaacatttttggatgatgaaggcagcacgttactccattctgttgcagtaatagcaccaacagatcgacttaatgtagtttctggagctgcttttcaaatgatgcttgagttgacatggtttgaggaggtaaaaaagatcatgctaccatcatttgtagagatgccaaattatgaaggcattattcctcgagaactattcaccaatcagcatgaagatttgttgaaaaagggagaatcttggatgaagcgaacagcaagttcttgcatggttgtctcaactctaattgcaacaggagtgttttctgcagctttcagcgtcccaggtggtatcgatgacaagttaggatctcccaattatttgaagaaacctttattcacggtcactgccattcaaattgatatttggactagtgtcactatttttctcaataatcagcatgatggtagcattcagtag

SEQ ID NO: 30621 - DNA, 528 bp, Glycine max
  Peptide Sequence Number=SeqID_122306
atgaataccataggcgacgacatgggttactcgggagattctgaagacaaaaggggttccctgtcttcacaagataatgtgaaacagtctccttccaccctagctggtgccatgagctgcgccaaaagttcaaaatataaaaaaggttccaagttttctggaaatggtactcagacacatgaacatgatgtttccgtgcgtggcaaactcagcatcgaagaaaaccctacactgctgttggaactgtgtgggtcgaaaaaaccctacattgctcttggaacagtcgtgggtgctcaaagctcaaagctttctacactgccagttaacaagttcttaatcagtgcggtggcattgtccgaagttgattgtgctttttctggttttcaagcttgcgagagttacacaccgagcaaagtttccatccgtgccgttgatggttttcacaacttgaaggagattaagaccgtggaactcgtgaaggcaattgggtgggtttatctatccttgtctggagctgatcctaggtaa

SEQ ID NO: 30622 - DNA, 348 bp, Glycine max
  Peptide Sequence Number=SeqID_122307
atgccgtccaaccccttctccccttttttcccttctccttcttcctcttatccaacagaaaacaactcaccccacgccaccaacagaaaacaactcacctcatggaagttaggggaaaattgcaagaaagtgacttggtttagggaatccctttcgattcgaagtagctccacatggtttagggatttggttgcttggacgaagatcacacatgaagtaggggaggagtggttggatgacgcggtggtggcggtcgacggcggtggtggtgcagcgtggtcgacggtggtggcgcggtggtggtggtttcccaacaagcccaagatctggtattgttcttcactttaa

SEQ ID NO: 30623 - DNA, 693 bp, Glycine max
  Peptide Sequence Number=SeqID_122308
atggtctatggtggtggcatggtggtggtggtttccggtgaagaaggggaagaaggtgatggagttactgccagtagtggcagtggtgatcctccaccaaacggtggccatgcgcagccaattcagcctccatcaacgaacacgaacttcaatcacatcatttctgagaagctcgatgttgtgaactctcttctggaaatcgcagattctatccaagctaatcttgtgcaacagaatcaaaatcagcctcaaaaccccaatcaaaatcagtacttgaattattcccaaaatgatcagaatcaatatcagcagtctaatttcaatggtggtcgtggtggccgctttggtggacgtagaggtcgtggtggtcgcagctctattcaatgctcaatatgttttcagtatggacatgatgctggcaattgtcggcatataccatctttctctttctacggcacaacttatcctagtatgactcaacctatgcaaccaatggttcaacctatgcaagtttcttttggcacacaacaacagtatgcacaagctctagtgcaatatgttcccatgctcaacaatttttctgctcaacctgtctttccacagcagttgcagcaacaagcttacttaggcactgctcaatctatttttccacatcacaaggctacttgggaaagtcttcacaagctccaatga

SEQ ID NO: 30624 - DNA, 282 bp, Glycine max
  Peptide Sequence Number=SeqID_122309
atggcaaatcattttcatgaagatgaggttcaatcttatgctaccgtggatgagaggattgtggaaattcagggagaagccttgaaggtccttaaagctcttgaagcagtagttggccatctgaggaaatttttggttgatcatagcgttcttcccctatttgagaaaactaatggagtacctgaggtactaataatacaggaaaggaccatacaaatggttcctcaatcagacattcatattctgaaagggaaccaatctatggatataggtttcatatga

SEQ ID NO: 30625 - DNA, 504 bp, Glycine max
  Peptide Sequence Number=SeqID_122310
atgaagaagatccaaggcctacaagctccacatggagctacatcaaacatcctacccagtgaccacaactttgatctccctctgccgaagtgtcagctagtgcatgccatcctgacacaggtctctaccagttttatggagtgcctgtcacccccagcattcggccccctatcaccagggccttcatcgagaagtactacacctccagacaggctcagggcgaggcaccacaatagcttggagatgcccagtcgcaggaagttgatgcaccgctgtcttctcagagtccacctcagctcacttgcggagagccaggatcctaacacttatgcatggcctacccatgagcagttcgaccccacagtggcatggcctggagattggcccgatgctcagacaggggcagggcatgcaggcacctctggagatggatacggaactgaagaagatgatgacatggctaacgtgatggacttcttccttggaggaggcggagatgtatga

SEQ ID NO: 30626 - DNA, 402 bp, Glycine max
  Peptide Sequence Number=SeqID_122311
atggcctccatgatggaggccatgctaggtatgaagagattaatagagagtaatgcaaccactgctaccgtcgtcagcaccaccgctgaagtagacccggtctttccgtctacaacaaatctagcacatcaactttccctggatatggtgggacgagaaagagacacattggggaataccaacagcccgcattttgggtacaaccgaagtgcttaccccaacggactaccccccaactttacgccacctgccatgcatgagaacacgaaccatgccattccctttaccttcgaagggcagcttccccagcctgtagggggcacccgtgaagagccttgggagcgtgcccaaggggacatcgactcataccccccatttccccacttagggactggcacctaa

SEQ ID NO: 30627 - DNA, 285 bp, Glycine max
  Peptide Sequence Number=SeqID_122312
atgactctcggcaacggatatctcggctcttgcatcgatgaagaacgtagcgaaatgcgatacttggtggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtcagggggctacccgctgagtttaagcatatcataa

SEQ ID NO: 30628 - DNA, 615 bp, Glycine max
  Peptide Sequence Number=SeqID_122313
atgaccggtagattgctggccgggtcattaacatttgataatcgcatcatgcactatataattgttagaattttgcttccccggtcttcaaatttagcacaagcctctaaggaggatttgattctgatgtgggcttttcttaccagtcgtcagatcgactgggctcacttggttcggtaccgaatgcataaggcattacgggccaatgcacctctcccttaccctcaattgataactttgtttctgcgtcattttcaaattccgcttgatgatgaaccatatgttcaagtcaagcgttcctttgcaattggtgctggtgcagtgacttcctttggataccgtaaggatcggaatggtcaatggctgaagaaagacgcattccctcctcaagatgagcgtactccttcacctcctcctcagcgagatgattcaactcttatgaatgaagtccttaccgaattacgaggtcttcgtttttatgttggtgaacgtttcgactcattggatacacgttttgccggcatggatattcgcctcacacaacttgaagaggatgtgggttacattcgtcagagtttcgatcttccaccaccacctccaccttctagaatttag

SEQ ID NO: 30629 - DNA, 237 bp, Glycine max
  Peptide Sequence Number=SeqID_122314
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggatgtcaagccatgtggggtagtggagttggaagaccccattacaaaaaggtcttggattatcaatggacaacgattaaagccttatcttggtggtga

SEQ ID NO: 30630 - DNA, 387 bp, Glycine max
  Peptide Sequence Number=SeqID_122315
atgaaaactggggaaaatgaagaggatgagaatgagggagaaacccttgctatgactgccattcctacacggtcaaatttcccatcagtccaacaatgtcattactcagccaatatcagcccttctcattacccaccacctagtcatccacaaaggccatccctaaatcaaccacaaagcctgcccgccgcacatccggcaatggtagccataacccctgctaaggttcctcaacctccatttttccgaggatatgactcggatgcaacatgtgtatatcatggaggagttccgggacattccattgagcactgtatgaccttgaagcttaaggtgcaaagcctaattgatgtgggctggctgaaatttgaggagcatcgcttgtga

SEQ ID NO: 30631 - DNA, 351 bp, Glycine max
  Peptide Sequence Number=SeqID_122316
atggttatccacaccttttgtcagccagaggcaagcgagcccgttgacacgcagagactaacatcgtcatctgcacctttatcatccagagactgtaagtccgatggcatgcggagatactttatggttatccgcaccttttgtcagccagaggcaagcgagcccgttgacacgcatagactaacgtggtcatctgcacctttgtcatccagagacggcgagtccgatgaaatgcggagataccttatggttatccacaccttttgtcagctagaggcaagcgatcccgttgacatgcagagactaaacatcgtcatttgcacctttttcatccagagacggcaagtctga

SEQ ID NO: 30632 - DNA, 318 bp, Glycine max
  Peptide Sequence Number=SeqID_122317
atgaagaagcaatcaggatctcaagacaatggggatagaggaaataatgaactccaagagaatggaaagcctcaagagatcatcccctcgacaacattattggtgatatatcaaaagggatacacatggactcttttcatcactcataagaacgatgcatttcaagcatttagaaaacttgcaaaaatcattcaaaataagaaaaatctcaagattatatctattagaagtgatcaatggggaataaggcatagggttgagcataacttttctgcaccaagaacccctcaacaaaatgggtatgttgaagaggaataa

SEQ ID NO: 30633 - DNA, 823 bp, Glycine max
  Peptide Sequence Number=SeqID_122318
actggccttcgcgctctttttcggcttgtgggttgggaggttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacaccccggcgagcagagctcgctgttcgattgagggcgaattggtggggggatcgcttataacgagcgaatcctcgactccttcgtccggagtcaacttgcaatcgaaagggcacatagaggccgcacttgtggcggacggatattccccgcaagtagtctttgaaagaagacatatgattcgtggctttcttttctatccggaggggcatgcgctgagtgaaaacgcttacgcgggttatctgaccaaaattgccaattttgccggcaaaatgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccccaccgtcgtaaaataagagcacccagctctgcccattcacaaggactcgattctatgtccaaacatcacatgccagcagatgtggtcaccatcatag

SEQ ID NO: 30634 - DNA, 495 bp, Glycine max
  Peptide Sequence Number=SeqID_122319
atggctcccgaagacctggagcaactgacgcaaaaaatcagggaccaattggaggagccgatcacagaaaaagtgactcgacaattaatgttatccttcagccagatgcaatctcattttcaatcgcagatgcaatcacagggactcacactacctcctgagcctgaggttagtccttcatatgctcgtgtcagcacaaaggagagttgtgttgatcccttaggaaatgatccagacaagggtgactcggaaaaatatgggttatacgtcgaagaaaatcctccccgcctggttgccctaggaagactttatgaggggtccacaactgttcacaacattcctttgctccatgatcatgtcaaggttggtgttgaggaggttaaagatgcagacactctcattcatgtacccactgaagaggttaagttagtggggcaaacactaaacaccttccttacttggtcgacacatcttgtcaagcgtttatcaaaatag

SEQ ID NO: 30635 - DNA, 372 bp, Glycine max
  Peptide Sequence Number=SeqID_122320
atgtccaatcagaagagcacagagtccgccataaagaatcttgaggtccaagtgggacaacttgcaaagcaattggcggatagatcatcaagcagttttacagctaatacagagaaaaatcccaaggaggaatgtaaagctgtgatgactagaagtagaatggcaatccaaagagatgatagtgaagctggaaagaagatgaaggaacataaacaacagctggcacctaagccagcacttgaacctctttctgattttgtagaacttgaagagattaatgaggagactgaagatgacaaggaagaagagacaccaataaaagagaaagaaaaagaaagaagaaaaagaaaaacaaaaaaagttgaaaaatga

SEQ ID NO: 30636 - DNA, 450 bp, Glycine max
  Peptide Sequence Number=SeqID_122321
gtttcgcttgtaatgtggtttcctggcaattctcccttcaccagtatcccaaattcgtgaatattaatcagtgcacgcttcgtgttcgattaattgcctctgagcctaacttgcgttcatgcttaatggacgaagggctaactggcacactgtccatggagtttggtgatataactgttcattttaatattctggatgctatgaaatacccatctgaagatctttctgtatttcgtgctgaaataattgaccatgttgttgatgaatacatgactgatctttattctaatctgcatgcctctcacttttcatgcattgagtctgaaattgtacttgatcatatgactgaatttgatgttgagagtgatattgattgcatgcctggcggtggtgttttacctcttgagattgattttatagagtcagataggactaaccatgtttcaggaa

SEQ ID NO: 30637 - DNA, 384 bp, Glycine max
  Peptide Sequence Number=SeqID_122322
tggaattgctcattgcattatttccttgaaatcagaactataatcattgtaatcaaaaggaaagaatgcgcattacggtgcccttacccaacgtgtgccaaagctagagtgatgagtgaaatagaggaggtgcaagagcagatgaaggccgacatggaggccatgaaagaccaaatggctgccatgatggaggccatgttgagcatgaagaaaataatggaggacaacgtggttgcggttgccactatgagtgctgccactgaggtagatccaactcacccacctggcctcaatcaagtaaatcctccaatatcggatatggtagggcagggaggcgaagtgatgcaatcctacaccccaagggcattggatagaagactctaa

SEQ ID NO: 30638 - DNA, 162 bp, Glycine max
  Peptide Sequence Number=SeqID_122323
atggaggttgaggaaccttggttggggttatggctaccattgaattatcgagtggatatgggatcaagttcagcatatgacaacggaatttggggtgaaccctacaggctttttgctgtggtcttcgtcattggaagtgcggtagacaagctttgtggttga

SEQ ID NO: 30639 - DNA, 560 bp, Glycine max
  Peptide Sequence Number=SeqID_122324
gaaggcaaggaaggagtcttttctcgtgtggggactaccctaatgttccattgatagggactaggggttgtattaattataatcccgcactcgccataagacagctagggtatcccatgaggggaacgccaaccgaagaaagtctctcgcctttccttgtgaggggtctaggcgcgcaaagtctcaagccgatacaaagagtccacaaggcgtggagaagtccgttgaagaaagacaaggagcttagaggcatccgaaatgtcgtcatcggaggttatcatggatggctaagaattcacacgcgagggttagattggctctacaaattgaaagttatcgaggaggagaacttcgaagctccggaggaagatgaagaagtccaagctctcaaattggagctagggaaggcaagactcgccaaggagaagttcaaatcagttgctacacacatccggaaagagtgcaccgagttacaagaggaaaacgcggccactgcaagagcccttgaacaagaaatcaaaagggcccgcaaggaggagtatggtcgagagaaattctga

SEQ ID NO: 30640 - DNA, 204 bp, Glycine max
  Peptide Sequence Number=SeqID_122325
atggaggctaagttcatttcctattttgaggctacctttcatggtgctattatattgaagttgtactatgacacctctgctacaatattcatggctaaaaacaacaaaagtggaagtcaaagtaagcacaccaacatcaagtacttagccataagagaacgtgttaaagaaaagaaagtggtgaacacattagcattgagttga

SEQ ID NO: 30641 - DNA, 480 bp, Glycine max
  Peptide Sequence Number=SeqID_122326
atgacggaggacgccatgaaaaccagaaaactgacggaagccgacgtaacggcggaatcggtatttaacctacagcgccgccaggtgctgaaaatgctcggtatcggcgcgacggcgatgtcgctctcaacgaaggcccatgccgacctgctcgattggtttaaaggccacgatcgcccgccggcgcctgccggaaaggcgctgacctttgataaacccgcagcatggcaaagtaagctcgccctcaccccggaagataaagtcgccggctacaacaacttttatgaattcggcctcgataaagccgatccggccgctaacgcaggcagcctgcgcactgacccctggacgcttaccatcggcggcgaagtcgccaaacccctgacgctcgatcacgacgacctgacccgtcgtttcccgctggaagagcgtatttatcggatgcgctgcgtggaggcctggtcgatggtcgtgccgtgg

SEQ ID NO: 30642 - DNA, 51 bp, Glycine max
  Peptide Sequence Number=SeqID_122327
tacttccatgcctctgggattggatgggaagggaaggatgatttcccttaa

SEQ ID NO: 30643 - DNA, 135 bp, Glycine max
  Peptide Sequence Number=SeqID_122328
atggagaaaaagagggaggtggttgccgcccagctcgcccagaatgttgcagaactttacggattgcgcaaaaatgccctttttgacttccagaatgtggcggaactttatagattacttaacgatgggtgttaa

SEQ ID NO: 30644 - DNA, 696 bp, Glycine max
  Peptide Sequence Number=SeqID_122329
gtgaggcatacttgcccgttagaaagccaccgttcatgcacagagaaaggaagggcaaattgggaccaactcttagcaagcaaagaaggaacatctgtcaactggttccctcgatggaaggaaggaagaaccgaagttcttatttcatgcggaggatttccaaatgttcccttgatggggacgaggggttgcatcagctacaatcccgttcttgctataagacaacttggctaccctatgaaaggggcgccactagaggatgagcttacgcctgtccgcaaggcatgggaggtgttgcaaaagaaggacaaggaactcaggggcagtaacaatgggcccatcggtggctatcgtaagtggttaaaaacccacgtgcaaggtttggattggcttccaagtttgagaaccgataaaagagaggaagttgaggcaccggaggaagacgaagaggtgcaggcccttaggacggaactcaagcaagcccaaacagttaaagaaaggttcgaattagcagctttgaaaatccgaaaagagaataccgaactgagagatgtaaatgtggctaccaccaaagccttggaacaagaaaccgagagggcttgtagggaagaatgcggctggaacaagttccgacggactctgtggggcagcaacagcgagcttaagctccggagagaggaaagggaccaatcacga

SEQ ID NO: 30645 - DNA, 992 bp, Glycine max
  Peptide Sequence Number=SeqID_122330
atggctacaccacccagctttccgcctcttactgacgcaacatcatattcgccgtctaccttgaagcggataagaaaagccacatgcctaagatcattggcgactagaccagttggggtagagaaacccctggtccatgtggatcctacgatcaagaaagctgacggtccccacagaaagaagttaagaacatatttggggatcgtcgctcgtgataagtctgatttgatgtcgaaatgggcacttgcagccgacaaggacagtgtcgatgacactagccgcagagacccttcgtgggaggatgtgcaaaaaaaggcacaggccatccaaaaacaaaatagtgcccctcacgtgttgtttcatgggggttatgaatttctagaaaacaagttgatgaaggagaagaaaaagaaacaactagaggaagctactaaatttggaagcactaacactgtcattgatcctccatctcccatcagacgacacgtaaagtggaagatgagccgcaccaataaaactgggcaaatgacttctaaggtagctaaggaaattgttgacaagattgatgtactgactgctgccattgggcaaccagaacaccatggtcgtgtgcgtgctgctggagccggtatgcaatcacaaaaacttgcactgcctcctgagcctgaggttggtcatttagctactcgtgtcagcacaaaggagagttgtgttgatccctcagggaatgatctagacgcgggaagactttatgaggggtcgacaaccattcacaacatccctttacaccatgatcaagtcaaggttggtgttgaggaagttagagatgcaaatgctctcattcctgtatccactgaagaggttatgtgggatgctaccgtgtttggggtgtttaatgacaacttccccttgtacataaagcatgaagatctgtctaaaataacacacggtggtcaatgtctcagcatctctgttatacagttgtggattct

SEQ ID NO: 30646 - DNA, 198 bp, Glycine max
  Peptide Sequence Number=SeqID_122331
atgacattaggtgctgaattcaatgtggaaagcttaacatgtagagattggaacacatcagcgaaagtatcccaaaaggtatgtgttcggttctgtgcaagaaagaaaaggactacctatataagcatgaagtttagccgcttgaagaagctgggacttggctttgatatgcttatgaaggatagggacacaggctag

SEQ ID NO: 30647 - DNA, 353 bp, Glycine max
  Peptide Sequence Number=SeqID_122332
gtaatccttgtggcgtctaccctgacttatcttccttcattggaagtggcgtctacccagacttatcttccttaaccggaagtggcgtctacccagacttatcttccttcactggaagtggcgtctacccagacttatcttccttcaccggaagtggcgtctaccctgacttatcttccttcaccggaagtggtgtctacccagacttatcttccttcaccgggagtggcgtctacccggacttatcttccttcactggaggtggcgtcaaccaaaaactctacaggctgtatcaagcgatccgccccgtaagattcgcatcatctggtatcagagcttcgctcttgatacag

SEQ ID NO: 30648 - DNA, 612 bp, Glycine max
  Peptide Sequence Number=SeqID_122333
atgactacacaaatgcaacgtttgttgaaccgtaacaatgaagagctctacaggcgaatagccaaatcttccttgtttattcttaaacctctatcccctagagaagtgtgtgatgaccaaatcagaatgagagaaaagagagaacaagagaaagaaaatagtgaggcaccacagaggaataggaaaaagaagagtgatacacccgagggaaagagtgatacacataagagagagagtgatacacatgagagaaaatttaattattttgcagaggcgagtgaagtgaggaaagtgttacctgctcatgaaccactctgtctacagtattgcaaagacagtaaaatttctactgagactcaacgtaaggatgcacatgccaaagttgagtatgtgaaaagattgtatgaccaagtgaatgtgcaaattgcaaagaagaatgaaagctataccaagcaagccaacaagaaaaggaaggaagtggtacttgaacccggtgatgatcttggacatttgagagcaaatgttttccaagaaggagggaatgatgagagtcctgaaactggccaaatacaggctaaaggcccaagtggagaaggacgaaggcccaagtga

SEQ ID NO: 30649 - DNA, 105 bp, Glycine max
  Peptide Sequence Number=SeqID_122334
atggttaaagcacataaaaagggggacaaaagagggaggtggttgccgcccagctcgcccaggcgagcagggttgcttccaccagaaggcaccgccttctgttag

SEQ ID NO: 30650 - DNA, 434 bp, Glycine max
  Peptide Sequence Number=SeqID_122335
atggagacactcgccatgtttaggtatgaggcaagctcatggagttacatgacgcggtccaggcttccgtctgggaaaaagggaaggaaggagatggcccatgccgtctcttcaacacccgcgtgggtcaaaccccagcaaacgcacctcatggtgcccattcagtacgcttgcagacatgcaccaattgcttctcggctcatgctgggaacgcctctagttcaacacccgtgcagcctaaggcgcccacccagagggaagctccccaagttcaactccgaacacgactcgaccggtccggaccacccccggcaactgaagaaaggaggaagctcgatctcctcgaggaagattgagagccgtggaaggatttggggattatccgttcgcagacatgacgatctttgcttagtacccgatgtgtatcccctgaa

SEQ ID NO: 30651 - DNA, 207 bp, Glycine max
  Peptide Sequence Number=SeqID_122336
atgatggtgacccatgtaatgttggggcacggttatgagcctggaatgggcttggggaagaataatgatggcaaggccaacttagtagacatcaaggaaaaccgcgggaagtttgggctaggctataagcccacgcggactgatatgagaagaagtgtcttagaaaggaggaacagaggcatgggcccgcaactaagccacaagtga

SEQ ID NO: 30652 - DNA, 414 bp, Glycine max
  Peptide Sequence Number=SeqID_122337
atgtcccatgctgtcaaggaccatcgagggaaatgggccccgaactacgaagggccttttgttgtgaagagggctttttccggaggagccctggggcaggatcatcttgagctaccttctggggtagagacaaaatatgaacaacagaaaccaatcaaggtaagacagcgatacggtcaagattggccacaccaggttgtttcttacttgcaggttagctcgcctgggcgagccacccctgcaccaaattataagaatgacgaaaggggggacgtttttgcattcaaaaacttcttcccccccccccctttcaaaagccatacccacgggattgacgagtttgcagccctagggtcatcatttttcgcattttttgattccgttttgcgcttttgttcatcaccaacaagttga

SEQ ID NO: 30653 - DNA, 318 bp, Glycine max
  Peptide Sequence Number=SeqID_122338
atgactgaaacatcccagaaatccctcaggataccttgttgtgtccaagtagccatcaagcctttaattgatatgggcatcgatgttgcagtcttaatgtgccttagagatattaggcataacaagtttgaagattccttaattggaacaatagaaacaagcctaagacaaggtccaatatacttcaattgttacccaaacaaaaccgtgagtctgatggacagaaacattcttgactctctgtttctaaatacccactttcatggcctcgacatgaaagaaggatcaattccaacagcattgatttacaggatttag

SEQ ID NO: 30654 - DNA, 217 bp, Glycine max
  Peptide Sequence Number=SeqID_122339
atggaagcgcagttaatccatgatcgcgtggtgatggagtgcctacagggagtttgggagaccctcgaaggcaatgagaggtgccgattccgtggcacaattcgactcactgctacttcattagtacatccgggaggaacccgaacgcacactacagcaacctgtggagtggatactacctacacctactccatatcgactagtggagccagttcaa

SEQ ID NO: 30655 - DNA, 195 bp, Glycine max
  Peptide Sequence Number=SeqID_122340
atggagaagacaaaattgtttcaagcactgacagaagcagaaacaccctttgttttaaagtttcaaagaggagaggatgagttattcacatttcatttgatggccagaggcaaattgaaagctaaattgtggagcggatcgcttgatacaggctacgaagatttggatgacgccacttctagtgaaggaagataa

SEQ ID NO: 30656 - DNA, 578 bp, Glycine max
  Peptide Sequence Number=SeqID_122341
atggcgggcgcgacgctggcgctggctatctcgtcgcttactcagggaagaatggcggtggatctggtcgaggcgactcggccggatgaccgcagccatccgggctttgacgcccgcgccatcgcactggcgcagggcacctgccaacagctggcgcgcatcggcgtttggccggcgctgcgcgattgcgctacgccgatcgctcaggtgcacgtcagcgatcgcggccacgccggtttcgtgaatctgcaggcgcaggattatcaggtcgatgcgctcggccaggtgatcgaactgcataacgccgggcagcggctgttcgcgctgctggcgaaggcgccgggcgttacgctgcactgccccgcgcgggtggtggacgtgattcgcaccgccgagcgggcggaagtacaactggataccggtctgagcctgtgcgggcaactgctggtggcggccgacggttcgcgttcggcgctggcgcagcctgcaacgtgcagtggcggcaggaggactatccgcagttcgccaccatcgccaacgtcaccacggcggaagatctgcagggcgcgccttcgagc

SEQ ID NO: 30657 - DNA, 147 bp, Glycine max
  Peptide Sequence Number=SeqID_122342
atgaagacgctcttgataccacatgatgtagctccatgtggagcttcggaatggagaagaagaagagttgagaggagacgccacttcaaggagaagatgagtcaagaagaagctcaccaacataggaagctatggataagagtttga

SEQ ID NO: 30658 - DNA, 249 bp, Glycine max
  Peptide Sequence Number=SeqID_122343
atgaccattcgactttgtcgagagcttccgttgttcaatttcgagcgtctcgatatattatgtccccgaatcggtcaacaacaacaacaacaacaacaaccacgccttatcccactagtctttttgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 30659 - DNA, 226 bp, Glycine max
  Peptide Sequence Number=SeqID_122344
tggatgtactcggttgagcgatacatggagatctaaaaagggtatacaaagaatctacactgtccggaagcatctattgtggaatggaaaattgcagaagaaactattgaattttgttcagagtacattgagaaagcaaaacttgttgggcttcccaagtcttagcatgacgaaagagtgggaggtgagggttcaagagggctgcatgttatcactccaagtgtag

SEQ ID NO: 30660 - DNA, 456 bp, Glycine max
  Peptide Sequence Number=SeqID_122345
atgggtgaagtagaggaggtgcaagagcagatgaagaccgacatggaggtcatgaaagagaaaatggccacaatgatggaggccatgatgagtgtgaagaagataatggaggtcaatgcggttgcaatagccgctacaacaccattgctgaggcggccccatgacgtgcaaattcaaaacgagcacgccttcccaccatatggcttgcctcccaactatacaccacccaatgtggcgtacactcccgatgaggatgtcaataactccgctcccatactcattgagagccgacaacctcatcatgaacatgtctctcaactcatgggggagacatatgaaataccccaccacaatctagccaaattcgagccttgcctcagatatgccactaaagggcaagcagttggtggtataccactgcaaaacactttggagggccctcaattttgcccctaa

SEQ ID NO: 30661 - DNA, 522 bp, Glycine max
  Peptide Sequence Number=SeqID_122346
atggataatgaagagggcgtgcaggaacagatgaaggccgatctatcggccttaaaagatcaaatggtttccatctcggaggtcatgctaaaactccagaaaactatagaggataaagccacggcaactgcctccagtacagctagggaagcggagccggtgctacagcccgccttaaatctgggccgagacagaaacacggcagtgtttggtcggaggtatagtccgcaagcttacccctatggcttgcctccggacttcgctccccgtgccgccccggaagatttaagccaaacccctaccttcgaggggcaactcccaccttatgacgactatcccgtgcaagacgatgaggaaggagatacccatctcggccccctgctccgcctcaaagatccatccctccatgaactaccccaaccaaacgtagtccgccacgtcccatcttcacccgcacccgtaatcgaatccgttcccttcgcagaggataagggaaagattgatgcgcttgagagaggctga

SEQ ID NO: 30662 - DNA, 456 bp, Glycine max
  Peptide Sequence Number=SeqID_122347
atggtcattgatacacgtggtgcacaagataagaaagcttgcactcaatgtagatgtgaccagatgaatctcccgaaggacttttataatgtcacaagggatatacataaccaaaaattgactacaaattataaaggaggtctattttgttgtcaggacaacttacaatgcaagcaaatagagggttttcaaggttcaaggagaatggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgtgtaa

SEQ ID NO: 30663 - DNA, 222 bp, Glycine max
  Peptide Sequence Number=SeqID_122348
atggtcctaggcaaaccatggagtctcacaacttccctgaaaaagagttttgagatgtgggaagtgtcataccctaatttcgtccggggaccattgtttggtgacatgcaaccttcgcttgacctcctcgagcaattcgagtctaggcccttccaaaacattttggaagttgggttgcttaaggaggaagcaattgggcgacaagctcctccacatttttga

SEQ ID NO: 30664 - DNA, 174 bp, Glycine max
  Peptide Sequence Number=SeqID_122349
atgtcaatgggagaagttgatgtggaaccatgtttgagtgcctctaagtttaaaaactgggaacaaggtcagccctgtaataaccgtgaatccatcactgtcatagtgcaagaagtgacacccagggaaacactcctggcagcatggaagctgatggttaacctcctgaggtga

SEQ ID NO: 30665 - DNA, 186 bp, Glycine max
  Peptide Sequence Number=SeqID_122350
atggttaggactagaggcttaggtcgtaccttaggtagggttattggcagagctttagggagaaaggatcgtcatgatttagatgatgctccccagcggctaaaggcccaagtggagaaggacaaaggccctagtggagaaggacaaagcccacgagtggagaaggatgaaggcccaagtggataa

SEQ ID NO: 30666 - DNA, 231 bp, Glycine max
  Peptide Sequence Number=SeqID_122351
atgaattgcgttttcattcatgtgtcctccaccttcgagtttggagctatgcgtagtgatttcttagagcaattctccattctcaatcctttttcggagccccatgaattgcagttttcgttcatgtgtcctccaccttcgattcatgtctcctcaaccttcgagtttggagccatgcgtagtgattgcttagatgaactctccattctcaatcttttcggagccccatga

SEQ ID NO: 30667 - DNA, 237 bp, Glycine max
  Peptide Sequence Number=SeqID_122352
atgatgttcgttcgcctttgggctctatggcccgatcacatctattccccggtgacatggaaattatggcatggtggccaaaacctcaaggaagggcaggacgttgccaccggggattcgtccggagatgtctggcttttcaaagatgtacttgactggtccatcttggatatcaacatcactcggtgtatggctcagcatagtacctgccttaggcgatgggatgctccatactaa

SEQ ID NO: 30668 - DNA, 490 bp, Glycine max
  Peptide Sequence Number=SeqID_122353
tgcgtaatagctcactgatcgagcgctctgcgccgaagatgaacggggctaagcgatctgccgaagctggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 30669 - DNA, 447 bp, Glycine max
  Peptide Sequence Number=SeqID_122354
atgtcattgcctagcgttgttcatgtgttctcccttatcaagtgcgaagcttctggtgactgggaagcacgttattctgttgttttccagatcggttccttcgccaaaagaaaaaaaaaagaagtagagatgagagtcgtcattgcgaaaagggcaggacggacgaaatcagtgtcctatctttgctttcctcttatctccgatgagaggcccacttgggccttccagaaggttgtttcttctgtaggaagcaacctggctcgcctgggcgagctgggcggcaagcatctcccctattttgctataaataggggaggaagtgaagaagaaaaagccgaggcgcttccaaaacgcttctgtaacgtttccgtgaagaatttcgcaaaaggtttcaaccgttcttcggcgttcttcattcgttcttcattgttcttcgatcttcaacgg

SEQ ID NO: 30670 - DNA, 528 bp, Glycine max
  Peptide Sequence Number=SeqID_122355
atggataagtttgaccctgaggtagtcctggagttttatgctaatgcttggcccacagaggagggagtgcgagacatgtgttcatgggtaaggggtcagtggattccctttgatgcagatgcccttagccagttcctgggtgacccgctagtgttggaggaaggccagcaatccgagttcagccagaggaggaacagggctgacgggttcgacgagaaggccattgcccagctgttatgcacaccggggcaggatttcgcccggaccgctgcagggaggcgggtgcggatcatgcgcaccagcatgaccactttgccccaaacgtggatgatattgctactcagcaatgtcttgcctagcgatcataactccgatctccctctaccgaagtgccagttggtgatccgaccgccgatcactggggccttcatcgagaagtattgcacgcctaggcaggcgcacgtgatgcacctcaggccacaaatgcaccgccaccatctcatcaggccgatcccgttggatcactag

SEQ ID NO: 30671 - DNA, 509 bp, Glycine max
  Peptide Sequence Number=SeqID_122356
caatactttggaccggctccaaggacctcccgcacgtcttcctccatggctcccgaagacctagaatagctaactcaacaaatcaaggaccaggtggaggagtcgatcacagaaaaagtgactcggcagctaatgttatgcttcagctagatgcagtcccagtttcagtcacagatgcaatcatagggacttacactgcctctcgtgttagcacaaaggagagttgtgttgatccctcaaggaatgatccagacatgggtgacttaaacaaatgcaggttgtacatcgaagaaaatcatccccgcctagttgccctaggaagagtttatgagggatccacaaccgttcacaacatccctttgttgcatgatcaagtgaaggttgctgttgaggaggttaaagatgtagatgctcccattcctgtacccactgaagaggttaagttagtggggcagacacttaacaccttcattgcttggccgacacatctcgtcaagcgtttatcataa

SEQ ID NO: 30672 - DNA, 671 bp, Glycine max
  Peptide Sequence Number=SeqID_122357
gcttgcagagttgggcattgaggcccggtcagtgtttaaatcccatggttaaggcagttcatagctttcaggaaattgtttgtgtaactattggcacaattactaggattgttatggacaatcattcatggtgttatatagcttgcattcagtgccataaaaaaattgatgcagagatgatgcccttcacatgtgcatgtggcaaatacaatcaggaagctatgcttaggtataggcttgacgtgatgatcaaccacagagatgaaaacacaaaattcttgctttgggatcgtgaatgcactgaattaattggtcagtcagctgatgcaattaataggcttaaaattgaaataaaggtgcaacccaagttcaggaattctgccattttgaagtgttctattgactcaagcttaattgatgttgtgatggacatgctacctgatgctgagacatcttcaaaaatcaatgtcccagcctttgattccaatcattctaccaaacatgaatctaaatccatgtctgtgactatagaccatgatccactgcttgggctcccattgacacctacaaagcgacagacatttcatgattgtgatgatgaagcaacgagctctctaatttcacctgcacagctttcatctaacaaattaaaaaaacatgactcaatttag

SEQ ID NO: 30673 - DNA, 237 bp, Glycine max
  Peptide Sequence Number=SeqID_122358
atgaaaaagagaccaagcatacctcgaacccaaatagtgacaatggcagtgagatctaacaaaatggcacaaaacttgaagctttcctcgtacctcaatcagcaatactacaacttgatgcaatcctaccccgcaagggcattggctagaagactccaagtagattgggctagagatccaaggaaaggccctagggttctcatgagccttagggtagatttcgagcccatgggctaa

SEQ ID NO: 30674 - DNA, 480 bp, Glycine max
  Peptide Sequence Number=SeqID_122359
atgattgaaagttttcaacaacaacaagaaatgggtgtcattgaattgtgcgttgaagtagatattgccggtgcttttgcgttgaatgtgaaaaattcgctattatcatgtgggaataatatagttggcaatgaatcaaaagttcaaagatttgtaacaaatttagatgaagattctgacgatgatgattatatgatatataattcatatgttgaggactcgtcggatgaggaggaagatatcaatgatatatctgacacagatgaagaaggtggaagtgagattgcattttgggaatctgcttctaattatagtaacattaattggagtcatccagatgaagaagatattcgtggtttcgatatgggatcaaccttcaatattggccaagaattatttgttggcatggaatttgaaagcaaaaatgcagtaaaaaaatgcactgcaacagtatgttataaaggtgcaccaaacttttaa

SEQ ID NO: 30675 - DNA, 267 bp, Glycine max
  Peptide Sequence Number=SeqID_122360
atggcagtgcagttgatccatgatcgcgttgtgatggagtgcctagaggttgagccgattcaagtgatagaggtgtcatcctctgaagagggcccagaggagttacctcctgaacctgctatggacgcccttgacttacctgaggatgatgaagacccactccctgatgttgattctccagaggatattatgtcagcatctgaggcagactctacagaggagagtggccctggagggacagcgaatagtgacgactcttcatcatag

SEQ ID NO: 30676 - DNA, 681 bp, Glycine max
  Peptide Sequence Number=SeqID_122361
atgctgttggttttcgcgttgcctattgggaaaggttgtctcgctcgtttctctactccggtgatgcatgatgggcatgattatttgtggctctcgagcgaatcggtgctagtaggtgatgggaatataggcgatgcgttgctatacggcagtcggtgcttcgtgggatggctctcattcgaaaatgcggctgttggttggcatggttgcctgaatgttgcggtgctcattggaagtttcgctcgagccactactcaaggttggatattcacgaatgcatgttgtcggtgcccgttggaatgtttcgctcggactcactcgaccgcacaagtgggtggtggtgcaaataagtgggtggtggtgaacaccgcaaagaaaaatgctgtgctcttgcattgcttttggttggacaacgatgcgccttctcgggcattgcgtacggcagggcgcgtgagtggtgcttggtgcgcacgggcttgtcggatccctgctcgggcagcgacggcaacttgtgcgcgcctcttcaatcgtcggttcaagtgtgccttgatcggtgtcggtttcctggtgcggcgtgggatggaccatgaagcatccgtcgtgttccacatcccagacgtaactgtccccgggttgttggcgcacggcggcacgctcgatctctcggatgcggaaaattga

SEQ ID NO: 30677 - DNA, 57 bp, Glycine max
  Peptide Sequence Number=SeqID_122362
atggatccttttgatgatcttctaccagtggctcttgttgcacgtatggtggcttag

SEQ ID NO: 30678 - DNA, 108 bp, Glycine max
  Peptide Sequence Number=SeqID_122363
atggaagagggatatgctgctgctagtgaagttgggcaggttcatttgcggatgaggaagatgatactggttgaggtccttgatactgctttcccgacctcaatgtaa

SEQ ID NO: 30679 - DNA, 210 bp, Glycine max
  Peptide Sequence Number=SeqID_122364
atgttgcggaaccttacggattacgtaatcatcccttttttgcctttcggaacgttacggaactttacgaattgcgctttaacacttccttttaattgtcggcatgtcacggaacttcacggattgtgctacaacgcttttcttttggcttccggcatgtctcaaaacttcacaaatttcctaacgatggatgccaaatacctcgaagtg

SEQ ID NO: 30680 - DNA, 341 bp, Glycine max
  Peptide Sequence Number=SeqID_122365
tcaatgagcaacctgaagcttatgctgcaaacatttataatagaccccctcagcagcaaaaccaacaacaacagactaattatgatctttcaagcaacagatacaatccaggttggaggaatcatccaaatctgagatgggcaagtcctccacaacaacaacagcctatccctaccttccagaatgttgttggtccaagcaagccatatgttcctcctccagcaaatgaccatccagaatatgcaatttcagcaagagacaagagccttcattcagaatctgacaaatcagatggggtagatggatactcagttgaaccaagctcagtcccaaaattctga

SEQ ID NO: 30681 - DNA, 114 bp, Glycine max
  Peptide Sequence Number=SeqID_122366
aaatgggcaccaaaggttgaagctttgtttagagcttcaatggagaatgaaggaggaaagaatggcaacgtgagggagagaggaaaggcttctgaaaaatgtggggctgagtga

SEQ ID NO: 30682 - DNA, 420 bp, Glycine max
  misc_feature (244)..(244): n is a, c, g, or t
  Peptide Sequence Number=SeqID_122367
atgaagggtgatgcacccgggccttcagtgagaagtattgcacgcctagacaggcgcagggtgatgcaccgcaggtcgcagaggcgccgccaccacgctcatcaggctgatccagctggggtcattggccatggagcggtatttacagcacttggttcgctagcaggcggccaaccacaaggggcagatcagttcagggctgaggttgcatggcccggagattggcatgaggcccaggcagggntggcgcccgcagaggctcccgacgatgcagaggaggcccgcatggatgaggagatgacagatttactcggtttcttgggatggagtggaccacgtgaccaggggatccccagattcctattctcttttatgtttcctcttttatctgttacatatcattttatttttataacttga

SEQ ID NO: 30683 - DNA, 600 bp, Glycine max
  Peptide Sequence Number=SeqID_122368
atggaagaaccatcaaagaagcgaaaaggttcttcaagtcgaagtcaacgacattccgacactcaagaaacacagattccctcctccatttcctcttcctcattgttctcatccgaagaacaacgaatacggtacacaaatcttttctcttctcgttccattattgatccaaagttcattgacatggatttcttttgcaatgagagttttgaatgcattcaggcatttgagaactccaatgttattcctttcatgtctttaaaattgcctgtttattctaaattagttaaagccttctattctaatcttgaaattcaagaaggcactttgatttctgaagtttatgggataaaaatggtcattgaccaatccctattctatgacttgacccaattatctagtgaaggtgtaccatttgaaggtacattgaatgatgattggaaatttgacttctctgtgggtgttgcccgctggttggtttgcaccaaccaagcggatatgaccggaaggcttcttgttggttcattgacttttgaaagccgcgtccttcattatctcattgtgcgtatcttgcttccaagatcttcaaaccttgcacag

SEQ ID NO: 30684 - DNA, 258 bp, Glycine max
  Peptide Sequence Number=SeqID_122369
atgcagtatctagaaagtgatcctaggtcgcctcccaacgagcaatgcccgggggatccactagttactagaaccgcggtggaaattcaccctatagagctcattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30685 - DNA, 486 bp, Glycine max
  Peptide Sequence Number=SeqID_122370
atggctaccccagttgtggttgtgggcgaaactgagggccctccaaagtgtttggcagaggtagacaaccaactgcttgcccctcagtggcatatccaaggtgaggttcgaagtcgactagattgtggtctcggggtgcttcatgtgtctcctccatgggttgagggacctgtgcctgatcatattggggttgttagctctcaaggggaacaagagtggcatggtcggcattctcgtctggcatatgtacgacattgggtggcatgtggttgggaggcaagccgtatggtgggaaggaatgcttgttctaaactcgcacaaaataggggccacccgtacttcctaacgcttcgtgatgtaagctccattggagcttgtaagcctaggatcttcttcatcaatggattcctttgcttcttggaagatgaatggcagtggaatggagaaggaagagagagaggagacgccacttcaaggagaagatga

SEQ ID NO: 30686 - DNA, 474 bp, Glycine max
  Peptide Sequence Number=SeqID_122371
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgcccccctgacgagcatcacaaaaatccgacgctcaagtcagag

SEQ ID NO: 30687 - DNA, 192 bp, Glycine max
  Peptide Sequence Number=SeqID_122372
atgaccataatttgtctccgcatgtcatcgggcccgccgcctctggatgacaaaagggcgcagaatgaccataatttgtctctgcgttccatcggacacaattgtgtctggaatggcaaaaagggtcaatatgacaaagattgtggggcggccgacaaaagcgaggctcttgctcctacgtatcctcaatga

SEQ ID NO: 30688 - DNA, 156 bp, Glycine max
  Peptide Sequence Number=SeqID_122373
atggacgaagataaatgggcatattacagtgcgatgtccgaagaagttgatatggattttcaaaatgaagaagattatggtgtgaatgaagcacatgttgattgttcagatgcttttaatacttctcaggtctttgaacccgagaagatgttttga

SEQ ID NO: 30689 - DNA, 1309 bp, Glycine max
  Peptide Sequence Number=SeqID_122374
agcgtagagcgagccgcgctcggctgctgtaagcgcagaggcagccgagcgtgggctcggctctacaggggcgcccgcgcgccgttggggccatgcccggcggccgcgcagcgcggcaacgcgttaccgtcagccctcttcgcgaacgatttcgaccaggcgtgggccgtagcggctcagcttggtaccaccgatgccgccgacccgggccagttcgtccaggctggtcgggcgctgttcggcgatgttgcgcagggtgctgtcgtggaagatcacgaaggccggcacgttctgttcgcgcgccagttcggcacgcaggccgcgcagggcgttgaacagggccagatcctgcggcagcaccgacaggccggtgcgctgtgtgctgcgctcgcgtccgctggtgctgctggccgggtcgcggcgcatgctgatctggcggcggccggtcagcacgtcgcggctggcatcggtcaggcgcaggccgccatggccctcgctatccacttccagcaggctggcggcgaccagctggcggaacacgctgcgccaggtgcgtgcatccaggtcgcggccgatcgcataggtgctcagcttgtcgtggccctgctgcttcaccttctcgttctcgctgccacgcaggacgtcgatcaggtgaccgacgccgaagcgctggccgctgcggtagacgcagctcaatgccttctgcgcgggaatggtggcatcccacgaagcgggcggggtcaggcagttgtcgcagttgccgcagggctgcggataggtctcgccgaaaccggccagcagcacctggcggcggcactgcatggattcgcagtagcccagcaggtgatcgagcttgccccgctccagctgcttgcgttcttcgccggcctcggactgctcgatcatctgcttgagcaggaccacgtcacccaggccgtagcacagccatgcttcagcggcttcgccatcacggccggcgcgaccggtttcctggtagtagccttccatcgacttgggcaggtcggtatgcgccacgaagcgcacgtccggcttgtcgatgcacatgccaaaggcgatggtggcgcacatcacgatgccatcctcgcgcaggaaacggcgctggttgttagcgcgcacttccagcggcagggcggcatggtatggcagggcgttgaagccttggccgcagaggaattcggcagtctcctcgaccttgcgccgcgacatgcagtagacgatgccggcctcgccacggtggccgcgcacgaaatcagacagctgcttgcgggcattgtccttctgcaccacg

SEQ ID NO: 30690 - DNA, 708 bp, Glycine max
  Peptide Sequence Number=SeqID_122375
atgaaagacaccgcccgcgtattaggccgcatgtatgacggcatcgaataccgcggctacgggcaggccatcgtcgaggagctgggcgagtatgcgggcgtgccggtgtggaacggcctgaccgacgaattccacccaacgcaaatcctcgctgacctgatgaccatgctggagcactcgccgggtaaaaccctgccggagctgagttttgcctatctcggcgacgcgcgaaacaacatgggcaactcgctgatggtcggcgctgccaaaatggggatggatatccgcctcgtcgcgccgaaatccttctggccggaagcgggtctggttgagcagtgccgcgccatcgccaaagagacgggggcgcgcatcaccctcaccgacgacgtggaaaagggcgtgcagggagcggatttcctctacaccgacgtgtgggtctctatgggcgagccgaaggaggcctgggccgagcgcgtcagcctgatgaagccgtatcagatcaacgcgcacgtcatgaaagccaccggcaacccgaacgtcaagtttatgcactgcctgccggcgttccacaacgagcacaccaaagtgggccgtgaaatcgagatggcctacggcctgaaggggctggaggtgacggaagaggtctttgaatcaccaaactccatcgtcttcgacgaagctgagaaccgcatgcacaccattaaagcg

SEQ ID NO: 30691 - DNA, 518 bp, Glycine max
  Peptide Sequence Number=SeqID_122376
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccggtgcgccttatccggttactatcgtcttgagtccaacccg

SEQ ID NO: 30692 - DNA, 671 bp, Glycine max
  Peptide Sequence Number=SeqID_122377
ggttagattggctctccaagttgaaagttatcaatgaggagaacttcgaagctccggaggaagatgaagaagtccaagctctaaaattagagctagggaaggcaagactcgccaaagaaaagttcaagttagccgctacaaacatccggaaagagtgcactgagttacgagaggaaaacatggccactgcaagagccctgcaacaacttgagctcaaggctccggagagaggaaaggagaccagtgacggatccaagaggagtttggctcaacacttggaagccacggagcaaagcatgctagctatcatagggcagtacaaggaagagttaaaccagtctgtgacccatgaacaaaagctagtagaggatttcacctttgacaagtgtacgctgaaaaggaagcaagagggaggcgcgatcaattggtttcctcattggaaggaaggcaaggaaggagttaccttctcgtgtggggactaccctaatgttccacttatagggactaggggttgtattaattataatcccacactcgccataagacagttagggtatcccatgaggggagcgccaaccgaagaaagtctctcgcctttccttgtgaggaatctaggtgcgcaaagtctcaaggcgatacaagagtccacaaggcgtggagaagtccgttga

SEQ ID NO: 30693 - DNA, 246 bp, Glycine max
  Peptide Sequence Number=SeqID_122378
atgaagatgaaagcaagcaaaacaagaaatgaattgaaagtctcggattcaaactcttaccggttgaagaacgaaaaacggaccaagaaaagtgaagaatggaggaaaatcttcacagatttgctcacggaaacatctcggaagcgttacggaagcacttcgactcgatttttcttcacggaaacgtggggaaaaagggagtgcccgttgccgcccagaggcttcttgacggcaagattaatctaa

SEQ ID NO: 30694 - DNA, 333 bp, Glycine max
  misc_feature (18)..(18): n is a, c, g, or t
  Peptide Sequence Number=SeqID_122379
agagaaaatcctctaagnacttcaatttgtatcatccactctaaaggagagaaatctttctgttcatctcagaagtccagttgcaatcaagagactagttgtctcttggattgtgagaatcttgaacacaagggtgagggatcccaagatagtggaaaatctcaagtgggttgcttgaggactggacataggcacgcaaagtggctgaaccttatgcaatcctaccctgcaagggcattggataaaagaatccaagaagattgggccaaagatgcaagagaagaccctaaggttctcatgagtcttagggtagatttcgggcacatgggctaa

SEQ ID NO: 30695 - DNA, 549 bp, Glycine max
  Peptide Sequence Number=SeqID_122380
atgaaagacataagtcaagatgaaaaagagaaaataagggaagaagaaagaaggaaaatactaaaagagttaagaaaagaaaaacatgcctcctatagcagtcatgactcttgcaagagactaagtgaagaacttcgtgactattacgaaggaaggcataggtcacatcttagacctcactcccataggagagaaaaggaaagaaagcctaatgaggctaacattaacctcccatacttccacgggaaggacaataaataccaaggtcaaggtatcttaggggtgacaccttctaagcccaaagacgataagggaaagacaatagaaaagcaaccccttaaggctaatatgcaagagaagactagctccataaagtgctttaaatgtcttggaagaggacacattacttctcaatgtcccaccaagaaaaccatgattatgaagggccaagacatttatattagccaagatgaggctactacttcaccttcctgtagtgaaagtgaagaagcaaaaagggaagaatctagtgaagaaatctacccctaa

SEQ ID NO: 30696 - DNA, 495 bp, Glycine max
  Peptide Sequence Number=SeqID_122381
atgcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggttccactgtagcggacattggcagatggtggtcatcctgcccaaggaacacttagttgtctgtgctatcaagggtcttgatgatgctccacagcctaaatcaaaggctcatgctaggtggattgtcgtcaagtgtaatagacaaaaaggaactactgagtgcagctactatgtcatgcactggatgtccaccatcattttaggaagttttagaaataattgggaagcgtattttaacgaccctagaccattggagcccgagagattaaaagcattgcggattcagtgggcacagttttatctccgagttagagatcaggcctag

SEQ ID NO: 30697 - DNA, 236 bp, Glycine max
  Peptide Sequence Number=SeqID_122382
ggatttcctgtctgttgtatctctcgttacaatctttcaaagaaatgaacgtggattcgaggcttttagtactcacgatcaccttgggctaccttctggagtgaagacaaaacatgaatggcagaaaccagtcaaggtacttaaggatgaacgcaagcggggatggggtcacgaccgaccgatcgttgctcttctctgtgcgaaacaagcagggaatgtcgctgcaaggcagcccc

SEQ ID NO: 30698 - DNA, 462 bp, Glycine max
  Peptide Sequence Number=SeqID_122383
atggaggtagattcactccacatgccagtgatggaaagtagatccaattttagaagaagtcccaagatgttgtacttggaatgtgatccaattccaaaagttgttgagaatgaggatgatttagatgatgtacctgttgctggccatgaggaaggtaagtttaaattcatctgtacttggtctgacatgatgttggtgccggagagcagagagatgctggtgagtagagggatgctggtgagaaaagggatggtggtgagcaaagggatactgatgctggtgagcaaagagatggtagtgagcagagggatgctgaagctgttgaagctgaagttgagacagatggttatcattcagaggagcttaatatccccattagtagtgatgatgaagatgaggatgttgaagtttatcctcaatatagtcaaagtagtggagttggtgtacagcagttggggttag

SEQ ID NO: 30699 - DNA, 204 bp, Glycine max
  Peptide Sequence Number=SeqID_122384
atgcggaagggaccactgaaagaaggaggaactgaagccattgatagtgttggaacactcagaacttatacgaaaaatgaggttacattaagcaaaaagggcaacagaaatgaagagaaagaaggaattctgaagcaggcccaacccaacagtggcgctaagcgcgcgtcaggcgctaagcgagcaaccaaatgcaggcgctaa

SEQ ID NO: 30700 - DNA, 71 bp, Glycine max
  Peptide Sequence Number=SeqID_122385
gaattcgcaaagatttcaaccgttcttcgacgttcttcattcgttcttcatcgttcttcgatcttcaacgg

SEQ ID NO: 30701 - DNA, 306 bp, Glycine max
  Peptide Sequence Number=SeqID_122386
atgattcgactcactgctacttcattggtacatccagaggtacccgcacgcacgcttcagcagcctgtggagtggatactacctacacctactccatatcgactagtggagccagtccaagtgatagaggacccagaggagtttactcctgagcctactgtggatgctcttgacttacctgaggatgatgaggacccacttcctgatgtggattctccagaggatatcatgtcagcatctgaggcagactctatagaggagagtggccctggagggacagcgaatagtgaagactcttcatcatag

SEQ ID NO: 30702 - DNA, 519 bp, Glycine max
  Peptide Sequence Number=SeqID_122387
atgcaaccccataaggcgagtatgcaagagaagactagctctataaagtgctttaaatatcttggaagaggacacattacttctcaatgccccaccaagaaaaccatgattatgaggggccaagacatttatagtagccaagatgaggctactacttcaccttcctctattgaaagtgaagaagcaaaaggggaagaatctaatgaagaaaactacccccaagaagaaatacaaccattaatggttaaggaggaacgtaaggtggtaagtgcctcctccaaaaggttagctaagaaggaaaatcattttacaataaagacaaacaatacagaaactttatctcttagaaaacctccacattttctcctttgtaaaaagacacttgttagcattgtcacacctcttgggcttgagtttattcctcaagtaaaggagttgttggatgagggtttggtttgcaagagcttaaatccttgtgcttttttggtgcccaaaataggtatcagatccctaaaatag

SEQ ID NO: 30703 - DNA, 231 bp, Glycine max
  Peptide Sequence Number=SeqID_122388
atggaagcagaatggagaaggaagagagagaggagacgccgcttcaaggagaagatgagtctagaagaagctcaccaccataggaggccatggataaaagcttggaggaagaaggagatgaatgaagggagaggaaaagaagagcacgaaattttgtgctctaaaagagatctgaaatctgaacccactaatccaagatcaattccaagattctccactaagtgtgcttag

SEQ ID NO: 30704 - DNA, 642 bp, Glycine max
  Peptide Sequence Number=SeqID_122389
atgagtgatctggtttacacatcttctgctccatccgcttccctcaaagactttgtggaaagcttttggatgttggataatcaatcagagaataaagaagttattcttttgcctgacggaaggatagatattatattgtcacagtcctccacaatgccttttcatattgttcttttaggcattggaacacatcctgaagaaattgtaattgctgaaaaatccagaacctttgcaattaagaaaatagcatctgaactttctctgcggaaaattgatgaacggaaacggaagctgtttgaccttatatactctgccaacggagatatttctgtgaaagaactttctgaaaaggtgatatggagtgaacggcagatcaaccgttattttaatcagcaatacgccattattggtggtggtcccggcgggcttactttggcaaatctcctgcagatcaacaaagctgaagttcaagtttatgagcgtgatgagcataaagatgtccgtgtacagggagcaactttggatctgcatgaagaatcaggactggaagctttaaaaagagccgggttaatggatgcttttatcgctcactaccgtccagatgcgggaaaattaaaaattttagacaaagggatcctctag

SEQ ID NO: 30705 - DNA, 330 bp, Glycine max
  Peptide Sequence Number=SeqID_122390
atgggtgaagtagtggagatacaagagaagatgaaggccgacatggaggccattaaagagaaaatggccacaatgatggaggccatgatgagcgtgaagaagttaatggaagccaatgcggttgcaattgccgctaccagcgttgttgctaaggtgaacccgacgtccccatccggcatcaatgaatcatccaacctcatatatgaaatgggaaagttggatcatctagaggaaaggctcagggccattgaaggaggtgaagattatgcctttgctaacctagaagagttgttcctagtacccaatatcatcatccctcccaagttcaaa

SEQ ID NO: 30706 - DNA, 762 bp, Glycine max
  Peptide Sequence Number=SeqID_122391
ccatacccgggagggtcttccagccaccctaccccaagtggtatgacccgggtgccaaatgtgagtaccatagtggagctcccggacacagcattgactcctgccgcccgttcaaaggaaggcccaaatgttaaaactaacccgctagctagtcatggaaaggctagcgtaaacgccatccaagagggtgggccatcgcgggcaaagaggttaggagaggtggctacttccagacgttttatctaccaatcgctgcaagcggcatgtatggtctcccgtggtggaggcgaaagggacaaatgtttgtttcacctcggggagtcgcacgacatggaaacctgtcccgcggtagaagaattgcttcagcggctcatggattgcgggcagcttgaagtgtccataggagggagggaagaaccacaaatttgcatgcagtcggaagagaagaaggttcctctaacccccaaggccctagtgatatgttttactaggaaagggaccggctccacacccatatacccccggacaatgcccaagccaacgtcatttgcatatcaaagtaataaggccattccgtggaagtatacccctcccgcattcagcgaaagagttgcaaccgaagttgactccctgtcatccaaggtgaccaacatcaccggcctcagtggcataaccggcagtggtcgggtgttcgcttccctcacccagcggagttgccctccaaggggaaagtgcccatggtccaagagcccacagacgtag

SEQ ID NO: 30707 - DNA, 447 bp, Glycine max
  Peptide Sequence Number=SeqID_122392
atggcagcgcagctgatccgtgatcgcgtcgtgatgaagtgcctagagggtgtttgggagaccctcgagggcaacgagaggtgccaattctgcggcacagttcgactcactactacatcgcttgtacatccggagcaacccacatgcacacttcatcaacctgtggagtggatactacctacgcctaccccatatcgactagttgagcccattcaattgatagaggtgtcatcctctgaagaggatcctgaaggggacccagaggagtcatctcctgaacctgctatggatgcccctgacttaccagaggatgatgaggacccacttcctaatgttgattctccagaggatattatgccagcacctgaggcagactctacagaggagagtggtcctggaaggatggagaatagcgacgactcttcatcacagcagacaactccttag

SEQ ID NO: 30708 - DNA, 349 bp, Glycine max
  Peptide Sequence Number=SeqID_122393
atgagacgatactacatgtcagcagatgtaaccttctttgaagacacacccttcttttcaccctccatagaccattcatcgtctctccaggaagttcttcctattccttatccttgtcctctagatgattcagaccaaaatgtcagtgttgttccatcttcctcacccacttcacctgaagttgtatcttcgcccctgattgcagatcaacccaggacaacgctgattggatttccagttcctgaagcttctcctcgtgattctcgttcatcttcaaccagtcctccactcatggacccttccacttcttctccttctgactcacattggcccattgccattaggaaag

SEQ ID NO: 30709 - DNA, 265 bp, Glycine max
  Peptide Sequence Number=SeqID_122394
gattctacaaggttgaaaagaaatctcaaggatcgcaggtcgcttggggactggatgtaggcacggagaaccaaataaaggtgtatgcagctaaaggcaataaaggaaggaaggagttggtgcttaatgaagggaattgggtcttggagaggatcaacaacattgcttataggctagacctcctagagaagtatggagttagcaacacctttaacattattgatttggttccttttgcaggtgtagctgattcagatgatgaggg

SEQ ID NO: 30710 - DNA, 636 bp, Glycine max
  Peptide Sequence Number=SeqID_122395
atgtttgagcctcgcactattttagattcaaatggctatccagtgtatcgtagaagaaataacggtcgtacaatttctaagaatggtgttattattgataatagatatatagtaccttacaatgcaaaattactgaggaaataccaagcacatataaatattgaatggtgtaatcaaagtacttccatcaaatatctatttaaatacataaacaaaggctatgacagagtcactgttgctgttgtttatgatgctaatgagacagttgacaatgctatcactaaaaatgatcagattaaagaatatctagattgcagatatatttgtccttgtaaagctaccttgggaatttttgcatttccaatacatgctagaaaacctgctgttgagagattatattttcatcttccaggccaacacaatattctttgtgaagatgatgatgacatagatggtatcctatctaagccaagcatttctgattcaaaattcttagcttggatgaataacaacaaattttttttggaaggtagaaatcttacttattcacaatttgtttccaaatttgtgtacaaccaaaaggctagatcatggaagctcagaaagaaagacaatacaattgggaggctaatatga

SEQ ID NO: 30711 - DNA, 477 bp, Glycine max
  Peptide Sequence Number=SeqID_122396
atgacgttgctgctcaacaacgtcctgcccagcgatcataactccgacctccctttgctgaagtgtcaactggtgtatgccatcctgacacggatgagcgtccatgtggctcaattgatcactgacgccatctatttatttgcaggtatgccacctaccaggcacccgctagacccggataagtctaacagggccttggggtttccagcattgatcacaggtctctgccagtcattcggggttcccgtcacacctagtaaggtgattcgaccgccaatcacccgggccttcattgagaagtattgcacgcctagacagacgcagggtgatgcaccgcaggccgcagacgcgccgccaccacctcatcaggctaatccagctgggtcatttggcatggagcgatatttacagtacttggttcgccagcaggcggccaaccacagggggcaggtgcagatacatgagtgtctctactag

SEQ ID NO: 30712 - DNA, 711 bp, Glycine max
  Peptide Sequence Number=SeqID_122397
atgtctcctttccttgtgagggatttcggcgcgcaaaatttcaaggctatacaaagaatccataaggcatgggaaaccccgttaaggaaagatcaagaacttaggggcattcgtaatggcgtcattggtgattggctcgccaagttaaaagtcgtcagcgaagagagttttgaagcaccggaagaggacgaagaagtccaagctctcaaaagcgagttaggaaaggcaaaactcgccaaggagaagttcaagttggccgctacacacatccggaaggagtgtgccggattacgggaagagaatgcaactaccgcaagagcccttgaacaagagaccaagagggctcgcaaggaagagtatggccgtaacaaatttcgcggagctctgtggggtagcaacagtgaactcaagttgcgaagggaagagagggaccagttgcgagcgcatagcatggtcttgaaagaggagtatgcccaagtatacgcggaaaaagaggctagaggaagggtgatcgactctttacaccaagaggcaaccatgtggatggatcgatttgctcttgccttgaacgagagtcaagaacttccccgattgttagccaaggccaaggcgatggcggacacctactccgcccccgaagaaattcatgggcttctcggctattgtcagcatatgatagacttaatgacccacataattagaaatcgctag

SEQ ID NO: 30713 - DNA, 567 bp, Glycine max
  Peptide Sequence Number=SeqID_122398
atgatcattgatcagtcattgttcttttctttaactcatttacccagtcaaggtgcaccttttgagggcaccattgttgatgactggaaatttgattattctagtcatgatgctcgccgtatggtctgcaatgacgaggttgaaatgaccagcattacaggccaatgcacctctcccttaccctcaattgataacttctttctgcgtcattttcaaatttcacttgatgatgaaccatttgttcaagtcaagcgttcctttgcaattggtgctggtgcagtgacttcctttggataccgtaaggatcggaatggtcaatggctgaagaaagacgcactccctcctcaagatgagcgtactccttcacctcctcctcagcgagatgattcagcactcatgactgaagttctttccgaattacgggatcttcgttcttatgttggtgaatgtttcgactcattggatacatgttttgccggcatggatattcgcctcacacaacatgaagaggatgtgggttacattcgtcagagtttcgctcttccaccaccacctctaccttcttaa

SEQ ID NO: 30714 - DNA, 237 bp, Glycine max
  Peptide Sequence Number=SeqID_122399
atgagtaagataggaaggtttggaggtttgggaatggaggaacgtcgcaagggagaagaggttgagcaggggtttctgaaaaacgtgatatttatagaccaggacgcattatggaggcagcctactggtaatcaattacatgaagactgtaatcgattacaggccatctgttctagtgtaatcgattacagtattcatgtaatcgattaccagaacaaaataatagccttttcctaa

SEQ ID NO: 30715 - DNA, 170 bp, Glycine max
  Peptide Sequence Number=SeqID_122400
gagaagccaagaggtggctccactcatttaagggtaacagtctgaaaacctgggaagaagttgttgaaaacgttggagaggtgtcataccctaatttcgtccggggatctttgctcgatgacgtgcgaccattctttggtcctcgtgaggtgcttggcacccatcattag

SEQ ID NO: 30716 - DNA, 387 bp, Glycine max
  Peptide Sequence Number=SeqID_122401
atggctccgagaaagctttccgcgaaaagatctaggagggacgccgcggttgaagggaccagtgccgcccccgagtttgataaccaccgttttaggagcgccgagcaccagcagcgtttcgaggccatcaaaggatggtcgttccaccaagagagacgcatccagctcagggacaatgagtacatcgactttcaggaagagatagctctccggcgctggatgtcgctggtcactcccatggctaagtttgacccagatatagtcctagaattttatgctaatgcttggcccacagaagagggagtgcgggacatgcgatcatgggtgaggggtcagtggattccctttgatgcagacgccctcagccaattcctaggtgacgcgctg

SEQ ID NO: 30717 - DNA, 228 bp, Glycine max
  Peptide Sequence Number=SeqID_122402
atgcacgaaacacaatgtggaccactacgggtacatagaatgaatcgaaaagcttggttcgagcaaaataggggagatgcttgccgcccagctcgcccaggcgagcagggttgcttcctccagaagcaaccgccttctggaggaaccttctggagggcccaaatgggcctgggtgctatttgcacccccatttttactaagttcaccccctctactgttttttggtga

SEQ ID NO: 30718 - DNA, 84 bp, Glycine max
  Peptide Sequence Number=SeqID_122403
atggcctctcgccctgatagacacataaaggcgcacgagtggggtggtggtgatcctatctcttcagtaaagatatctttttaa

SEQ ID NO: 30719 - DNA, 1053 bp, Glycine max
  Peptide Sequence Number=SeqID_122404
atggctgatttaggttcagcctcttccaagagaatgtggtgttccgttccagaaagaatgcagcttcacttggccatgttggccttgcagtttggctatgctggattccatgttgtctcaagagctgcacttaacatgggcgttagcaagcttgttttcccagtctatcggaacatcattgccttgcttctgctccttccctttgcctacttcttggaaaagaaggataggccagccatgactttaaacttcgtctgccagttctttcttctggcacttgtcggaatagagcaagtgagattgaaccgaaaagatgggttgggtaaggtggcgggaacagtgctatgtgtggttggagccaccgtgatcacactatacaaaggtccaacaatatatagcccaacaactggtgtgaacataaacaacacaagagtgacacaagtgtttgaattggggtcagtgtcactgggagatgcaaaggggaagaactggaccctagggtgcttatacctcattggacactgcttgtcgtggtctggttggcttgtgttgcaagcaccggttctcaagaagtacccggctcgcctctctgtcacttcctacacctgtttctttggactcttgcagtttctcgtcattgctttgctccttgaaagagacgcgcaggcatggcttttccactctggtggagaagctttcactattttatacgcgggagtggtggcatctggaattgccttcgctgtacaaatatggtgcattgacagaggtggtcctgtgtttgttgccgtctatcaacctgttcagacttttgttgtcgccatcatggcttccattgctttaggagaagagttttacttgggcgggatcattggtgccgtgttgattgtagcgggactgtaccttgtcttgtggggtaagagtgaagagaggaagtttgcaagggagcagcttgcgattgcatccactgagcatagcatcataaggcccgcaagccacgccaaagcatcacttgctcagccactcctttcttcatcaacagagaatgtttga

SEQ ID NO: 30720 - DNA, 279 bp, Glycine max
  Peptide Sequence Number=SeqID_122405
atggccattgccggcttctgccccttcttctccgccttttgctacactgagtttgtcgtcgacatgcccgtcgccggcggtgccttcagctacctacgcgtcacctttggcttgacggtgtacctaggcaccacaatcagaatctcctccgccaaatggcgcctcacggtgtcgtctcttcccaaaggcttcaaggaaatagacttcgtcgctgtcgccgtcattttgctcatcactctcatcatctgctacaagtgctttccacagttcttacaatga

SEQ ID NO: 30721 - DNA, 222 bp, Glycine max
  Peptide Sequence Number=SeqID_122406
atggtgcggataaccgtaagggtcagtactgacaaagattatggggcggccctggacaaaagcaaggctcttgcggataaccgtgcggataaccgtaaggtgtctccgcgggttaccagctcttgggtcatggcaacaaaaagcggtgcggtcgacaaaagcgaggctcttgctcctacgtatcccccaatgaggaactcagacctacgtagttctggataa

SEQ ID NO: 30722 - DNA, 1355 bp, Glycine max
  Peptide Sequence Number=SeqID_122407
gtcatgggcggcgtgccgatgaagcgcgccgcgaattcgctggccggacgggcatacaggccgtcgggcgtgtcgtgctgttcgatctggccgccgcgcagcagcaccacctggtcggccatgctcatggcctcggtctggtcgtgcgtgacgtacaccatggtgatgcccaggtcctgctgcaaggcgcggatctcgcgccgcatctcttggcgaagctgcgcgtccaggttggacagcggctcgtccatcaggcacaccggcgcttcggaaattaccgcgcggcccagcgccacgcgctgctgctggccgcccgacagttgcaacggcttgcggtccagcagatggcccaggcccagcagcgaagccacgcgttgcaggcggcggtcgtagtcgcgcgcgggctccttgcgcaccttcaggccgaacaggatgttctcgcgcaccgacaggtgcgggaacagcgcgtacgactggaacaccatggaaatgcggcgcttggccggcggcaattgggtgacgtcgcggtcgccgatgcggatggtgccggacgtgggcgtgtccaggccggcgatcatgcgcagcgtggtcgatttgccgcaacccgatgggcccagcagcacggtgaagctgcccgccggcacggtgaagctgacgccgtggatcgcggccgcgccgccgtattgcttggcgaagggatatggcccggggtattccccaatcacggcgtggtgcgtgaccagcgcgccgtcgtgccaccagtgcaactggtagcccggcggctccatgatgtattgcagggtcgggcgcggccccagctccagcgccagctggtgcgcggtgcccggacaggtcgaggcaatggtgccgccgaagcggcggaagatggtgcggtgcaggtggccgcacagcacgcgctcgacgcgcggatagcgcgccacgatgctttcaagttccgggccgccggccagcaggccgatgtcgtccatgtgctcgatgccggtctggaatggcggatgatgcatcagcaccagcgtcggccggtcgggctgttcggccaggcgcgcggccagccagcccaggcgttcgtcgcacagctcgccgtggcttttcatcggcaccaccgtgtccagcgccagcaggcgcagcggataggtttcgacggcatactggatgaacggcccctgtccttgcagatagccatggtccgggaaggcggcgcgcaattgcgcgcggtcgtcatggttgccgggcagcaggaaataagggatttcaagcgcctgcaactgctcgcgcagcgcctggtattcatgcggacggcccaggtcggtcaggtcgcccgtgatcagcacgca

SEQ ID NO: 30723 - DNA, 114 bp, Glycine max
  Peptide Sequence Number=SeqID_122408
atgttccttgtattcaacagtgctttgaaaggactggacgatactccacaacctaaatccaaggctggtgctaggtggattgttgttaaagaattaatgaaacattgggcttaa

SEQ ID NO: 30724 - DNA, 322 bp, Glycine max
  Peptide Sequence Number=SeqID_122409
atgggaactgctacattctttgaggatattgagtttggggggaagaataaggttagagactttgtcttagaggaagaatcagtaacaattccagaaccgattcatacaattgcttttgataaagcaaatttggaacctctacaagacattgttattgaatctcccactcaagataatttggtcattcacgaaaaacaaactcaagatcctcaagaacctatacttcatgagccaatacctttacagagattcacaagagaaagaagaagtgctattccagatgattatatggtatttctcaaggaacatgaggaaaattatg

SEQ ID NO: 30725 - DNA, 630 bp, Glycine max
  Peptide Sequence Number=SeqID_122410
atgatgatgattggaaatttgatcggaaggctgcttggcggttcattggctcttgaaagccgcatccttcattatctaattgttcgtatcctaatccctagatcttcaaaccttgtgcaggtttctgaagaagatctaatagtcatgtgggcctttcatactggccgacaaattgattgggcagatctagtccagtatcgcatgcataaggcattgctattaaatactcctttaccctatccacacttagttacttttttccttcaacattttaacatccctcttgattctgaaccatatgttccaatcaaaagatctttcttgatcggtgctgctgtggttgcatcctttggttaccgcaaagagcgtgatggctcttgggtaaaaaaaggtgctcaaccaaatgatgatgaaggacacttaccggttgaaggggactcttctctccttcagagtattttggacaggtttaatggacttcaaacctatgttggtgagaggtttgactccttggaacttcaagtggacacacgatttgaggagatgaactcaaggattgcaaaggttgaaaaagatgttaccatcattcgtgactgccttgatttacctccaccaccaccatcaatttag

SEQ ID NO: 30726 - DNA, 837 bp, Glycine max
  Peptide Sequence Number=SeqID_122411
atggaactgcttgaagaacatcgctgttacgagggtcggcagcagcgctggcgtcatcactccagtaccctgaactgtgcgatgacgttcagcatttttttaccgccgacgacggaaaccgccccgccgccggtgctgtactggctatccggtttgacctgcaatgacgaaaacttcaccaccaaggctggcgcccagcgtgtcgccgccgaacttggcatcgcgctggtgatgcccgacaccagcccgcgcggtgatgacgtcgccgatgatgccggttacgatctcggtaaaggcgcgggtttttacctcaacgccactcaggcgccgtgggcggcgcattttcgcatgtacgactacctgcgcgatgagctaccgcagttgattaaccgtcaatttaaggtcgccgaccgttgcgctatcagcggccactcgatgggcggccacggcgcgctcatcatggcgctgaaaaacccagggcgctttaccagcgtctcggccttcgcgccgatcgttaacccatgcaaagttccatggggacaaaaagcgttcagcgcctatctcggcaatgatgaagcgaactggcaggagtgggacagctgcgcactcatgcagacaagccaggccggggatgccattgccacattaattgatcaaggtgacgccgaccagtttctcggtacccagttgcagcccgcggtccttgcagaggcggcgcgacagaaacagtggccgctgagcctgcgtatccagcccggctacgaccacagctactatttcatcgccacctttatagaagatcatctgcgcttccacgcggagcatctgtttaagtaa

SEQ ID NO: 30727 - DNA, 606 bp, Glycine max
  Peptide Sequence Number=SeqID_122412
atgattatgaggggccaagacatttatagtagccaagatgaggctactacttcaccttcctctagtgaaagtgaagaagcaaaagggaaagaatctagtgaagaaatctaccccccaaaagaaggacaacctttaatggttaaggaggagtgtaaggagataagtgtctccttcaagaggttagctaagaaggaaagtcattttgcaataaagaaaaaaattaaagaaacttcccctcttagacaacctccacatcttctcctttgtaaaaagacacttgttagcattgccacacctcttgggcttgaggtttttactcaagtaaataagttgttggataagggtttggtttataagagcttaaatccttgtgctttgttggtgcccaaaataggtattattaggcaccaaatccctataataagtgatatgatgaatgtgttgagtgtgacaacccttttttgtaaaatcactcatgcacccaacatcttcatgattcaagtacatagggactcattaggtaggaataatcaacatgaaaatacagaaaaagtgatcaagggatttccacggaccctaaccctgtgtttggatggagaaatttag

SEQ ID NO: 30728 - DNA, 553 bp, Glycine max
  Peptide Sequence Number=SeqID_122413
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatcatctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccccaaaaccgacgggggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30729 - DNA, 555 bp, Glycine max
  Peptide Sequence Number=SeqID_122414
atggcccgagttatgttggggaacggttatgaacccgggatgggtttaggcaaagacaatggcggcataactagtctgataaaaacccaagggaatcgtgggaagtatggtttaggatataagcccactcaggcggacatgaaaagaagcatcgcgggaaggaagaacagtggtctgagctcgcgttggaaacaagaaagtgaaggaaacccgccctgccacataagtagaagctttataagtgcaggtctgggagacgaaggtcaagtggtcgcgatatgtgaagatgatgttccaagaactctggatttggtccgaccatgccctcctgatttccagctgggaaattggcgagtggaggaacgccccggcatttacgcaacgagcataatattcgatgacgagtcccccgaaggtactaatacctgggacccgtctatcaacttcgagcaagaaatgaatcaaacggaagatgaaggaatgaggatgtgggacttcctttcggagctagaaagatggtcgcccaagagactaagaaatggggcctcatcatga

SEQ ID NO: 30730 - DNA, 549 bp, Glycine max
  Peptide Sequence Number=SeqID_122415
atgctggatgaaaacaatgctcatgcaaaaagttttaggatggcaagggatagattgatagacactgaagtgcataatgtcagactcaaattgattgctggtcgagaaaaagatggtcgtacatataatgtaccaagtgttccagaagttgctgcactcattgcaggtgatattgatgcaaattcaaacaaagatattattgttaaaactcaaaatggtcaattacaaaggatacatgaattacattgtagttatctagctctacaatatcctctattgtttccttatggagaagatggatataggtctgacattgtacatcgtgatacattaagtgggaaaaaaagaaaaagaaatcgtcttacaatgagagagtggtttgcttatagactgcaatgcagacccaatgaaggtcaaactctgctgcattctacaaaactattccaacaatttgttgctgaaggatacacaatgattgaatccgaaagactttcctatgttagaaacaaccaaaagaaacttagagttgacaagttctatagcttgtag

SEQ ID NO: 30731 - DNA, 138 bp, Glycine max
  Peptide Sequence Number=SeqID_122416
atggccaaatacaaggcctcaaaagaagggaagaacaagttctttttacaaaggagaaaatggaggtctcaagaagggagcacttactccttctcctccttaaccattggaaaggttgatccttcttcttgggggtag

SEQ ID NO: 30732 - DNA, 203 bp, Glycine max
  Peptide Sequence Number=SeqID_122417
atgtacaattatcatgagaaaggaagaactcctgatcttgaaagtgtattggcagacttcatgacataccaagctagctctaaaggtgattgctattcaatgcaacaacagattatcaatgggagtcagaatggaaaccttattatcacaatgaagcagaagggattgtctaatctggatgacctggttaatgcaattcaaag

SEQ ID NO: 30733 - DNA, 256 bp, Glycine max
  Peptide Sequence Number=SeqID_122418
ggttgtcatcaacaaaaagggggacattgtggaagcaatgccttccaaggttattttgatgatgccaaagaatcaagagttaagcaaagtttcaagcaaagattcaagaatcaagtttcaagtttcaagattcaagattcaagaatcaagtttcaagaatcaagtttcaagaatcaagaataaccaagatcaagatttgagactcaagactcaagattcaagaatcaagagaagactcaatcaagataagtattaa

SEQ ID NO: 30734 - DNA, 306 bp, Glycine max
  Peptide Sequence Number=SeqID_122419
atgtcgagtatgacagatcttgtgagcgcggaagatgacgtaaatctccgcgtgtcaacgggcttgtcggctgcgattgatgaagggcgcagaaaacgaccaaaaaagaatgtttatacggataaccactcgggtatttccgcgcgtcaccgtggctcaaatacaacaaaaaagaatgtttatacggataaccactcgggtatttccgcccgtcagcatgactcaaatgtgagtatcacagatcttgtgagcgcgaaagatgacgtaaatgtccgcgtgtcaaacgtgcttgtcggccacgattga

SEQ ID NO: 30735 - DNA, 483 bp, Glycine max
  Peptide Sequence Number=SeqID_122420
atgtctagtgatgttttacctcttgagattgattttatagagtcagatagaactaaccatgtttcaggaagtacacatacctctgactttgtttatgagcaaaagttttccagtaattatatctgcgtaagaaggcttgtcgcaacatgcccatttgggggcgagcgtaagaaggctataggctggatcctggcagacattcctagtattagcccatccacatatatgcatcagataaatttagaagatggggcttgtcgcaacatgcccatttgggggcgagcgaggcggggctcacgggtgcatttttcaaaggaggaaagatgcgcggagtcgccaccaacatttatttgtggaaaacgtcagaaaaaccaaaggaaaccggtcaaaaagaaaattccaagttcgggagttgtatttacgtttgaggaaggtattagcacctcttacgtttgtctcaaaggacaacaacctattttttag

SEQ ID NO: 30736 - DNA, 402 bp, Glycine max
  Peptide Sequence Number=SeqID_122421
atgaagactgtcccaggggctaaggttgagaacaataagttttgcttgtccttgcactttcgttgtgttgacaaaaagagttgggcagcattggtggagaaagttagattggtgcttaatgagaatccacaacttaggctaacccaagggagaaaagtgctagagatccgtccaaccatcaaatgggacaagggcaaggctcatgaatttttgttagaatcattagggtacaagaatttgaatgatgttgcaagttggaggagtgcaactttttatactggacctcctgtaataaagtgggctactagaagtcttatgtttgctacaggatcatctgagttgtcattctgggttcctgatttgtctaagttgggatcctatgttgttgacaaaggactttga

SEQ ID NO: 30737 - DNA, 870 bp, Glycine max
  Peptide Sequence Number=SeqID_122422
atgaccggtagattgctggccggatcattaacctttgattgtcgcatcatgcactatattattgttagaattttgcttccccgttcttcaaatttggctcaagcctctgaggaggacttgattttgatatgggcttttcttaccggtcgtcagatcgagtgggctcacttggttaggtaccgaatgcataaggcattacgggccaatgcacctcttccttatcctcaactggtcaccctatttctccttcattttcaaattcctcttgatgatgaaccttttgttcaagtcaagcgatcctttgctattggtgctggtgttgtaacttcatttggttaccgtaaagatcgtgatggtcaatggctgaagaaggacacgctacctcaacaagacgagcgtactccttctcattctcctcaacgagatgattcctcagcccttatgaatgaagttctttcagagttacggggcctccgcacatatgttggtgaacgattcgattccttggatggtcgctttgaaggcatggatacccgcatcacccagcttgaagaagatgtgacttatcttcgtcggagtttaaattgtcatcatcaaaaagggggagaatgtagaagcaaagaatttgactttgatgttttgatgatgccatatgatcgtgatgatttgatggcttatgaaaatgtgcttctcaagtttaattcaagacaaaaattcaagaatacaagatacaacatcagaaagatctctagtgttttaggaagggaattccaaattgaaactgcaaaaggtttggccaagaaatttaagcaaaaatgtctttttcaagagatttactctctggtaatcgattaccagtggccgaaatga

SEQ ID NO: 30738 - DNA, 455 bp, Glycine max
  Peptide Sequence Number=SeqID_122423
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaaattgcaactgtggtcaaggatgcagcaagaggtttggaccgcataaaacagactcggaacggcatagcgggcctaccacagaagtacctagaagacaaggcgaggggtatggccaatcaaggaggctgggtcccgtttatggatgtgttagctttgctaatttttggggtcgtcctctttccaaacgtggatggtttggtagacctagcagcaatcgacgctttccttgcctaccaccatagcaaggagagtccggtggtagctgtcttggcagatctatttgacacatttgaccgaag

SEQ ID NO: 30739 - DNA, 334 bp, Glycine max
  Peptide Sequence Number=SeqID_122424
aacttgtaaaaggaatttacaagatagtggaactctcaagcgggttgcttggggactggacgtaggcacaaggatatctgaggccacttgtgatgcaagctccattggagcttgtaggcctaggatcttcttcatcaatggattcctttgcttcttggaagatgaatggcagtggaatggagaatgggagagagagaggagacgccacttcaaggagaagatgagtctagaagaagctcaccaccataggaggccatggataagagcttggaggaagaaggagatgaatgaagggagagggagagaagagcacgaaattttgtgctccaaatga

SEQ ID NO: 30740 - DNA, 330 bp, Glycine max
  Peptide Sequence Number=SeqID_122425
atgtgtgttcaagaagaagaaaggcatgtaatggagatggctaatattaagaaggtggcaaagtatttcttttgcaagaagaagggatacatgaagaagaattgccccatattccaaaaatggcttgagaagaaagacacattgtttgagttattttataattctaaatgtgttgggaatggtatcttgtctggtggtctttatcttcttggtttacaaaattatgccacttatagttcaatgcatgttcaaattggtattaaaagattaggacatacctccattgagaggattaaagggttagtgaaagatggggtacccaatacttag

SEQ ID NO: 30741 - DNA, 165 bp, Glycine max
  Peptide Sequence Number=SeqID_122426
atgaagaaagagtatcccaagtatgccgcatggcgtgtgaagaaagggttacctgtggagccgaccgccaaatgtaaaaaagggaggtacaacaagcaaaaaggggacagaaataaagaaaagaagaagaaaatcagaagaagcccaagtccagtaaggcgttaa

SEQ ID NO: 30742 - DNA, 378 bp, Glycine max
  Peptide Sequence Number=SeqID_122427
atggatccttttccctcggttactaaggtttttgccttaattgttcaagaagaaaagcaaaaagaggttgatgcatccacgtctggaacttctgctagtgaggtttcacatgcttttgcattcaagtactcttctaatgcaataaataattctaacaatctttccaaagactcttccaagaaccaccccttgtatgctcattgtggtatgttgggtcatactcatgattgttgtttcaagttgcatggatatcctctaaattataagaagaatggatattcctcagtggtcaagaagcaatcttcttcctcctctgaaccatctcacaaggctcagtgcgagattggcgctaagctcatattcacttacttgtgctaa

SEQ ID NO: 30743 - DNA, 405 bp, Glycine max
  Peptide Sequence Number=SeqID_122428
atggaaaacgccagcacgcgccttttacggttcctggccttttgctggccttttgctcacatgttcttcctgcgttatcccctgattctgtggataaccgtattaccgcctttgagtgagctgataccgctcgccgcagccgaacgaccgagcgcagcgagaaacagctatgaccatgattacgaattcgagctcggtacccctccgacacgaatcatagcctcgacggcgagggaggagcacggagcgacgccgtccagcttatcatcaccatcgcgcccaagagagagagagagagagaggcgcgaaaatgagcggagcgaaggggaagaagaagggggatcctctagagtcgacctgcaggcatgcaagcttggcactggccgtcgttttacaacgtcgtga

SEQ ID NO: 30744 - DNA, 484 bp, Glycine max
  Peptide Sequence Number=SeqID_122429
gattggagctgcaaactgggtacccaccaatcatacttccactgttgccacagaatcatttgttgtcaaattacccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcttcaggacacatgcaaggtgctggaagcaacaaagccaccacagagaagaagatggagctggaacggctgatcaaaaggctctcagaaagtggcattgatgatggtgaagcgactgaggaagaagaagaagcagctgagcaagaagatgaagcagctgaggaagaggtagaagctgctgaggaagaggaagatgcagcagaggatactgaatcagatgaagattctgaagccaccccatga

SEQ ID NO: 30745 - DNA, 168 bp, Glycine max
  Peptide Sequence Number=SeqID_122430
atgactggtatattcttccttttgaaacagcaaaataatttagagaattatgagcgatcaatgaaattggaatggagaaggaggaaaggtgattggagacgccacttcaaggagaagatgagtcaagaacaagctcaccaccataggaagccatggataagagcttga

SEQ ID NO: 30746 - DNA, 284 bp, Glycine max
  Peptide Sequence Number=SeqID_122431
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttttagagaattggggatggcaatttggtaaaggtttgggtggacaggtggatccgaaatactga

SEQ ID NO: 30747 - DNA, 755 bp, Glycine max
  Peptide Sequence Number=SeqID_122432
atgatcgccgcgcaaggcgatacgcggattgccgccaacgctttgcgtagcgcgcaaaacagtacgctcgccgccggattaaatagcgatggttctaccgccagcagcggcgcgctgacgctgaatagccagagctcgctggcgctgaatggccgcaatatggcggcaggaacgctgacggcgcagggcaggacggtggatcttgataacagtcgaacctcgggggcgcggatcgtggtcagcgccgcgtccggcgatatcaccacccgagatgcggtggtggcggccagcgaaaaactccagttggccaccagcggcaaactcaacaaccacagtggcctgttgacggccagccagcttgagctgaaagcaatggcgctggataaccaacagggcgtaatccagcagatgggcgaggacgatctacgccttgattttcgtgcgggattggataaccgcggcggtgagattgccagcaacagccatgctttgacgctcagcaccagccagttgctcaatcaaaacggaacgctgctgcataccggcagcggcggcatgtctattaccagcgaaggcgcgctggacaatggcgaaggcactattgccgctaacggcaatatcgttttgcactccgataacattaataatcccagcggtaaaatcagcacgacgcagggcaatgctcagctcactacgcgtcacgagctggaaaattcgcaaggaatatcgttgctggcggcagcctttctctacaa

SEQ ID NO: 30748 - DNA, 435 bp, Glycine max
  Peptide Sequence Number=SeqID_122433
atgacggtgaaaacctgtgacacatgcagctcccggagacggtcacagcttgtctcgggtgttgccgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggctagagttgtacttctatgcgcaggtttcttaaagaagttccctgctagcttatga

SEQ ID NO: 30749 - DNA, 542 bp, Glycine max
  Peptide Sequence Number=SeqID_122434
gttcggaacaggagagcgcacgagggagcttccagggggaaacgcctggtatctttatagtcctgtcgggtttcgccacctctgacttgagcgtcgatttttgtgatgctcgtcagggggtcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccatgtttgacggaccaattgatgtcttaatgcgaattggggatcctctagagtcgacctgcaggcgtgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30750 - DNA, 411 bp, Glycine max
  Peptide Sequence Number=SeqID_122435
atgtcgggtcaggattttgcccagaccgctactgggagacgggtgcggatcatgcgcaccagcatgactaccttgacccagacgtggatgacgatgctgctcagcaacatcctgcccagcgatcataactccgaccttcctctacggaagtgtcagctggtgtatgccatcctgacacggatgagcatccatgtggctcagttgatcgctgacgtcatttatttatttgcaggtatgccacctatcaggcaccctttagacccagataagtctaacagggccctggggtttccattgttgatcacgggtctctgccagttgtttggggttcccgtcacacctagcaaggtgattcgaccgccgatcacccgggccttcattgagaagtattgcacgcctagacaggcgtag

SEQ ID NO: 30751 - DNA, 216 bp, Glycine max
  Peptide Sequence Number=SeqID_122436
atggcgagtttttctaatattcaatgtgatgttcccaaattcaaaggagataactataagatatggaaagagagaattcttctgcaattggggtggatggacatagactatgctataaggaaagacaaatcacctgcaatcacggatgaaagtagcccaactgatgttgcgctatatgagcggtgggagccaatggctcagcgtgatgttcattaa

SEQ ID NO: 30752 - DNA, 282 bp, Glycine max
  Peptide Sequence Number=SeqID_122437
atgcatgatttacatcatcacatcatctctcctacagaggcacaggaggtagccgcctatgctgaatccaaagccgcagaccctcttctatggaagcgtctcgatgccgcgatgcttcaatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30753 - DNA, 554 bp, Glycine max
  Peptide Sequence Number=SeqID_122438
atggataaaggccaaattgaagtctgcagtgcaagaaaatgggagggggatgtgtgcatgttgtcaaatgataagaaaccaaataagcccaaggctttggtgatccacttcactaaggatgtcgccactcagaggccccgagggctcgacggaaggaaagatgcgttcatcgtatttgttaaagatgatctatcctccgctaaagtcacaaacatatctggtacgagtggcatgactcgtagtgggcggatcttcgtagcacccgaactgtcgatgcagtccaaagacctaaaaaggaaagcaaaggcggattcaatcgttgatcagtataaagagaagctaaacctagctgctagccatgagcaaaggctagaggatgagtatgcaaaagtattgactatgcaagcgcaatgggaagcaagagagttcactttcactctgaatgagagtcaagagcttccaaggctgttagctagagccaaggcaatggtggacgtatactcagctcccgaggaagttcatgggcttttcgattattgtcagcatatgatcaa

SEQ ID NO: 30754 - DNA, 288 bp, Glycine max
  Peptide Sequence Number=SeqID_122439
aaatccattgatgaagaagatcctaggcctacaagctccaatggagcttacatcaactatgaacaggatgagcccttgcttagcacgtgtgtcccactcttctattgcattaactaccgagcctccatgactggttgcattggggttgtaccatcgagggaagggagactagtagatcttctcggggttcactacagccatctgggtgaattctacaggcttctttgttggaaaattccttctcgtattggtgcttgtgttgggattggtgttgccgacgggacgtga

SEQ ID NO: 30755 - DNA, 108 bp, Glycine max
  Peptide Sequence Number=SeqID_122440
atggctaagtttgacccgaatatagtcctagagttttacgctaatgcttggcccacggaggagggcgtgcgggacatgcggtcatggagaaagaagaaagagagatga

SEQ ID NO: 30756 - DNA, 330 bp, Glycine max
  Peptide Sequence Number=SeqID_122441
atgctgacatctccggaaagggtgcagatgaccacattggcctctgcttgtcaatcgaacttggggtctccgaatgacgaggtgcagataaccggaaggtgtctccgcatgctaccggactcttgggtcatgatagcaaaaggtggggtggtcgacaaaagcggggcttttgctcctacgtatcctccatttgtgacgaggaactcagacctacgtagttctttcctttgtgagactaaaatagtcgcggtgtttttttcactaaaatgcgaacatgctttagtaaagaaacaaaacctcaaactgatcagagcaacatatgatttttga

SEQ ID NO: 30757 - DNA, 225 bp, Glycine max
  Peptide Sequence Number=SeqID_122442
atgattggtattgtatatcaggaggatatggaaaaaggccgaaccccttcagcagagagcattgatgccagtgatgaccttgagtgtcatggtaagctttgtatcagatatcctttgccttctgtgagaatacaaggattaccgggcgcagatggagggagattattcctaattcgatatgtacgacgtatggaggtatcttctatgggaatgattctcgaataa

SEQ ID NO: 30758 - DNA, 591 bp, Glycine max
  Peptide Sequence Number=SeqID_122443
atgggtgatcaagaggagacacaggaacagatgaaagccgacatgtcggctctgaaagaacaaatggcctccatgatggaggccatgttaggaatgaggcagctcatggaggaaaaaacgcggccaccgctgccgctgtcagttcggctgccgaagcagacccactctcttggcaactacgcaccatcctccctcaggcattcggcttacccttatggattgccgcccaactactcaccacccgtcttgcaagacgatgcgggccacattgcttctcccatccttgaaagagagcctcctcaacagcccgatgaggtccacaaagaccctcaagactatgctcgaagggatgtccagttgtatcccccaatccccgaagggccggcacccagcacgttgcctcaacccaacatcgcgacacaaccaatagttttgtccacggaaggaccgcccccggcaactgaagaaaagaggaagcttgatctcctcgaggaaagattgagagccgtggaaggatttggggattatccgttcgcagacatgacgtatctttgcttagtacccgatgttgttattcccccgaagttctaa

SEQ ID NO: 30759 - DNA, 342 bp, Glycine max
  Peptide Sequence Number=SeqID_122444
atggcttctccacctagctcgcctcctcctcctcctccttctccttcagacacatcagtttcaccgtctgccgtgaagcggacacgtaaagccacacatctacgatccttgtctactagaccacctggtgctgagagaccagtggtggacgtcacgtacgagaactggaaggaggtccctactgctcagaaggacttgatttgggaggatattcaggtggaatttgaaatcccagaggcttctgatgataggacaaaaaagaagttacttcacactatcggcgagagatggaggcagtttaaatcagacctcataaggaaatgggccctgcagccgatcagg

SEQ ID NO: 30760 - DNA, 141 bp, Glycine max
  Peptide Sequence Number=SeqID_122445
atggaaaaccattatgaaatctcacggaaacgtctcgaagccagttacggacgcgcctcggcttgcagtttctatcacgggaataagagggaggggtacgcccagctcgcccaaccgagcttagatgttgctatcccctaa

SEQ ID NO: 30761 - DNA, 95 bp, Glycine max
  Peptide Sequence Number=SeqID_122446
atgggggcggggatgataaagtatgtgaaaagtatgacaaaagcaaagagaaatggaaccagttttgtcaaagccgtagagacccttcatgggag

SEQ ID NO: 30762 - DNA, 399 bp, Glycine max
  Peptide Sequence Number=SeqID_122447
atgatgcatgcacctgactcaactcttagatgcaatgtggtacataccaacaaccaaatcccaggaaatagcctagattctttaaccacgtttgtcccccacgaatgggtcatccgacaaggtcagtgcactccaccccccatgaacatacactacatacaacgtggtccaaagcaagtaccaaagaccatggaccaattaaagcgcctaagcatcccctcagaaatgcttagattctttaatcacgcttgtcccccacgaatggaccatccgacaaggttagtgcacttcgccccccacgaacatacacaacatccaatgtatcgaacatgggcaccatcaagtgcaatgaccatggacaaattaaagtgcctaagcatccccgcaatgaatgcttag

SEQ ID NO: 30763 - DNA, 219 bp, Glycine max
  Peptide Sequence Number=SeqID_122448
atgtcgagcgtcccgatatattattgtcctaaattagacatccgagacaaaacggaatggagaatgaagagagagagaatatgccacttcaaggagaagatgagtctagaagaagctcaccaccatagaaggtcatggataagagcttggaggaagaaggagatgaatgaagggaggggagagaagagcacgaaatttagtgctctaaaagagctctga

SEQ ID NO: 30764 - DNA, 50 bp, Glycine max
  Peptide Sequence Number=SeqID_122449
aaagcaaacggctggatcatttaatacaacagtatgaacacgataccaag

SEQ ID NO: 30765 - DNA, 591 bp, Glycine max
  Peptide Sequence Number=SeqID_122450
caggaagaaccagatgccgaccgaggtttccagacgcgccagcagcgcctgcgcggtggccagatagccaatgcaggaggccagcgccgccaccagcggaatggcgatcatcaggttccacagaatccggttaacgaagttgtcgccgttgccctctttatccaaatagagcgggataccggcgcgtttcagactgacggtgacaatgctcagcgccccgcagatcagaataaagcacaggcgccccagcgtggcggagaactgcggatcgtcgaggttggcgaaagcaatcagcagcataatcagcggtacgatcaggccgaccgtcagcgagtaataacgcatggcgcgcgcgacccgcgcctgcggccagcggaagtgcacgacaaacaggccgtcaggacgggcaaacgccgcgctgatcatgaacgcccacagcagcggcagggtggcagtgatgccatcgccaatcgctacggcaaacgggtaaggccaggcgtgctgcaggccaaagccgagcgcaggcccacagcaccggcagcggcaccgcgaccagaatcgaccagaagacggtgcgcagcgtcaggctga

SEQ ID NO: 30766 - DNA, 441 bp, Glycine max
  Peptide Sequence Number=SeqID_122451
atggaggttaaacagaattttgcacaagtgcagaaaaatgcttgtgcgtggttggctgtggaaagtctagtgcagaatgagttctggatgtttgctagtatatcccaacggtcaaaatgcaggcttatacactatagacttccacttgagaggattgatggggacccggtgttgagagaaacgaggatatgggctacgtgggagtacgcgagctcagttggaggtgggcaacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagtga

SEQ ID NO: 30767 - DNA, 506 bp, Glycine max
  Peptide Sequence Number=SeqID_122452
ataagtccaacagggccctgggatttcccgccttgatcacaggattctgccagtcgttcggcgtccccgtcacacctagcaaggtgattcggccgcccatcacccgagcttttattgagaagtactgcacgcagagacaggtccagggtgaagcaccacaggccgcggacgcgccaccacctcatcaggctggtccagccggatcatttgacacggagcagtatttgcggcatttggttcgccagcaggcggccaaccaccgggcacatgtacagacccatgattgtctttatcagatgagtctcagcctgcagagccagggctttacttcttttccgtgccctactccggaccagttcagggcagagatcgcatggcctggagattggcctgaggcccaggcaggagaggcactagcagaggctcccgacgaggaagatgaggcccgcgaggacgaagagatgaccgatttacttgatttcttaggagggagcggggccacatga

SEQ ID NO: 30768 - DNA, 251 bp, Glycine max
  Peptide Sequence Number=SeqID_122453
gtagctgtgtctccggcaaaaccacctccgaagcccgatccggaggttagatgggatgccaccgtgttcggggtctttaatccaaatttccccctctacataaagcacgaagacctctccaaaatcgcacacggtggtcaatgtctcagcatatcagtgttacagttgtggattctgcatctcagtgaaacatgtatgcgagtggggaattctgatatctatggattcctcgagccacagtccattcagag

SEQ ID NO: 30769 - DNA, 183 bp, Glycine max
  Peptide Sequence Number=SeqID_122454
atgagtgagatacgaaaatttggaggtttgggaatggaggaacgtcgtgaaagaaaaggggctgcgcagggatttctggaaaatgtgatatttatagagcaggacgcgtggctcatctgttctagtgtaatcgattacagtattcatgtaatcgattaccagaacaaaattagccttttctaa

SEQ ID NO: 30770 - DNA, 261 bp, Glycine max
  Peptide Sequence Number=SeqID_122455
atggagaggagtatgatggatgctgctagtggtggagctcatggtgatatgacccctactgagggaaaacttgatgccttggtcaacctagtaactcagcttgccatgaatcagaaatctacacctgttgcaagagtctgtggtctatgttcttctgtagatcaccatacagatctctatccttctttgcagcaatctggagtcagtgagcaacctgaagcttatgctgcaaacatttataatagacctcctcagcagtaa

SEQ ID NO: 30771 - DNA, 945 bp, Glycine max
  Peptide Sequence Number=SeqID_122456
atgtctactgcaccaagcaccacttcagacttggataattcctatatttctactctgagaaacaatgtacgttcccgtgcttggggtgctgcaattggttgtagttataaagttgagcggtgctgcatcgtaaagaaaggaggtggaactattgatcttgaaccttgccttacacatacctcaactgttgagcctacccttgcaccagttgctactgagcggacaattactactagggctgcagcttcgaatgcattgcggcagcaaagatttgtacgcgaagttacaatacagtacaacctctgcaatgaaccatggatcaaatatagtataagcattgttgctgacaagggtctaaaaaagccactctatacatctgctcgtttaaagaagggagaagttctttatctggagacacactcctgcagatatgagctctgttttactggagaaaagatggcgaaggctataccagcaactcagatgcatgacctagatacagagaagtctcaaaatcaccatcaccatcccacaaatggtgacaaagctgattctgataatgttatggttgatgtatttcgatggtctcgatgtaagaatcctctaccccagaaactgatgcgcacgattggaatccctctgcctcttgaacatgtggagaattttttctcctcaattatgacttatgagagtaactcttgtattactgttgaatattttcatttgcctgttagtctacttactcgtttgcttaggtgtacaacctatgaaatgggagaggatggtagcgtgtttttagaaggtaaaggggaaaatcttatggtgctagaggaaaacctggactgggaagatgtacagtggtcgcaaactggcgtttggattgcaggaaaggaatatacccttgctcggggggggggggatagaaggggaacggtgctgggatga

SEQ ID NO: 30772 - DNA, 828 bp, Glycine max
  Peptide Sequence Number=SeqID_122457
atggccgcgaaaaatgtcgacagcaccggcgtgaaatatgacgccgtggccagcaagcgcgtagcccgcggccatggcacccgccgtcacgcacagttccagcgtggcgccgccgccgaaggccagcgcgggttccgcgctcatgccgtatttaatccacagtacgatcgcagtcagcatgaaaaacaatgccacaccgttcttgccgtcggcatagcgttttgtcacgttgcaataaacggcccatatgatggccccgctgaacgccagcccgtagctgaggggattgctggaaatgttggcgaccagccggtcccaggaaatgccgccgtcgccgcccaccacccagacaatgccgcacagcgacaaagcgatgccgggaacgacccaggcgctggcacgctggccgttgatcagtatcgccaggacgacggtaaagcacggccacaggtaattgacgatgcccagttcgatggcctggccgcgattggcggcgaaacccagcgaaagcgacaggcagatttcgtaggcgacgaacagaatgctgccgctgaccagataggagcgtgggaacgaccgcagacggggaaaccccagcagcaggacgagaaacaccgaacctaccgtatagatcagggccgcgccgccgatcggcccaaaactctcgctgacgctgcggatcaggccgaccacggtgccccagagcaccacggccatcagcccaagaaaggtcgccgtgttccggccgggagcaaattgcattactttttccgattgcccgatgtccatccaggcgccgcgccgggcaacgcgcgccagaacgacgca

SEQ ID NO: 30773 - DNA, 267 bp, Glycine max
  Peptide Sequence Number=SeqID_122458
atgggaaagttggatcatctagaggaaaggctcagggccattgaaggaggtgaagattatgcctttgctaacctagaagagttgttcctagtacccaatatcatcacccctcccaagttcaaggaattgctgatacattccttccaagaaagccttactggggtagctgttacttggtacactaacttggaaccttcccgagtccattcttggaaggacctagtggttgccttcgttaggcagtgtcagtataatatcttcggatag

SEQ ID NO: 30774 - DNA, 222 bp, Glycine max
  Peptide Sequence Number=SeqID_122459
atggaagatgaagttgcaaaagaagctcagcaagagccagctcctcaatggaacccttttgagtcccttatgattcaaaagatggatgctatccttcatctccatcaagtgcatcaagctgaagttcatagctccttagagaacatcacaactaggcttgaaaacatagaacctaggttatcccttagtaacttcctaaactcgaataaggatgagacttag

SEQ ID NO: 30775 - DNA, 492 bp, Glycine max
  Peptide Sequence Number=SeqID_122460
atggggcaaaggatcaagcgctttgactttgtctcccgggattcaccacaggttgggtttgagagccgtgtgatgggtgactatccagcacggtgtattcttatacattttcccaaaagaacattcattcatttctttcttccccgtcgaccacgacgactgaaacgacgcaaaaaatccagacccggaaaggagaagggccggtggtgggcatttgggaaagtcgggccgatcgggtgtcttcattccagcgacaatacagaagaagaacgaaacgaagtgagaggccggagggcaggaaaagagtcgagtcgatcaggctcgacgaccgggagaagcaaaacgaaattcggatttggcgaaaagaagcaacgctatggataccatgaccgatcaccatcgataaagaagaatctttctaaatcacttcgggtcagcggggccttcaagcatccgaaatacgccggggttgtaaatgacatagcgttctga

SEQ ID NO: 30776 - DNA, 420 bp, Glycine max
  Peptide Sequence Number=SeqID_122461
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgcccccctgacgagcatcacaaaatcgacgctcaagtcagag

SEQ ID NO: 30777 - DNA, 240 bp, Glycine max
  Peptide Sequence Number=SeqID_122462
atgattggctcttttatcaaattgccatggtctccccaaaaacctgatgaggacatgttcaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 30778 - DNA, 426 bp, Glycine max
  Peptide Sequence Number=SeqID_122463
atgccccattgccttatcctcatcttgttacccttttccttcaacatccctcttgattttgaaccctatgttccaatcaagagatcattccttataggcgcttcactcatagcatcctttggttatattaaggagcatgatggctcttggataaagaagggtgctagaaatgttggtgaagaaggacatgagggagaagattcatctcttctttcaatgattttggaaaagtttaacggtcttcaaacctttgttggtgagaggtttgacactttggaattgcaagtggatatgcgcttcaatgaaatggagtcaagaatgacaaaggttgaagaagatgtatcttacattcgttcaagcttcgatcttccaccaccggcgccaccatcatcttggatctatattttaatattattagtactttga

SEQ ID NO: 30779 - DNA, 279 bp, Glycine max
  Peptide Sequence Number=SeqID_122464
atgttaagagatgggaatggcaactggcttgaggatgagcaacaaatcaggtctctagttaacgaattttacattaatctattttctgatgatgacagggatgatagatggtcagtgtctcctttgtcctttcctatcttggatcagcaacattatgatagtttgggagttgatgttcttgccgaaaagattgttggacattttagtgcaaaggttggaagttacatggaagttactaaaacttccatcaacggttggaagttacatggaagttattaa

SEQ ID NO: 30780 - DNA, 111 bp, Glycine max
  Peptide Sequence Number=SeqID_122465
atggcctctggtaatcgattaccaagggtagcggttatgggacacattgtgttgttacccgtagttagatttctcgtgaaagagtctacccccttcttttatttcttgtag

SEQ ID NO: 30781 - DNA, 126 bp, Glycine max
  Peptide Sequence Number=SeqID_122466
atggggtgtagcaagcaaatgctcacctcccccttaggaaggtgttgcaacctacccttcggcgggagggcgacgcgagactcacagggtgtttccctcgctcctacctatcctcaattgcgatga

SEQ ID NO: 30782 - DNA, 832 bp, Glycine max
  Peptide Sequence Number=SeqID_122467
atggtgctggggatgttgtttaatattgttcttgcccgtattacgccgctgaaatacatcttcctgacaggccaccacacgctgtatatgtcggcgatgctggctgtcattctctctgtcggcggtctgtcgccgttctgggtggtactggtgggggcggtaatcctcggcatcatgatggtggtctctccggctattctgcagccatttacccgcaaaattaccggcactgatgacctggcgctgggccactttggttcaaccgggtatctgctgtcggcgctggtgggaaaagcgatcggtaaaggcagcccgtcgattgaagagctgaaggtgccgaaaacgctgaacttcctgcgtgactcctcggtggctatctcgctgacgatgatgattctgttcctgattctggtactggtcgcaggtaaagagtttgttgagaccagcatcagtggtggtcagaactttatcatctttgccattatccagtcgctgaccttcgcggcaggcgtgtggatcatccttgcgggtgttcgcatgattattgccgaaattgttccggcctttaaaggcatcgccgacaagctggtgaaagacgcgaaaccggcgctcgactgtccaaccgtctttccgttcgccccgaacgcggtgatcgtcggcttcctgtcaagttttgccgctggtctggtgagtatgttcctgtgtccgctgcttggcctgagcgtcattgttcccggcctggtgccgcacttcttctgcggcgcgacggcgggcgtttacggcaacatctgcggcggtcgtcgcggcgcggtggtgggggcattcgctcacg

SEQ ID NO: 30783 - DNA, 228 bp, Glycine max
  Peptide Sequence Number=SeqID_122468
atgccatcgaggaagctctccgcaaagagatctaggagggacgccgcggccgaaggaaccagcgctgctcctgagtttgatagccattgtttcaggagcgcagagcaccagcagcatttcgaggccatcaaaggatggtcgttccaccgagagagacgtgtccagcttagggacgatgagtacatagattttcaggaagagatagctcgccggcgttggacgtcgctg

SEQ ID NO: 30784 - DNA, 911 bp, Glycine max
  Peptide Sequence Number=SeqID_122469
gttttatcaagtcaaggttaaaggtctagatgtcactagcctcaaggaattgggacgattgatgggacccctccaaaggcaagccttccgcaaagtgtacgtgaagattctagatttggccgcagcggaggtatttacggaagctgtcgtatccctcgcccaatactatgaccagtcgttgaggtgtttcacgttgggggacttccaaatggtgccaactattgaagagtttgaagagatattaggatgccctctcgggggggggggggaaccgtatcttttctccggctttcttccttccttgagcaagatcgcagctgtggttggagattcagcaaaagagttggaccgcatgaagcaaattcggaacggcgtagtgggcctgcctcggaaatacttggaaagcaaggcaagggatatggcgagccaagagaagtggggcccgtttgcggatattttagcgttgctgatttttggggttgtcctctttccgaacgttgacagtttagtagacttagccaccattgatgctttcctcgcatatcaccatagcaaggaaagtccagtggtggctatcttggcagatttgtttgacacctttgaccggagcacgatcaattggtttcctcgttggaaggaaggcaaggaaggagttcttttctcgtgtggggactaccctaatgttccactgatagggactaggggttgtattaattataaccccgcactcgccataagacagctagggtatcccatgaggggagcgccaaccgaagaaagtctctcgcctttccttgtgagggatctaggcgcgcaaggtctcaaggttatacaaagagtccacaaggcgtggaggagtccgttgaggaaagacaaggagcttagaggcatccgaaacggcgtcatcggag

SEQ ID NO: 30785 - DNA, 977 bp, Glycine max
  Peptide Sequence Number=SeqID_122470
accgcgaagctggaggcagagatcgagcgcctgcgggaagtaaaaggccagaagctgagcaacgaagcgcagaagctgatgaacatgccacaccgccgcgcaatcactaaaaaagaacaggctgacatgggcaagctgaagaaaagcgtccgtggcctggtggtcgtgcacccgatgaccgagcttggccgtgaaatgggcctgaaagagatgacggcggagactcacccgccgcgcaggttatctggtccccaggagacctgcatgagcctctggcaacaaaactacgacccggccggaaatatctggctgtccagcctgatcgcatcgctgccgatcctgttcttcttctttgcgctgattaagctcaagctgaagggctacctcgccgcgacgtacaccgtcgccatcgcgctgctggtggcgctgttcttctacaaaatgccgatcgatcgcgcgctggcatccgttgtctacggtttcttctatggcctgtggccgattgcgtggatcatcatcgccgcagtgtttgtctataaaatctcagtcaaaaccgggcagttcgacatcattcgctcgtcgattctctccatcacgccggaccagcgcctgcagatgctgattgtcggcttctccttcggggcgtttctggaaggggcggcagggtttggtgcgccggtggcaatcaccgccgcgctgctggtcgggctgggctttaatccgctctatgccgccggtctttgcctgatcgtcaacaccgcgccggtggcgtttggtgcgatgggtattccgattctggtcgcaggccaggtgactggcctggacagcttcgagattggtcagatggttggccgccagctgccgttcctgaccattatcgtgctgttctggatcatggcgattatggacggctggcgcggcgtgaaggagacctggcctgcggtgatggtggcgggcggttcgttcgcgattgccca

SEQ ID NO: 30786 - DNA, 297 bp, Glycine max
  Peptide Sequence Number=SeqID_122471
atgaacatccaattattctctttgcacaaggatggtgatgttgatttaaatgcttcaccccaagcacttgataagctgctgggttatgtgcttgcttttaagataaaggtgcaacccaagttcaggaaatttgccattttgaagtgttcaactgactcaagcttaattgatgttgtgatggacatgctacctaatgctgagacatcttcaaaaatcaatgtcccaacctttgattccaatcattctaccgagcatgaacctgtgaattttaatcatgaccttcatcctttaatatga

SEQ ID NO: 30787 - DNA, 306 bp, Glycine max
  Peptide Sequence Number=SeqID_122472
atgccccatgggttgtttccttacaaaagtcacgcgctaatgccattgaggcatttcaccgaacacttggtgggcgcgcgtttaggcgtcaatagcaagagaacggggacaatgtggcatagcaccaaaaggagatcaaaatacaccaatgaaaagctagaaagcttagggatggaacacttacttattggtgatgaacaaaagcgcaaaacggaatcaaaaaacgcgaaaaatgatcaccctggggctgcaaattcgtcaatcccgtgggtagggcttttgaaaggggggaaaagaagtttttga

SEQ ID NO: 30788 - DNA, 159 bp, Glycine max
  Peptide Sequence Number=SeqID_122473
atggagtcctacagtggtcacagttcgaccgaagagggtgctacgccaatttgggcaggtgaccagcccagacatgcacctgccccagaccatgaggactacatgcagccggacatcccacaggttccagtgacatttgagccccctcaacatgtagtg

SEQ ID NO: 30789 - DNA, 510 bp, Glycine max
  Peptide Sequence Number=SeqID_122474
atgctgctgtgcaaagagctggcgatctggctgggcgtagacgtcggcgaccaggtgctggtgaccttcgccgaagtgcagggcacgcctgccggtgcggtgccacggatgaagcgctttaccgtgagcggcatcttcgaggccggctacaacgaggtcgaccgcggcgtcggcttcgccaacatgaaggacctggagcgcgtgctgcgttccgatggtgctacgggcgtgcggctgaaactgcacgacatggaccgctcgctggaagtgggcgtggacctggcgcagaaccttggtggcgcgtaccgggtgagcgactggacccagcagaacgccaacctctaccactcgctgcgcatggagaaggtggtgatgggcatcctgctgtcgctgatcatcgccatgggcgccttcaacctggtgtcctcgcaggtgatgctggtgaccgacaagcaggccgacatcgccatcctgcgcacgctgggcctgaccccgggcggggtgaagcag

SEQ ID NO: 30790 - DNA, 649 bp, Glycine max
  Peptide Sequence Number=SeqID_122475
atggcggtgcagctggataacggcggcgcggcgatgctgcgggagaaaattctcgatcttgaggttggcgtgcacaccagcaaagcgacgacggcgatagtgcgcaccgccgacgggctgcagcttaacttcgccgatggcggcacgctgcagaccgatatggtggtcttttccgccgggatccgcccgcaggatgcgctggcgcgcggcgcaggcctggcaatcggcgaacgcggcggtatcggtatcgatgaccactgccggacctcggacgcagatatattggcgattggcgaatgcgcgctgtgggacaacaaaatttatggtctggtagcgccgggctaccacatggcgcgcaccgcggcggcgcagttggctggtgaagcggcccgctttagcggcgccgatatgagcaccaaactcaaactgctcggcgtggatgtagcgtcgtttggcgatgctcacggacgtacagctggttgccagagctatcaatggaccgatggtccgcggcagatctacaaaaagatcgttgtcagcgctgatggcaaaacgctgctgggcggcgtattggtgggcgatgccggtgactacgcgacgctgttgcagatgatgctgaacggcatggcgctaccgtctcgtccggaaa

SEQ ID NO: 30791 - DNA, 234 bp, Glycine max
  Peptide Sequence Number=SeqID_122476
atgagatatttcttgatcggtgttgctatggttgcctcctttgcttacgcaaaaagcgtgatggctcttgggtttgatggacttcaaacctatgttggtgagaggtttgactccttggaacgtcaagtggacacacgatttaaggagataaactcaaggactgcaaaggttgaagaagatgttaccattattcgcgactactttgatttacctccaccaccaccatcagtttag

SEQ ID NO: 30792 - DNA, 234 bp, Glycine max
  Peptide Sequence Number=SeqID_122477
atggataagagctcgaaggtaggagaagatgagtggagggagagggagagaagggacatgaaattttgtgcctcaaatgagggacctatgacgaggagtaagaccaagcagtcagtggataccctccaccaaatggtagcagacatacttaataaggtccaagtggagaaggatgaaggcccagaagtagaggcaccactaaacatattaatcgttgttgaagcccaagattaa

SEQ ID NO: 30793 - DNA, 372 bp, Glycine max
  Peptide Sequence Number=SeqID_122478
atggcattaggggtcatgagttggttgaaggccaatctatcttgcgagcatgtcgtatatgagtccccttggaatcacttacttggtggaggaggaacacctatattttccagcaaaatctgtcgaatgccgaggttattcacaaagctagatgattggcgacagactatacctaaggagtggtgggataaaggttgttgtgtggtggtctttcgagaccaaaccgctaagcgagacaacagtggcttagcgattgaggataagcctgaagagagttctttcacgtcaacacgcacccagtgcgtatgcagctcgctaagcaagacggttgtctcttctacgctaagccaaatctcacttactcgcgcttag

SEQ ID NO: 30794 - DNA, 243 bp, Glycine max
  Peptide Sequence Number=SeqID_122479
atgcagctccggagacggtcacagcttgtctgtaagcggatgcgggagcagacaagcccgtcagggcgcatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 30795 - DNA, 616 bp, Glycine max
  Peptide Sequence Number=SeqID_122480
gcgctggagcaggataagcgcgtcttcgtcgatgtcaccgctgactggtgcatcacctgcaaagtgaataaatcacgggtgctgaatcagcctgacgtgcgtgccgccctcggcgcagaggatgtggtgctgctgcgcggtgactggactcaaccggatccggccatcggcgagttcctgcgccgccgcgatcgcgtagcgatccccttcaaccagatttatggcccggcactgccgcacggccagattttatcgccgttattaagtcgtgatgcggaggcgcgcatcaaacagctgattcgcgaaaccctggtgcaaaatccggcgattctggcagaagctgccgacgcatttgataaagaagccgcgcgccagcagcaaaacgtggtcgcgcagatggtagaaaaaaaccgcgcggcgctgtttaacgatgccggctcaccgcgcatcggtgccaaaaaaccggcactgacgttggtctatttcaccgactacaactgcgtcttttgcaaaaagtttgaggcggatatcgaaaaactgctgcagaactatccgcaggtggcggtggtgctgaagccgctgccgtaccgcgctgaaagctcgctcagttcggcgc

SEQ ID NO: 30796 - DNA, 148 bp, Glycine max
  Peptide Sequence Number=SeqID_122481
cccagagtatgaagaacctcgggatttgaggtcaaatcctttccaaggtggagggaatgatgcaatcctactccgtaagggcattgggggtgagcttagctattataggggatgtgtagctaagttcttagcttctcatctcaaggag

SEQ ID NO: 30797 - DNA, 477 bp, Glycine max
  Peptide Sequence Number=SeqID_122482
atgtgtgatacattggaaagtgatttgaagaattttttgtatccggtgtgcaagaagtcattgaccctattgtcaacggtgttaagtatggttaatatgaaggccagatatgggtggagtgacaaaagcttcacttcgttgtttaaggtagtgcaagaaatgcataaatgccccaggtgtgggatatcatggtacaaagtgacaaatgatgacaagtgtagcaatgatgaaagcgcaaagaaaaggctcccccagcaaaggtgttatggtatcttcatatcattccaaggtttaagcgtctctttgctaatggagatgatgcaaaagactttacatttcatgcaaatgggagaaactacgatggaatgctctgccattcagatgatttttcccaatggaagaagattaatcatttctatccaaatttcaggaaagaggcaagaaatcttaggcttagacttggcgctaatggaatga

SEQ ID NO: 30798 - DNA, 201 bp, Glycine max
  Peptide Sequence Number=SeqID_122483
atggaccttttggaacaagcaaagccttcatccactaatggggatgtacccttccttgttctctttgaacctaaggtgatgtcattccagctgagaacactggggcaccacataccgagatatgtcctttgcttacttggtaccacaaagatgtacctccaatgtgttaagacggaaggagactcaggaagaacgagttag

SEQ ID NO: 30799 - DNA, 646 bp, Glycine max
  Peptide Sequence Number=SeqID_122484
cctcgccttcagagggctgcatgtcctcgccttcagagggctacaagccctcgcctttagagggctgcacgccctcgccttcagaggactagacatcctcgccttcagaggcatgcacgccctcaccttcaaagggcgacacgtcctcaacttcagagtgctgcatgccctcgcctttagagggctacgcgtcgtcgctttcagagggctccacatctgcaccttaagagaatttaagcaacattctgcccagcgaccgcagtgccgatctccccctacggaagtattagttggtctgtgccgtcctgacataggggtcgcgcccataagacacccagtggacccgaaaaagtccaacagggccctggggtttccagctctggttacgggcctctatcagtcctatagggtgcccgtcccccccggcaagggatcgcgcctgcaagacacccagtggacccgaagaagtccaacagggtcttggagttgtcaagctctaattacgggtctctatcagttctacggagtacctgtaacctccagcaagggcatcaggccccctactaatcgagctttcatcaagaagtactgcgcccccaggcaggcgcagggcgaaacaccacaacagcattgggatggccggtag

SEQ ID NO: 30800 - DNA, 333 bp, Glycine max
  Peptide Sequence Number=SeqID_122485
atggataatccaaaacatcatttatggttagggagtttgcataaaatagagaactcgtccttcggcccgtggagaaaagggggcaccgagactttttcaatctcacaagttatccagaactacgtaggtctagttcctcattgggggatacgtaggagccaagatcctgactttttcgaccataatcctttcacccaagcaaaaaagaaaagaaggaaaatttccaatcaaagagaaagtcaaaaagaaaagaaaggaaattcccaatcaaagagtgggagaaagcaaaaggaaaagaaagaaaattcccaaccaaagaatgggagaaagtaa

SEQ ID NO: 30801 - DNA, 110 bp, Glycine max
  Peptide Sequence Number=SeqID_122486
atggagtctcacaacttccttgaaaagagttttgagatgtgggaagcatcatccaccttgtgcatggacaaagtccatactaatgtctacccaaggtgcagaggggatgg

SEQ ID NO: 30802 - DNA, 214 bp, Glycine max
  Peptide Sequence Number=SeqID_122487
ttgttgggcctattgtgcaaggaacaaaaccagatgacaacattgcccttaggacatataaagatcatttgccaatatgcactgcattggagaacattagatcaatgacaacggaatggagaaggaagaaagatgattggagacactacttcaaggagaagatgagtcaaaaacaagctcactaccataggaagccatggataagagctttaag

SEQ ID NO: 30803 - DNA, 120 bp, Glycine max
  Peptide Sequence Number=SeqID_122488
atggaggctcccaacacacttccaatgaaaggccttttgttacatatcttgaaagcaatgaagattcctatgagggaactcaactcatctaagaagtttcagaaaaggctttatgactag

SEQ ID NO: 30804 - DNA, 366 bp, Glycine max
  Peptide Sequence Number=SeqID_122489
tgcagaaaaatgcttgtgtgtggttggctatggaaagtctagtgcagaatgagttctggatgtttctagtagatcccaacgagttctgcctttgccctgttttgcttggctgtgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctaagtggtacctggagatatgtcgcgggggtcaggagaccttggggacgtcaggtggggtgctattgcccaaaaccaagcttgaccaatcccgacccaacccgggcatagtcg

SEQ ID NO: 30805 - DNA, 243 bp, Glycine max
  Peptide Sequence Number=SeqID_122490
gtcgactctagaggatcccccattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 30806 - DNA, 425 bp, Glycine max
  Peptide Sequence Number=SeqID_122491
gtggagggcaaagaaggcctccttctggggggccagagccatcagtgagatacactctggaagagctagaattctaccttgtgccaggacctacgggccgagggacagtctcaggtagacagtttctatggggcgtaggcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 30807 - DNA, 354 bp, Glycine max
  Peptide Sequence Number=SeqID_122492
atgaccctttcatcatggcagaacaagctagacaagtattttacgtgcaagacccttgtgatgaaaggtgagacaaaggtcaccaaagcaaatggtatccttaggacttcatacagctcatgtttgtcgccagtttcatcatccaccacccttttcttctctgtcttctcacagattggtgttgatcgttctagtgcaacctttaataaagctgagatttataaggaggaagcacggaatgcaacacagaagcataaaccaaagagggtggagagtgtcaacgctgatgcagaagcctttggtgatcactcgaaaattctgattgctttatgcattctgaagctgaagcactag

SEQ ID NO: 30808 - DNA, 1380 bp, Glycine max
  Peptide Sequence Number=SeqID_122493
atggagggaagagagagcaaatcttctctcacctcacaaacggaacctcgcgacaacccccattcccgtttctccactccaatgcaacaacaccaatctcatcatgagttaccgatgtggaactctaaatctgattggagaagagtacagaaagaaatggtggctttgaagaaggcatatgcggatgtgattctgaacactgtgaaggaggctgcaggtcgggtaatggtggcggaaaggagagctcttatgttccagcaagagcatgcttcatcgaaagaagaggctcttcatatgttaatgcgtttgaagcagatgatggatgctaagacagctgaagcagaaaaggcatcattggagaagcaaagaaaaattgatgagcttgaagcacaattgaatgaagccgaggatatcataacagatctaagggcagagttgaagcttgtatatctggagttagagatggcaaggaataaccaggtccggcctttgagtggacagaaatcacagaatgaaaagcaagctgtaacttttcaggagagtgcaaaacctgagatttcaatatccagtcctcataaagaacttagatgtgtaacaagctgtgatgtggcaaacaaatcattgactatgaacgttttagataataagtgttgtaatgcaaaacaacaaactgagcaattgcgcatctctaatttggaggattcttgtggtcatgactctgactttgcttccatcatcacgaaaagcaaggaacctgaacttttccgaaatggatttactcagagaatccatgcactcgaaggaaatttgctggatgaaaagctgctcaagcaagatgtacacaatcaacattatggtaaaaaactcaggatcattgctaaagatagtaatgggcaatgcccatctgtctctgataataaaaaatgttgtgaagatgaatatgatgcaaagatgaagtcagtggcacctttgactgatgtagaacctgtgcttgggaccactggtgttacagaaagtgtccaggctgttaataaattcaagcttgtggagaaggcaattgagaaggataatgagttattaaatttagaagaaagtgctgcacagaatctaacaggtccaagttctgatatgaaagttgaggttttcgatgttccatccacgaatactgatttggaagatgcaaaagcttttgaaaaaaatgatagatctgccagtcaagtaaatgacagtaggcctctgaagtatacattccaaaggaagcgaaaaaaggaatccttgggaaacacagaccaaaacattgattctgagaagcgtatagtgaagaggaggttggaagacaaacaaaatggtgcattagaacaccaaaatctagcatcatag

SEQ ID NO: 30809 - DNA, 246 bp, Glycine max
  Peptide Sequence Number=SeqID_122494
atgtggttactagtgaatttagcaccggtttttcaaaacccgtcgcaagagaaaaacgcggtgcccctcagcttcctccccaaacactgcaagagagatctagaggcaacaaatcttcttgatggagctttagaggtgacagatctgttcatagatctctctggtgttcctgctcgtgtttgttgccataattggaaccagcacggcctcgaagatgacaatctcgtagggcttttaccagaatag

SEQ ID NO: 30810 - DNA, 1794 bp, Glycine max
  Peptide Sequence Number=SeqID_122495
atgggaggagaggaagcgtttttcgcttacggaagaaccttcttccgtatgcgtgattgtctgaaaatgcttcgtacgaaagaacgttcttttgtaagttcctatggaagaaccttcttccgtaagaacttacagaataaggattttcttgttacggaagaaggttctttcgtatgttcttacgtaagaaccttcttccgtaacaagaatatccttcatacgggagaaggttgttccatcatggttagaacaagaggtttaggtcgtgccttagctagtgttagaggtagaggcatgggccaggatgagcatcatgctgatgtttcacaacggcgtaggcctaccgcttttgcccgtaggcaaagggttcatgttgatgttactgaggatgttcctcaggtgactgaggatgttcctcatatggacaaggatattcctgagaggattgcggacgtagatgctgcagacgtagagggcataactattgatggtgctaaggggtcacctgctgatcatgctgagggattccctggtgggccacgtgacccatcgatcctgacttcatttggcgaccatgtggcacatagcatctggagtggaaaggaacgacctgagttgaagttagtctcccaaggtatgaaggttgataaatttgggaggtcagcacctgagatagaaggcctagtggcggccactggattaagtccactaattgggtgttctgtagtcaccaacgatcctagacttatattcgcatttgtcgagaggtggcatagggagaccagcaccttccaccttccagtaagagagttgatgatcaccctggacgatgcggcggcactcctccatcttcccatcacaggcgtgttacacagctttgagcctctgcttgtggacgaggcaatcttcttgttgatggagctgcttgaggtctttggtgatgaggctggagttgagactgtctatcagagtagatgccatgtccgatggtggattgtagcagcccatgcttatctcctccacttgggagctgcgacactagtgcacatgtatgaccagctaaatgaagcttgccagacccctacacgacagatgactaggtacttgactttatcacagtgctggatatatgagcactttcctagtgtgtatcagtgcgtcactgatgatgcgtatgctgagacgaccccatgtgcctcctggtggctgactacgaaggctcacatgaggggggtcacaggagcgtcgtaccgggcacggtcagctgagatgggtcctattgtggtctttgttcgaccagagagggtggtacgacaattcgggtacattcaaatgatccctctgtcgcctgttagtgcttcactgtcatatgaggagataggcgacaggtggatgcatttcttggaccatgtagcacctgcgggtgagatttgtgttgtccctggacaggtatcagcagactacatggattggtttttccagatatctcatccattcgtcacactgacccaggcaggtgatcagcccagacatccacctaccccacatgatgaggaatacgtcgagccacatatcccggaggttctagtggcatttgatctccctagacattcagtggatgcttgtgaaggttgtgaagcaatcgcagaaaggttggagcgtgtgctcaaccttaggatggtcactgaaggcacagagttacacgagatcatgcaagattgcctcaggatcgctaggggtaacacctcagatggaagtctcagggcgcgacatagacgccgcatagatcattga

SEQ ID NO: 30811 - DNA, 264 bp, Glycine max
  Peptide Sequence Number=SeqID_122496
atgaattatgggcaaggaatcccgaggcttgtattggtgggaatgattaatggtattggcaattgccatgtgaagaatgatgaagggaatggaaaggaaatgagattgaaagacaagagatcataccttctcattagtgaatacgttcaaagagcagagctaagaagacaaataaaaattggaatgaaaaggagaacaagaagacgtgaacccaacagaattgtaccacgattcagctcaattcctaagccgcagtctgcatga

SEQ ID NO: 30812 - DNA, 348 bp, Glycine max
  Peptide Sequence Number=SeqID_122497
atggaggataggccaaataaattagattctgctccacatatgcaggatctgtctccaatccttacacttgagtgttttgatggtacaaattattctgaatgtgccctaaatgcagagaacaagatcagagatcgtaggcgttggggttacactcaatcctttggggttgattaccaagaaacctttgcatcagttgcaaggggttacactcaatcctttggggttacactcaatcctttggggttgattaccaagaaacctttgcatcagttgcaaggggttacactcaatcatttggggttgattaccaagaaacctttgcaccaattgcaaagctcaatacagtga

SEQ ID NO: 30813 - DNA, 444 bp, Glycine max
  Peptide Sequence Number=SeqID_122498
aaataccaagatattaatggaagatcggagcatcctggtcgtgtacgtggggctgggacaggggttacaattacgcaatactttggtccatcatcgtgtcggtctaccagttcatcaaacatcattgtagaacagttggctgatataattggtaacctaaaagaagaatggcaaagacaggctgaacaagaaaacattaaaagagaggaggtgtggatgaggagggttgaagaggaaaaacagcgcactatggacacatttaaaggacaaatacaagaagctatcaagttggagttgtcacaaattgtatcacaacattcagccccacttcagccaaatgatatacaagtattagcagcaagggtaagcacgaagggaagctgtgcagcagcagagacaaatgcattagctaaaaaaccctctgagttgaatgttgaatggtga

SEQ ID NO: 30814 - DNA, 1050 bp, Glycine max
  Peptide Sequence Number=SeqID_122499
atgacacagtctgcattacttggcagaggaatcgagcttgcatcttctctcacaagctctgcagtgcttcttcgcaaaccatgggacgttatcacgtcccgttatgcaggcatcattaccagcgagggagagggaatatcatggaagcttttcagagaaccgggtttggatttgacgattttagcgtttgatgtcacacaagattcttctaatcctccaaaggaattggtttactctaatgcttgcggggagaagattttccgtcactttgagtttctgcataccaagaaaagcccatttttctctgttaacagcgctgcaattttactcttggataaaaattatgagcagcttgatcagttgaaatccgagattaatagctcccctcgattgattgttactggacttggtcttggaggaccaattgcttctctgttcactttatcactattagataccaataatgacaaaaagaaaccccctctatgcatcacttttggttctccccttattggtgacaagaaatttcaaaaagccatatcacgtagttcaaattggaattcttgctttctacacgttgtgtcactcaatgacccacttccaaggctcttcgttacaaattcacctgctgcatcgactcctcaaacaagtgcctacatgccttttggaacatttttattgtgttctgatgtaaactccacttgttttgagaaccctgactctattttggaacaactcattgcaatgggctcaatccacactcagaatcaaggatttcagtcttctgactatggaaatattgtagaaaagctaaatgataaagtaatttgcaaggacttcagtacaacacatttgcagcagcagaacattgataccaatactctggaaacaaagagtaaaatacaacaaaaattcattttcccaaggagggtaattatttatccagccaaaaaattgaatgaaatgaaggtacatatggcccaacttgaatggtacaagaagaaaacaaaaaatcagcgaatagatactatgacagctacaagaatatga

SEQ ID NO: 30815 - DNA, 315 bp, Glycine max
  Peptide Sequence Number=SeqID_122500
atgaagtttaaggaggtggagagtgagggacacgcgccagtgtgggggagtgggagatggaatcacgggattgtgagagagtcacggtttaggctgttcccatttcgctcaccgctactacaggaatcgcttttgctttcttttcctctggctactaagatgtttcagttcaccaggttgtctcttgcctgcccgtggattcagcagcagttcgaaaggttgacctatatcgggaatccccggatctacgcttattttcaactccccgaagcatttcgtcgcttactacgcccttcctggtctctgggtacctag

SEQ ID NO: 30816 - DNA, 294 bp, Glycine max
  Peptide Sequence Number=SeqID_122501
atgtttgacacgagcatctctaagaaagctgtgagcaagttcttgggtgtttcgaggaagtcaattagtcaatatgacatagactatcgatgcttgttggtatgtggtgcgtatggaagtagcaaactaaccgcgttgcacttgcagaacaaactattgacagtgaaattgagccactctatgcaagctggagcctataagtgtattgtggatgcagcagggtttttccaagatagaaatagcacacaggatttggattttgtattagagatgattgtggtgattttattataa

SEQ ID NO: 30817 - DNA, 1572 bp, Glycine max
  Peptide Sequence Number=SeqID_122502
atggaagaggtcaaaaagaggattcaatcttggagcaccaatgaacaattgcttgttgacaaagtctatgaatacattagaggtgtcaaacctactgttagttggtattctattatatggaacccagcaatcccccctaagatgtctttcattctatggaaatctctccaagtttgggctcacattcgtgatttgactcctttccacaggcgtttcacttctttgcagcgcattattgactctttaattaggggcagatctacatcaggggggcttttgattttctctagctgcggggtaaagttgactaagaaggttaccaaacaagtaagattacttgcacaggatgaaaatgagaaacttgcagaaagaagcttatatgatgtaattcctccttatgaccaagcaacagcacttggtaagacaaatattgatgttgaccgaatagctgctggattaccttgtggtagtgaaggatttctattaatgtatgctcgatggaaaaagcttgaaacggatttgtataatgaacgcaaggaacgctttgatatcacccaaattcctggtgtttatgattcatgcaaatatgatctcttgcacaatgcacatcttaatctagaaggacttcatgagcttttcaaagttgctcagatgcttgctgatggtgtaattccaaatgaatatggaattagtccaaagcagaagctgaagattggctcaaagattgctcgtcggttattgggaaaacttttaattgatctgagaaacactcgagaggaagccattactgttgctgagctgaagaataaccatgaccattcattatccataaatattgagaaggaagatgcagaggccaagtcaaaactattccataagaatgatgaaatagatcaagatgatgatgatgataaagagaccaaatatcgtttagatccaaagtatgcaaatgtgaagacacctgagcgccatgtgcgaacacgcctctacttcacatcagtatataaaatcattgctaggctatcaccaaacaggcttaagcattttggaaaattggcatgtgacacttacaaaagggaatctcatattcattctctcatgaatgttcttcgttattgtaatttggaagaatcccttcaagaagagagtcttgtttgccgtaatgctctagagagactatgtaaaacaaaggagcttgactatatgagccatattgtgcttaggatgttcgagaacacagaggtggctttagaagatcctaaaaggtaccgcatagagctgacctacagccgtggtgccgatttatctcccctggagaagaaaggtagtgcagctacttcattgcatcaggagcacacactgcctataatgggtccagagaggctgcaagaaataggatcatatctgacattagaaactatggaggagatgattcggccatttgctatgcccgcagaagactttcctccagcaacacctgcagcattctctggctatttctctaaatccgtgcttgaccgtctcgttaacctttggccgttccatagacaagccagttctctaggaaaatag

SEQ ID NO: 30818 - DNA, 1821 bp, Glycine max
  Peptide Sequence Number=SeqID_122503
atgtggtctgcgattgtgcactccgttgataagttggggatatggccacgcttgcctgttttcttagggctattgtacctagcgtttcgccgccaccttcatcaggaatacaacctcttcaacgttggaacaacgccggtgggggttaggttcaaccattctgattttccatacagaacagctgatggaaaatataatgaccccttcaacgaagtttctggcagccacggaactttctttggcagaaacattctccctgtggatcagaaaaaaaagctattgaagccagatccaatggttgtagccacaaaactactagctaggaggacatacaaggacactgggaagcaatttaatgtgatagcagcttcttggattcaatttatgattcatgattggatcgatcatctagaagataccaatcagattgaactcatcgcaccaagagaagttgcaagccaatgcccactaagatctttcaagttctacaagacaaaggaaattcccactggcttctttgagatcaaatccggatcctcaaacatccgcacaccttggtgggatgcaagcgtagtatatggaagcaacggagaagttttacagagagtgagaactttcaaagatgggaagataaagatatcaaaagatggtcatcttctccataacgaaaatggaacagcaattgcaggtgacatccgcaatagttgggctggtgtttcaaccttgcaatcccttttcattcaagaacacaatgcagtctgtgatactcttaagaaacattatcctcacttgggagatgaagaactttatcgccatgctagattggtgacctcagctgtgattgcaaaggttcatacgattgattggactgtagagctccttagaactgatactttacttgcaggcatgcgtgctaattggtatggattattggggaagccatttaaggatacatttgggcatgttggtggagtcatcttgggaggattagtgggtcttaagagaccagaaaatcacggtgtcacatactctctaacagaggaatttgcgactgtttatagaatgcactcactcctacctgataacctacaactgagagacatatctgctactccagggcccaacaaatctctaccattaatcaaagaaattcctatgaagaatttgattggactgcaaggagaaaaaacattatctgaaataggacttgcaaggcaacttgtgtcaatgggtcaccaagcttgtggggcactagagctttggaactacccagagtggctcagagacctcgtaccacaggaaatagatggcacagataggcctgatcatgtggatctagctgctcttgaaatttatagagatagagagaggagtgtggctagatacaaccaattcaggagggcattgctgttgatacctatctccaagtgggaagatttaacagatgacaaggaagcaattcaagtattggaagaggtatacggtgatgatgttgaagagcttgatgtgctggtaggccttatggcggagaagaaaataaagggttttgcaatcagtgagacagcttttgtaatattcctactcatggcaaccaggaggttaaaagctgacaggttcttcacaagcaactttaacgaagagacatataccaagaagggactggaatgggtgaacacaactgagagtctgaaagatgttattgatcgtcactaccctgaaatgacacacaagtggttaaactcttcaagtgctttctctgtttgggactcaccaccaaatactcacaatcatatacctctctatcttcgtgttccccactaa

SEQ ID NO: 30819 - DNA, 1359 bp, Glycine max
  Peptide Sequence Number=SeqID_122504
atgaagacatctagtacgatgtttcaggacaggcatcataatcatagcagtggcaaaaaggagagatgtctgagtctgaccttagggaagggtgtgccttttgtcttgacctctctcttaatggcttcaattttcagtttgttcttcctctataatccaaaccctttaaccctcacaccccatcaaggccatgacatgtttgaaaatccctctgatccaaagcaagaagaacatcccatcacaacaacaaaggtttcaccatccaaaccacaaaaggaacagaaaacatgtgacctttctaagggtaactgggtaccagttttgagagggtcatcaacctattacaccaattcaagctgcactacaatccctgatagcaaaaactgtttcaagcaagggagagtggacactgattttctcaattggaaatggaagcctgagcaatgtgatcttccaaggttcgaccccagaaccttcctccacatggttcgtggcaagaaaatggctttcattggtgactctgtggccagaaaccatgtggattccctcctctgcctcttgtcacaggatgaaattccaaaggacatacacaaggactcagaagacaggttccgcaaatggtatttccccatccacgacttcaccctcacgatggtatggagtaggttcctcatagtaggcgaggagagaatggtaaacggcacagtaggcacaagcattttcgacatgcagctcgacaaggtcgacaacgattgggccaacgaacttcccaacctagactacgcaataatctcagccggccattggtttttccgagtgatgcacctccacgaagcaggaaaacaagtaggttgtgtctattgcaaccaaccaaatatcacaagctacaacccagatatcacaataagaaaagcattcagaacagccttcaaacacatcaatgcatgcaaggagtgtggaagaaaaaaaatggtgacagtgttgaggacatttgcaccggcacactttgagaatggggattggaacactggagggtattgcaataggacaagtcctgtgagtgagagtgaggttgattttgggaggtttgattgggaagtgaggggcattcagatggaggagtttgagagagcaaggagtgagggcattattatgggaaaattagggcttcataataggtttgaggtggtggacgttgctagggctatgttgatgaggccagatggccaccctggggagcattgggggaataagtggatgaggggatacaatgattgcactcattggtgcttgcctggtcctattgatgtgtggagtgagttgctgcttgctgttctcaagagggtgaatgagttttga

SEQ ID NO: 30820 - DNA, 255 bp, Glycine max
  Peptide Sequence Number=SeqID_122505
atggaaaagataagtgtcaggattgaaagagtgactcaaaaccaacaacaatcagagcttgctggtgacctttcaaagagctccatgttctcatcaattgatgagtttaacaagttgaaagagttaggtgtgatctgccaccctagaaaagtgcaaattatgcaggtcacttggtaccctcctttcaaggaatggttaagtgtaacacggatggagtggccagaggatccccgggcatggcaggctgtgggatga

SEQ ID NO: 30821 - DNA, 1170 bp, Glycine max
  Peptide Sequence Number=SeqID_122506
atggaaaagatagctgtaaaacgtagaacaacccaagctaagatattgggcagcataatatcaatattaggtgcatttgttgtgactttctacaaaggccaatcgatcatcatagcagataattccccttccattcaacttccacaatcaaatggcattcttacttcagtggatagaaattgggtcattggtggccttctgctcacagcttgcaatatactacttactgtatggttcgtttaccaggttgaaatcttgaaggagttcccggatgaactaactatggtcttcttttacaacttgtgtgcagccattgtagcctcaattataggcttattaggggagaaaaactcaagtgcttggaaaataagaccagatatatcactgatctctattgtttgcactggaatatttaacaagttcctgagtagtgcaatatatgcatggggaatacacttaaagggccctgtatatgtagcaatgttcaagcctctctcaattgttattgcggttgccatgggtgttatgttccttggtgattctctatatgttggaagtataattggagccacaataatatcaattgggttttatactgtgatgtggggcaaagcaactgaacagaaggaagaggaggaggaggaggaaaatgttggtagccaggaatcgtcaattactgagaacattcctcttttgcaaagctatataactgtaaattctacgaagaaaatagatggaaataaaatcttagagaccattttttatcacagaacagcatattgttgtgaaggtcctttggtttcattgttccctgagtggcctagttgttacccctttgcaagacagtgtatggaagattttcagcagtggttcactagatttatggcaatgaatgggaatgcatttagtaaaatttctttgttctatgccttcatcaagaagcaagtcatcagatcagacattgctaaagttattgaatgtgctgcagaaatatctgaagttgctgctggggtagtgcaggacatatatgaagaaaggggttggcaccacagcaaccaccagcaaagctctgcacagaccgaatgcattaatcaaaagatagaagaaaagaccatacaaggaaccaggggggtaaagaaccaaacccttggaagaaaggcgaagctctaa

SEQ ID NO: 30822 - DNA, 2550 bp, Glycine max
  Peptide Sequence Number=SeqID_122507
atgttgttagatgcaaaagcacctcatctttcttcagcaattccgccaactttaccatggaaagtaaatgaactagtccaaccttctgagccactaactcgtcagggtagtggtattaatggcagttttggagattctgaggaactgcgttgtgtaattgctgttattcgtcatggtgatagaactccaaaacagaaggtgaagctaaagattactgaggaaaagctgctgaacttaatgttgaaatacaatggtggccggcctagatctgagacaaaacttaaaagtgctgttcagctgcaagatctgttagatgccacacggatgctggtgcctcgcactagaccagatcgagaaagcgatagtgaggctgaagatgttgagcatgctgaaaagcttcgtcaagttaaagcagttcttgaggagggaggacatttctctggcatctataggaaagttcaactaaagccactaaagtgggtcaaagtgacaaaaggcaatggtgaagttgaagaacaacctgttgaagctcttatggttcttaaatatggtggtgttcttacacatgctggcagaaagcaggcagaagaactgggaagatattttcggaataaaatgtatccaggagaaggtacagggcttcttcgcctccatagtacataccgtcatgatctcaagatttacagctctgatgagggtcgtgtgcaggcattgtttataagcctaatttgtcctttggcatcatatgtgagccattttttcatgacccatattaaacagatgtctgcagctgcttttgccaaaggtcttcttgacctagaggggcagctaactccaatcctggtttcccttgttagcaaggactactccatgttggatgggcttgaaaatgcaagttctgaaatgaaagaagccaaggcttggttgaatgaaattattacatctaatgcaaatacagttgatagcaatggatcacctgaatttccttggatggttgatggagcaggattgccacccaatgcatcagaattacttgccaatttgttcgttactacttgcaatagccagcttgaactgttcccgatgaggaagaacaagagtcgtcaatcgcactcagctgcaaagcaaattatggtgaagggtattacctcagggtcaggtaaatcccaaacatctgctacttctggtctggctggttgcttggatgttgtccaagcaaatcagaatgcacaggataatcttgtaggcaaggtgctggtaaaaaaagcagagacaagttctgcaaaaactgatgatgtcgcacaccaagtgtttgataatttgtcggaatgcagggctgaatctgaatcttccccagaggtttcttgcaccttaggggacaatgattcaactactgatgatgattcatctcactcctatggctctaaaaacccttccaaagattttggaatgaagttctcccttccaccctctgatgatgaagtgttgttggaagaaactgatttacaacccttggaagaggcttggggacatagccttaatggctatgtggctgattgcttcccaggaaagaaagctctgctggattgttgccaaaaatggggagtcaagttttcattctcagttcatgaaagtggttggctggttatgccagccttctttgactttggcaatgaggagctcaacaagatccctgtttgggggtctatttcttttgttagagctttagttgaggttgatgcttctttggagctcatcgatgaagtgcgatttagacttcctacagggaatacttttgtacaaaagattgagtatgaaaatagaccttctttttgcactcactgcaagatgattaggcaccgcctcactaattgtaaaactgtcactgcgaataagtctgctctcatcacaacctcccccaccttggatcagccacaagtgggtgattcagcaatgcccccacataccaatacagcaggcccctctgataatccaaagactgttcagactaatttgtctgtccctcttcacacacagaaaatatgttctgggaacactgagtttggtgatcctatagaagaggggtttgttcagggaggcttccttctgtccaaatctatgatcattgcctcttggaacatcagaggctttaatttgcctctgaagcatcatgctaacgtcatggttgtgttggaaactaagttgaataaggataagatccatctttctgttttggagtcaaatgcccaattgattcattgtgctattgattgtaaaaccactgccaagcgctttcaagtttcattcatctacggtcttcactccattgtggtaagatctctttggataaatctaaatagtaccaatgctaatatgaattgtccctggctcctcattggtgacttcaactccattctgtctctcaccgaccgtttcaataaagctgagcccaatgcttatgagttgcaagattttgttgattgttgttctgacctggggttggggagcatcaactctcatgaccccttgtacacgtggactaatggcagg

SEQ ID NO: 30823 - DNA, 180 bp, Glycine max
  Peptide Sequence Number=SeqID_122508
atgtcattaaggattcttgctatttctcttaagtctggagaatcatcctcatgcatggcagccatcaaaggagtcctgaaattccatcagaaccctaacagagcaaccagaggaggagctctagagagcaccagagacgccaccattgctaacagagaacatttaagcgactacctcgag

SEQ ID NO: 30824 - DNA, 1051 bp, Glycine max
  Peptide Sequence Number=SeqID_122509
tgtcgacaatacattgtgcatgaaagctgaaactgtggacaatgatgtttgtgatttggaaggttcacctgatactgtgtctccaaaaaatcatcagctaaagtttcctttgagttcacagaggacagatgccaactcttggaataggttgagttcttcaattgctgagttgctacattctgacaagtctagctctgtagattctagtcccgaaggattcactacaatgactaggttgcagatatggaaaaatgtcatttcacaagtactggagcagacagaaactgaaatttgttcacttgagaatgaactgaagccactacaatctgaatttggggatggaatgccatgtcacaatgcaaaaacttgtgatatagaatttggaggttatgataaggttactcgtcgtccagaaccatcacaaattgacccttcccatgacgacaacaacatagagaagatgatgcctctttctactaacttgcatggtatgcatgacactaccaaggaaaatgatatcaacaatcctgcaacatcaacattgaaatttctagaagcagaacccttgataaaaatggtatcttctcttagtggtgtcgatgatactttacctaacaccattatttcttccaatagagaaacagcacaaagtgcatgtgcagtatttgagaagttcttgcctaatgaaactagcaaaactataagtaatgttggagttagcagtagttcgctctctcatgttgatgaattcattaaggacaagtttgcagagaaaaaaaggtttgcaggatttaaggagaaagatttaacaattaagcataaaacctttgatcacccgtggaaaaaagatatgtgcttaagatatctgaggaaatgcacccgaacctctcccaacaatctaaaattgcatctcaaagttgccactagttattgtcagaagaacttatcctctactcattatcgctgttttcctttccaacctgcctccaagagaacactcgtcctttttccgaaaaggatttcacagcctgaatcagctgataacagctag

SEQ ID NO: 30825 - DNA, 141 bp, Glycine max
  Peptide Sequence Number=SeqID_122510
atgggttcacactttctgaggaagaggaaacatcctgcgagcataataaggaggaaagaagtctgtttcctattgatagtggcactcccacaggctggcggggaactcccatatggatggctgagaataattcatatatag

SEQ ID NO: 30826 - DNA, 1455 bp, Glycine max
  Peptide Sequence Number=SeqID_122511
atgtttaacaaattagattttgatttcagtaaacctgtagaacctgatcgcctttttgagtgcctaccaaactctctaaggccatcaaattctgggaagcaaagtgaaggcggtggtaaaaaccattctgaaaaacaaagttcagaaacagtcactttcgcacttccaattctcattccaccaagagttatacctttgctacatgatttagcacaacaaatggttcaagctggtcatcaacaacaactctttcgaatttatagagacactcgtgctacagttctggaacaaagtcttagaaaattaggtgtggagaggctgagtaaagatgatgttcaaaaaatgcaatgggaggttttggaggcaaagattggaaattggattcattacatgagaattgctgtcaaattgttgatttccggagagaagaaaatttgtgatcaaatatttgatagtgtggactctttgaaagctcaatgttttgctgaagtcactgctagtagtgtggctatgcttcttagttttggagaggctattgcgaaaagcaagaggtcacctgagaaattatttgttcttttagacatgtatgagataatgagagaacttcaaccagagattgagagactttttgaaagtaaagcatgcattgaaatgcgggacgccgcaatgaatttgacaaaaagattagctcaaacagcccaagaaacctttattgactttgaggaagcagttgaaaaagatgccactaaaactactgttatggatggaactgttcacccactaacaagctatgtgatcaattacgtgaagtttctttatgattatcaatcaactttgaaacaactttttcatgagtttgatcccaatgatccagaaggacaattagcaattgttacaacaaggattatgcaggctctccaaagtaacttggatggaaaatcaaaacaatataaagatccagcattgacgcaattgtttcttatgaacaatatccattacatagtgagatctgtgagaaggtcagaggcaaaggatatgttaggggatgattgggtgcaaatacatagaagaattgttcagcaacatgcaaatcaatataaaaggatctcttgggcaaagattttgcaatgtctcactatcccaggaggggataataatggtggagtctcaagaacaatggttaaagatagattcaaaacctttaacgatcaaattgaggagattcatcaaagacaatctcaatggactgtcccagatagtgaattacgtgaatctcttagattggctgttgctgaagtcttgttacctgcgtatagatctttccttaaacgatttgggcccatgattgaaaacggcaaaaatcctcataagtatatcgtatactctcccgaacatcttgagcaaatgttgggtgagttttttgaaagcaagatttggggtgaacaaaagcgataa

SEQ ID NO: 30827 - DNA, 639 bp, Glycine max
  Peptide Sequence Number=SeqID_122512
atggagttgcacatgattggagaagcatgcttgtgggttacattccccaaagttaaagtgaggctaaaattgggtagtgtccaaaggaatatacctcaccttactcaggttggtcccatgttagttacacattgggagcttagtgggccggttgttcttcggttatctgcttggggtgctcgttttctgttcagttcaggttacaaagatattgttatcatttgggtgcaggcaaacttttttgtggattttatccctgatctgcaattctgcatgagaaagtttgaagtcagttctttctcatcacaagcttcaatatgcgaaactggcattaaatttaataaacaagaagtactcaattcctgtcctcctgaatttggcataacaaaaagattttggagctatgtgttggaacgaaagggtttaaggggagatattctgtgggcttccatttcaaatagttcattgatgtccattgattctttgttaaaggactgcatatttgatgttacaggaaagatactgaatgttgatggggtaactggtggtttcaatttccagaatgcttggtcgggaggatttattgcaggaaccactatcggtggattagcacttggttcttatctaggttcaaagtaa

SEQ ID NO: 30828 - DNA, 330 bp, Glycine max
  Peptide Sequence Number=SeqID_122513
atggggatatcgcaagccatggacgctcttcgacaaagagcagtgtttgtgaaagagtcacttcacaagagtcagaccatcactgataacatggtttccattctcggttcctttgatcatcgcctctccgcactcgaaactgccatgcgtcccactcagataaaaacacattcaattcgtagcgcacatgataatattgacaagactctaaaagcagcagaggggattttgtctcaattcgatcaaacacgaatggggcagagccctggagatcaattaataaccgcgagaaaatgcaataccacttacattcggcataacaacgtttga

SEQ ID NO: 30829 - DNA, 486 bp, Glycine max
  Peptide Sequence Number=SeqID_122514
atggcagcaacaaaactttctagtggcagtagaaccagcaactcaggtatttcccagaaacaaagtacaacccctacacagaaagggttacgttcaaacccaccaaccaaacacggaaggaatgacgaatcggggcctaaaaagggaccaggagcctccggcgagtactacggtggtggtctggtgatgttcggacgatgcatggcagcatatctaaatctactgcatattgtcagaaaaggacaagcattgcagttcaactggttatatgagaaaggagcctttgtctgggattctgaaggcaaagtctctgttgattttaccaagattgaaggagcagttgaaagcctgagcagggagatactcaccatacaagccaatggtgataaagagactgctggtttgcttctcctgaaatactgtgtgttgacagaaccactaaaagttgctctaaaaaatttggaggatattcagatatgggaataa

SEQ ID NO: 30830 - DNA, 285 bp, Glycine max
  Peptide Sequence Number=SeqID_122515
atggtcgtggcgttggccatggtaccttttctaattgaggtactgaatgtggggatggtggctcaggcagaggccgtagaggtgccaattccttattcagctggtccacctagaacctccaacacttgggttaatcccaattctaagtcaacaggctcaggtcataatcagcccagtgccatgctcacaaacttagcctctcatgggactgctccagctggctccacttggataccagattttggaggtagttttcatgttactggtgattctcaaaaacattaa

SEQ ID NO: 30831 - DNA, 660 bp, Glycine max
  Peptide Sequence Number=SeqID_122516
atgtggagaagggggaaaccagtgggacagctaatccaacgaaagcaggtgatgagtcacagtgcgatgacagctggcagccacgtgacaattttaaaaaaaaaggaacgagatgtagacagaattgaagaaatatttacggagcaggtcagtaagggtattagtgggccagctaaagggatgggcctcagtccaaaaaaacagggtttgctaagtcacacccccaacggaaaagaaggcaatatgggcctcaatccagaaaacagcaaggctggaacggaaaatgggtggcaggtgtactcaagactaaggaggggccaaaagaaatcccatttgggcctttacgatccaacatcagaaattgatatgcagggagctaatctacagaatcagtccacacaaaacatggcacaacaagggataattcagaatgctgaccaggttcacaacaatgacacatctgatcacaatggcgatatagttgcaaactcagaatccgaaagtcaacacaatcaagaggcaacttatatatggagcaaggctaaacaattgggggtttcaggagtggaggagcagaaaataatcattgaaaaaatcaatcagatggaagcaagggacaagacagaagcggaaaggaggggagataacataaggagttaa

SEQ ID NO: 30832 - DNA, 933 bp, Glycine max
  Peptide Sequence Number=SeqID_122517
atgcagcaagcagaagagcacctcgacgttctcaccaaaaccggcctcaaaaccggcgtgtccaagcccaggggagacgtgcatcgcgatggcgactaccaccgcgccgtccacgtttggatattcgcggagagcacgcgggaacttctcctccaacggcgcgcctcgtgcaaggactcgtggcccgatctctgggatatttctagtgccggccacatttccgctggtgattcgtccctcacctctgctaggagggagcttgaagaagagttgggtataacccttcctaaggatgcatttgaattgatatttgttttcctccaagagtgtgtcataaatgatggaaaatacataaataatgaatataatgatgtgtatctggtaacaacacttgatccaatacctctggaagcctttgtacttcagcttgttttacatgtgctagaactcagtatgaaggaaactgaggtttctgctgttaaatatatctcttatgaagagtataaaaggttactggccaaagaagattcaggctatgtcccttatgatgttaatggacaatatggtcaactctttgatataattgaaaagagggagaggcacgtgcttagatgttggtttgacaaggtgaagagtggccattacaagtatggatatttctctccaaatataccaaaaacagcaaagaccaaacgtgtacacaaaattcagacattgtcatcttctgaatccttttatgggcaaaccaaatattcatccaacaaaccaactgttatagaatttaggtgggaaagagaaagaaacagaaaaacagagaaagaaagagggaaagagagaagaaacagaatagagaggatagaaggaaagagaagagaaacagagaggtcaaggaaatgtgcactgcaccctgtgattatcattcagtctgtctaa

SEQ ID NO: 30833 - DNA, 810 bp, Glycine max
  Peptide Sequence Number=SeqID_122518
atgggccctccaattttcactcaaagcttcggtttcagagaccccacttggtcagagccatgtttcggtgtggtggtttctgtagaatggcacttgtttaggcataagattgtgtatgaccccgaaggaaggattaacaagttggctgatgaagtggacagggaaactcccctttcaaggcttactttgttctctccttgcaagataaatgttttcttgagaataaccaacaagagggaagatgggtatcatgatttggcatccctttttcatattattaaggcgcttaatctttacaggaagaagactggcagtgacaagtacttttggattcatcttgataaacgggtgcctactggggcagggcttggcggtggaagtagcaacgctgcaactacactatgggcagccaatcaatttagtggctgtcctgcctctgagaaagaactccaagaatggtcaagtgagattggatcagatattcccttctttttctctcagggagcagcctattgcactggtcgaggagaggttgttcagaatattcctccaccagtatctctagatgttccaatggttctcataaagcccccagaagcatgttcaactgccgaagtctacaagactagtaatgttgaacctttaacattgctggagaagatctcaaagattggcatctcacaagatgtttgtattaatgatttagaacctccagcatttgaagttctcccctctctcaaaagactgaagcagcgaattagtgcagctggtcgtggagaatatgatgctgtttttatgtcaggaaggtga

SEQ ID NO: 30834 - DNA, 270 bp, Glycine max
  Peptide Sequence Number=SeqID_122519
atgtcgcaacgtgcccttttgtgggtgagcgaaggcgaggctcatgggtgcgctttccaagggaggaaagatgagcggagtcgccaccaacatttatttgtggaaaacggtgatcattttaaggcgttggaccttaaaaatgatccattttacttgcaaaataggggaggagcttgccacccagctcgcccaggcgagcaaggttgcttttgcttcctccagaagcaacagccttctggaggaagaatctggaaggcccaaggggcctga

SEQ ID NO: 30835 - DNA, 201 bp, Glycine max
  Peptide Sequence Number=SeqID_122520
atggaagaagaaaggcttgtaatgaagatgggtgaaagtgcattgttagcaactgcttgtggggataacaaagatactaagtctcaagctaatcagaaaggaaatggtaaaataccacctccagttggtattaagaaggtgacaaatattttcttctataagaagaagggacacatgaaaaagaattgtcccagattctag

SEQ ID NO: 30836 - DNA, 1392 bp, Glycine max
  Peptide Sequence Number=SeqID_122521
atgggatcgagtcaagcgccttcgcttaaaaagaggttgtatcaagtcaaggtcaagagcctaggaatcaccagtctaaaagagttagggcagttgatgggtcagctccagcgacaagcctttcgcaaagcttatagtaaaatctgggacctagccatggcagagatctccacagaggccattgcctccctcgcccaatattatgatcggccgttgaggtgcttcacctttggggacttccagttatcacccatggtggaagagtttgaagagatcctgggatgccctctagggggaaggaaaccatacctcttctcaggattctatccctctttagctagaatttctaagatagtccaaatcttggcaggcgaatgggccccattcatagacatcctcacgcttttgatcttcagaggagtcctctttccaaatgtggatgggttggtggacctagcggtaatcgacacttttcttgcctttcatgaccgcaaggaaagcccggttgtcgctatcctagccgatctatatgacaccttcgaccgaagatgtgaaaagagtagtacaaggattgtttgctgtactccggccctctacgtatgttacaatcccgttcttgctataagacaactcggctaccctatgagaggggcaccactaaaggaagagctcgcacctattattgcaccaggtttcaataacaccaacgcgaaggcacttcagaaggtccgcaaggcatgggagatggtgcaaaagaaggacaaggaactcagaggcaacagcaacgggcccatcggcggctaccgtaggtggttgaaagcccacatgcaaggtctggattggctcccgagtttgagaaccactaaaggggtggaagttgaagcgccggaggaggacgaagaggtgcaggccctcagggcagaactcgagaaagcccaaacagtcaaagaaaagtttaaatcagaaggtcttaagatccgaaaggagaatgccgaactgagagacgatgagttgaggatttgcctaaggtccaagagaagcttgtctcagcagttgtgcgagaccgagaccaacatgttagccatcatcagcaagtaccaggaagaattaaatctagccacggcccacgagcacaaagtggcagacgattatgcccgaatgtatgcggaaaaggaggctagaggaagggtaattgactcgttacatcaagaggcaacaatgtggatggaccgatttgctcttactttgaacgggagtcaagaacttccccgattacaggccaaggccaaagcaatggcggacacctactctgcccccgaggagatccacagacttctcagctattgtcagcatatgatagccttaatggcccatataattaggaaccgctag

SEQ ID NO: 30837 - DNA, 330 bp, Glycine max
  Peptide Sequence Number=SeqID_122522
atggcatcaaaacctcaagtggggcaaggtgcattagcaggttcaatggatgggtctgtgtcaggccttgaactttgtgttcttgcatttgagctaaagagattctttaaatgggaaggtagaagggcaatactgcctagtgcgagaatctctaatgttgtcttcaagaaatttagcaagaccaattacctagaagttataagggatgggggtagggttgttgataaggcattgtcataccctaatttcgtccaaggactatcattcactgatgttttgattctcgctagccgaactacgttgttcaacaccagttaccgcacaagatga

SEQ ID NO: 30838 - DNA, 411 bp, Glycine max
  Peptide Sequence Number=SeqID_122523
atgtgtactgtcgcaacctaccctaccacgagagtgcgggcgaaaagcaaaaggagcgtcttccaaaaaggaaaatgcgtggaaatcaccattaacgtttattcgaggaaaatgttagagaaaccaaaaagaggcctgggaattttgaaaataatggttcgggagttgtttacgcatggggaagaaaaaaaggcacttaggacaatggcaactcgctcatgcaagttggagcttactcttgaagtagctggctcacccaagcaagctggttacttcaccctgaagtcttttgggggcctaggcgagccagaggcaagcctgggcgagctagggtccaagaaactcaatgaaaagacccttttgcccttcttttttggtatctttcacattcttgatcaaaacattgaatga

SEQ ID NO: 30839 - DNA, 1284 bp, Glycine max
  Peptide Sequence Number=SeqID_122524
atgtctttgaatgagtatgaaattgggtcaaggccaaacgattcatctcctaaaggagttgattctgtgtttgttgatcaccaacaacagaaacaaagagtgcacccttataattattttcgtagcaattcttctttgaaggttgccaagaatcaaggcaaaccaaaagattctacattgaaatcagatggctctagagttgagttagactctgtttcgacaggagaagtgtctacaggtcaagcagatgaaattggagagtacagaaagctgtccctggaccattgtgggattctgccaaatacctgtttgccttgcctcacttccaatgcacttgctgttgaaaaaagaaggccaatgagtcctgatacacctagttcgcggagaaagtcgctttctaaactctccttcaaatggagagaagggtcttcagatatgactttactttcccctaaggcatttaaacaaaaacatttggcaggttcatcgattccattttgtccaatagagaagcaaacccctggttcttggtcacaaattgagccaagttccttcagagtcagaggcaaaaactactttagggataagaagaaagattttgctccgggcagtgctgctttttatcctcttggtgctgacctctttttgtcttctcgaaaaattgatcatattgctcgctttatacaaattccttcaataaacgtacctggggacgtcccttctattcttattgtaaatattcagataccattgtatcctgccactatcttccaaagtgaaaatgatggtgaaggaatgaatgtggttttgtactttaaattatctgaaaaatactctaaagaccttccagaccaattccgggaaagcattagtaaattgatcaatgacgaagtggagagagttaaaggcttccctctagatacaattgcaccctttagggagagattaaaaattttaggcagagtggcaaatttggagaatttatctttaagcacaactgaaaagaagcttatgaatgcttacaacgaaaagccagttctctcacgtcctcagcatgaatttttcttgggagaaaactaccttgagatagatttggatgtacacagatttagctatattgcaagaaagggatttgaaggcttcattgaaagactgaagctatgtaacctggattttggtctgacaattcagggaaacaaggccgaagacttgccagagcatttattatgtgcaatacggttgaataaacttgactacagcaacttcaaccagtttggcttttaa

SEQ ID NO: 30840 - DNA, 153 bp, Glycine max
  Peptide Sequence Number=SeqID_122525
atggctgaagagccaagaagactcaccctggaagattattcaaaatttttctacaacaggggggttcatagaaccaccaagcaatcccctttgaagctcaaagatctagcctccatagaagctcctcaagcaagcttccatcaggatcattag

SEQ ID NO: 30841 - DNA, 510 bp, Glycine max
  Peptide Sequence Number=SeqID_122526
atgaacgaagagtcagtttgggtgatggccagcatcgcaccaacttgggtaagcctaggggcaagtgaaaaggtgatacaagtatcttgtagtatgctttcacatttacatgataacactttctttgtcaaagcattagggcaagtactaacaggtgctaggcccatgatcagatcgatcaccacccagtgcccggctaaagacgttaaagaagcgctcctaggaggcaacctagggggatccagtgcagccccgcaagcgaagattgagtttgatggacactatttccgaagcgaggagcatcaatgccacttcgaagagatcaagagttggtctttcctcaaagagagacgggtccaactaagagaaggggaatacacagaattccaggaggaggtcgccaggaggcagtggacccagctgatagagcctatggctaagtatgaccctaagatagtcatggagttctatgcaaatgcctggcccaccgaagaaggagtcatggattag

SEQ ID NO: 30842 - DNA, 471 bp, Glycine max
  Peptide Sequence Number=SeqID_122527
atgaatttattgcctagcgctgttcatgcatcctccaccaacgagtctggagccccgcgaatttattgcctagcgcttttcgccaattctccattctctacttttatccggagccccgggaatttattgcctagcactgttaatgcatcctccacccatgagtctggagtcccgcgaatttattgcctagcgctgtttgccaattctccattctccacttttatacggagccccatgaatttattgcctagcgctgttcatgcatcgtccacccacgaaactggatccccgcgaatttattgcctagcgctgttcgccaattctccattctccacttttatccggagccccatgaatttattgcctagcgctgttcatgcatcctccacccacgagtctggagccccgcgaaattattgcctagcgctgttcgccaattctccattctccacttttttcggagccccatga

SEQ ID NO: 30843 - DNA, 282 bp, Glycine max
  Peptide Sequence Number=SeqID_122528
atgggcgtagcctcccaaaaggtaacggaggcgtgcaaaggtttcctcgggccagacggagattggccctcgagtgcaaaggcagaagggagcttgactgcaagacccacccgtcgagcagggacgaaagtcggctttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 30844 - DNA, 273 bp, Glycine max
  Peptide Sequence Number=SeqID_122529
atgcctcacctcttggcgaaaaaggcgagaaaagcgtcgatcgctgctaggtccaccaacccatccacatttggaaagaggactcctccgaagatcaacagtgtgagaatttctatgaacggggcccattcgcctctacctgccaagattcttgcttttgcctccaaacattttctcggtattccaaccaccccattttcgacttgctttctgtggtctaattcctgcgccgagatttggactatcttagaaattctagctaatgagggatag

SEQ ID NO: 30845 - DNA, 277 bp, Glycine max
  Peptide Sequence Number=SeqID_122530
atgaggatcaaaaggtcttttaaggttgtaatggggccaaggacaaggtatggagaaatatggaataagtggctaaatcccaaaggaatagaggagcaaaggggagcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaag

SEQ ID NO: 30846 - DNA, 198 bp, Glycine max
  Peptide Sequence Number=SeqID_122531
atggaagagtgggagaaagcaaaaaagaaaggaaaaattctcgatcaaggatcgaaagaaaacagaagaaacatgcagaaaggtcttcggaccagacaatatctgaacaatacagaattgtcaccaagaaatgatttgcaaaatcaagtcatgacatatctatggttcggaattaggataaaacacttacctgtgtga

SEQ ID NO: 30847 - DNA, 276 bp, Glycine max
  Peptide Sequence Number=SeqID_122532
atgatatattacgggcctcaatcggacatgcgagtcaaaactttagcccgtcggaattcacccgagtcttcaatgttaaattttgagcgtcgcgataggttactttcgttattcgaagatccggaggaaaagttaaggccgtttgtatttgcgatgggcttcatttttatcctaagagcatctccagaatattatgagcttcaatcgggaatccgagtcaaacgttatggctgtccgaattgctgggctgtccatttcaactttcgagggccatga

SEQ ID NO: 30848 - DNA, 384 bp, Glycine max
  misc_feature (37)..(37): n is a, c, g, or t
  Peptide Sequence Number=SeqID_122533
atgggtgaagtagaggagatacaagagaagatgaagnccgacatggaggccatgaaagagcaaatggccacaatgatggaggtcatgatgagcatgaagaagataatggaagccaatgcggttatagttgccgctactagcgctgtcgctaaggtgaacccgatgcccccatctggcctcaaccaaatgaatcatcaaacctcaaatatggcacatatctctcaaaccatgggggagacacatgaaattccccaccacaatctagctgacttcgagccttggctcagatatgccactgaagggcaagcagttggtggtataccctttgaaaacactttggagggccctcagtttctgttagacaagtggcctcagatatcttaa

SEQ ID NO: 30849 - DNA, 249 bp, Glycine max
  Peptide Sequence Number=SeqID_122534
atgagaaaggttatgcgaaagaggtatgttcctgtagaagcaaagcttcatggtgaatcaaagaacaattcaagagttcaagataagaatcaagaagaattcaagactcaagaagaaattttagagtcaagaatcaagattcaaggctcaagatctcaagaatcaagatcaagattcaacactcaagattcaagaatcaagagaaggcttaatcaagataagtatgaaaattttttctcaaaaatgtag

SEQ ID NO: 30850 - DNA, 127 bp, Glycine max
  Peptide Sequence Number=SeqID_122535
gtggccatcttggcatacagaggacaactcgcaaggtgcttggctacggtttctattggcccaccatcttcaaggatgcgtggagaatctgtagcacttgatgcaatcctaccctgcaagggcattg

SEQ ID NO: 30851 - DNA, 651 bp, Glycine max
  Peptide Sequence Number=SeqID_122536
atgggtgatcaagaggagacacaggaacagatgaaagccgacatgtcggctctgaaagaacagatggcttccatgatggaggccatgttaggaatgaggcagctcatggagaaaaacgtggccaccgctgccactgtcagttcggctgccgaagcagacccaactctcttggcaactgcgcaccatcctccctcaaacatagtaggacggggaagggacacactggggcataatggcaaccctcatctgggatacaaccgagcggcttacccttatggattgccgcccaactactcaccacccgtcctgcaagacgatgcgggccatattgcttctcccgtccttgaaagggaacctcctcaacagcccgacgaggtccacaaagaccctcaagactatgctcgaagggatgtcgagttctatcccccgatcctcgaagggccggcacccagcacgttgcctcagcccaacatcacgacacaaccaatagttttgtccacggaaggactgcccccggcaactgaagaaaggaggaagctcgatctcctcgaggagagattgagagccgtggaaggatttggggactatccgttcgcagacatgacggatctttgcttagtacccgatgttgttatccccccgaagttcaag

SEQ ID NO: 30852 - DNA, 159 bp, Glycine max
  Peptide Sequence Number=SeqID_122537
atgttgttagactcaacttattttcattctcactatttggagaagccaagaagtggctgcaattcattcaaaggttgtcaacaacctgcccttcggcaagagggcgacgcggggctcgcaggtgtttccctcgctcctacgtatcctcaattgcgatga

SEQ ID NO: 30853 - DNA, 766 bp, Glycine max
  Peptide Sequence Number=SeqID_122538
ggctacatgccctctccttcagaggacctacacgtcctcgccttcagagggctacatgccctcgccttcagagggctacacgtctcgccttcaaagggctgcacgtcctcgccttcaaagggctgcacgtcctcgccttcagagggctacacgtcctcaccttcagagggctacactttctcgccttcagagggctacacttcctcaccttcagagggccgcacgtcctcgcctttagaggctacacgtcctcgcctttagaggctacacatcctcgccttcagagaactacacgtcctcgccttcagaggactacatgtcctcgtcttcagagggctacacgtcctcgctttctgagggctctacatctgcaccttcagagaactcaaggtcctccgcccttaatgcttaatcgaggcttgtgctcctgggtgagggggatcgtgcccgcaagacacccagtggactcgaagaagtccaacagggtcctggggtttccagctctgattacgagcctctgtcagttctatagagtgtctatcacccccagcaaggtcatcaggccccctactaaccgagctttcatcaagaagtattgcgcccccaggcaggcccagggtgagacaccacagcagcctagggatggtcggcagcgggcaacagacgcaccgccgccacctccagagcccctcagctcatctacaaaggctggagcattgcctatgacccgtggccaactagcaagcgaccaagtccaaagccaaag

SEQ ID NO: 30854 - DNA, 350 bp, Glycine max
  Peptide Sequence Number=SeqID_122539
atggtctggtataggcgaaagacaaagatgtttgttgacccagaaaatgcaaagacggctacattgggtgaagttgcggaggcattacaatacatggtgtctcctcaagggaggaaaacatgcacatttgatgatctcgtgccttatgtggaaaaaattacaattttatccgaagagcaagagagagtcactgagccagtgtcacatggtcccgcatcagagcgtcaatttcccgcacaacagtttcacatgcttcagtcaagtattgaaactcaggggatagccagaagaagggacactgttgaagcggaagaatattcccaacaaatggtggagcgtggccatggaat

SEQ ID NO: 30855 - DNA, 213 bp, Glycine max
  Peptide Sequence Number=SeqID_122540
atggaccaccagcagcagggtgcacaacacccaaggggtgcaaaccacccaacagttatgacccacccaaggggtgcaaaccacctaatagttatgacccacccaaagggtgtaaaccacccaatagttaggattcacccaaagggtgcaaggtcagaagatgtgaatcaaagggacatgacccttgggaacagtcacaaccaactgttatga

SEQ ID NO: 30856 - DNA, 355 bp, Glycine max
  Peptide Sequence Number=SeqID_122541
gaataatcgacatgaaaatacaaaaaaagcaccactcattcagttggtgaggaaccatgttacctcatgggaagatgcccaggaaatgggttttcagaccttaccttactccaacataccaaacaccactaatatatatgtttttattctttttacatgtgttgagggaagaagccttgagtttcaagaacctatggatttgaggtcaaatccttttcaaggggtagggaatgatgcaatcctaccgcccccaaaggcattggatagaagactccaagaagattgggccagagatgcaaaagaagaccctagggttctcatgagccttagggtagattttgagcccatgagctaa

SEQ ID NO: 30857 - DNA, 210 bp, Glycine max
  Peptide Sequence Number=SeqID_122542
atgaatttaacttctcaaactgttagtttttcggatattcaatgtaatgttctcgaactcaaaggagataactataagatatggaaggagagaattcttctacaattggggtggatggacatagactatgctataaggaaagacgaaccacttgcaatcactgatgaaagtagcccaactgatgttgcgctatatgagcggtgggagtga

SEQ ID NO: 30858 - DNA, 194 bp, Glycine max
  misc_feature (182)..(182): n is a, c, g, or t
  Peptide Sequence Number=SeqID_122543
atgtacgatttcgaagaggtcttcatgctttatgtagagtgggaagtttggattaaagaccccgaacacggggacatcccatgtaacttggtaaggcctcaagaaaagctctgggatgatcaatgtcatcagataaagcagattatcgacctctggatctgggttttgaggtggtttttccnggagacacaacc

SEQ ID NO: 30859 - DNA, 285 bp, Glycine max
  Peptide Sequence Number=SeqID_122544
atgaccacatttaaggttcccaacgaaacactcactatactacggaagtttggtaacctattggaggctcccaacacacttccaatgaaaggcctttttgttacaaaacttgaaagtaatgaagtgcttcttagtccaatagatcttaaggtggttggccccttgcttcttgactcaaattcttcaagggatggcaccaatcgtcctttccaattccctatatggcaactcccaaaaaaggaaacaaagagacaagcaataaccaaagaccaaaaaatgaaatga

SEQ ID NO: 30860 - DNA, 642 bp, Glycine max
  Peptide Sequence Number=SeqID_122545
atggtgggatggtgggtcaactgcccattttttaaaacttatttgaaggttacaagcactggaatatctcaacctctatcaggatgtgttgatggcatcatcgaccctccatcccccgtcagacgccacgattcctttgaggagcaggcgtcacaaggatccttcgtcccccatcgacgtcaggatgttctcactattgctattggatgtccagagcaccctggacgtgtccatgttgctggagccggtgtcaccatcatgaaatactttagatcggctccacggatgtcccgcaactcttcctcgttgcctcttgaagaattgcatcagctgacccagcaaatcagggaccaactagaggagttgatcacagaaaaagtgactcgacagcttatgacatcattcagccagatgcagtcccactttcggtcccagatgcaatctcagggacttgcactgcctccggagcctctggttggttcctcaggtcctcgagtaagcacaattgagagttgtgttgatccctcaggaaacgatcctgagacgggtgactcagacaggtgcggcttatacatcgaagcaaaggtgggtgtggaggaggttaaagatccagatgttcccgttcctgtatccactgatgag

SEQ ID NO: 30861 - DNA, 825 bp, Glycine max
  Peptide Sequence Number=SeqID_122546
atggcagaggtctccaccgaggccattgcctccctcgtccaatattatgaccaactgttgaggtgctttacctttggggactcccagttatcacccacggtggaagagtttgaagaaatcctgggatgccctctgggagaaaggaaaccatacctcttctcaggattctatccctctttagctagaatttttaagatagtccaaatcttgacgcaggaattagaccaccgaaagcaagtcgaaaatggggtggttggagtaccgaggaaatgtttggaagcaaaagcaagagtcttggcaggtaaaggtgaatgggcccttttcatagacatcctcgcacttttgatcttcggaggagtcctctttccaaatatggatgggttagtggaccaggcagcgattgacgcttttctcgcctttcatgaccgcaaggaaagcccggtagtcgctatcttagccgatctatatgacaccttcgaccgaagatgtgaaaagaacagtacaaggattgtttgctgtactccggccctctatgccaccgctaatgcacagaaaaaagaggcaagttgggaccgactcttagcaagcaaagaaggagcgtctatcaactggttcccccgatggaaagaaggaagaatcgagattcttatttcatgcggaggatttccaaatgttcccttgatggggacaaggggttgcatcaattacaatcccgtcctcactataagacaacttggctaccctatgaggggggcaccactagaggaagacctcacacttattattgcacgaggtttcaatggcaccaacgcggaggcactttag

SEQ ID NO: 30862 - DNA, 429 bp, Glycine max
  Peptide Sequence Number=SeqID_122547
atgggtgaagtagaggaggtgcaaaagcagatgaaggccgacatggaggccatgaaagagcaaatggccacaatgatggaggccatgatgagcatgaagaagataatgaaagccaatgcagttgcagttgccacttccagcgctgttgctaaggtgaacccgatgcccccatctggcctcaaccaaatgaatcatccaacctcagctatggtaggcaaagatttgggaagtacgagaagcccctattatgtgcaaattcaaaacaagcacgccttcctaccatatggcttgcctcccaagtatacaccagccaatgtggcatacactcccagtgaggatgtcaataactttgctcccatacttattgaaagccgacaagctcaaactgattcatgcacatgtctctcaaccaatgggggagacacatga

SEQ ID NO: 30863 - DNA, 219 bp, Glycine max
  Peptide Sequence Number=SeqID_122548
atgcctataggttgcacctcccagaagagtggagctgatattgaggaggaggaactaacagatttgaggacaaatcctcttcaagggggaggggatgatgcaatcctcccaaggaagggaccagtcactagagccatgagcaagaggctccaagaggattgggctagagctgctgaagaaggccttagggttctcatgaacctcaggataggtctctga

SEQ ID NO: 30864 - DNA, 408 bp, Glycine max
  Peptide Sequence Number=SeqID_122549
atgtcagcatatgagcataatgacacagcgcctcaggatgtagaaacgagccctttgctctttgaccagcctagcacactttctagcaaaagcacacttcctctgagtggaagaagaagaagaattcttcatgagagaggaagaagaagtttgttgagatacattcaaaaagaattctatcaggggggtatcattgatggttcatggactaacaacccacacaaggtgaaggaagaggtgaaatcctttttcttccataggttccaagaaccaattggtcagcgacccaagattgatggaatcaggtttcaaactgttaatcaacagcagaataacgagcttgtggcacctttcatggatgaagaaatcagaaggcaatttttaaagctgcggcgaagttttttatga

SEQ ID NO: 30865 - DNA, 250 bp, Glycine max
  Peptide Sequence Number=SeqID_122550
gctgtcgtctcttgtgacggacgtgtggggtgctaataccttccccgtgcgtaaatacaactcccaaacctttcacttaaagttcgtagactacgtcttttccagtttttccgacgttccctcaaataaacgttggtggcgactccgcgcgcattcctttcttggaagatgcacccgcgagtcacacgttgccctcccgccgaagggtgggttgcgacagttggcgactccactggggactgttttttag

SEQ ID NO: 30866 - DNA, 366 bp, Glycine max
  Peptide Sequence Number=SeqID_122551
gatataagagagcttcctaataggtggcatgtcccatttgtgcttttccaatctagtttgcaccctgcaaaatcagaatctgaaaagccgggtagatttcgagcccatgggctaagtatgagcccgcttatctttgtaaatattagaataggttatgaagcttgcttgtggggcttctatggaggctggatctttgagcttcaatggggtcctttaatggtgattttccaccatggagatgcagcgaaagacaaaggaaaagagcttggagaggatgcttcaatggaggaaaagaaagaggaagagaaagagagaggggggagcacgaaattgaaggaagaaaaagggagagaagttgaactttga

SEQ ID NO: 30867 - DNA, 1224 bp, Glycine max
  Peptide Sequence Number=SeqID_122552
atggcgagccaagagaagtggggcccgtttacggatatactagctctgttgatctttggggttgtcctctttccaaatgtggacggtttggtggacttggccgcaattgatgctttccttgcatatcaccatagcaaggagagtttagtggtggctatcttggcggacttatttgatacctttgaccaaaggtgcgagaaaaacagtgcgcggattgtatgttgcttacccgctctctgtgtgtggttggtttcgcacctattccaaccagacataagacatccgtgtctgctccaaagttatcgctcgtgtgtcgaaaaaagaatagtcgattgggaccgacacttggctgggatagggggcagcgcaatcaattggttttctcgatggaaggaaggcaaggagggagttcttttctcgtgtggggactaccctaatgttccgttgataaggacgaggggttgtattaactataatcccgcacttgccataagacagctagggtaccccatgaggggagcgccaacagaagaaagtcgctcgcctttccttctgagggatctaggcgcgcaaagtctcaaggtgatacaaagagtccacaaggcatggagaagtccgttgaggaaagacaaagagcttagaggcatccgtaatggcgtcattggtggttatcatggatggctaagagttcacatgcgagggttagattggctctctaaatggaaagttatcgatgaggagaacttcgaagctccggaggaagatgaagaagtccaagctctaaaactagagctagggaaggcaagactcgccaaagaaaaattcaagtcagctgctacacatatccggagggagtgcaccgagttacgagaggaaaacgcgaccactgcaagagcccttgaacaagaaaccaaaagggcccgcaaggaggaacatggccgagggaaattccgaggagctttgtggggtagcaacaatgagctcaagcttcgaagagaggaaagagaccggtcatgggtgcatggcatgatcttaaaagaagagttagctgctagcgcaaggtccaagaggagtttggctcaacacttggatgccatggagcaaagcatgctagctatcatagggcagtacaaggaagagttgaaccagtctgtgacccatgaacaaaagctagtggaggattttgcacaattgtacgccgaaaagaagcaagagggagggtga

SEQ ID NO: 30868 - DNA, 372 bp, Glycine max
  Peptide Sequence Number=SeqID_122553
atggaggtatcattgaagccggaacagatttctaacttaaaagagtttgtcaatcatctatcattaacaactcattcttcagtgcccggatcacaggtgatatggtatgacagtgtcactattaacggtgatctatggtggcaaaatgaactaaatgagcataataagcctttctttgatatatgtgatgggatatttacaaattattcatggcaggaagactatccaaggcggtctgctgctgttgctggtgatcgaaagtttgatgtgtacatggggattgatgtatttggaagaaacacatatggtggtggaatgtggaatattttacagaagtgtatgcaatctgttcttcaaagtgcttcattctga

SEQ ID NO: 30869 - DNA, 369 bp, Glycine max
  Peptide Sequence Number=SeqID_122554
atgttgctaagtagcaatgtcatctatatctgtgtaagagtggtcatgttggtgcgcatggtccgcactcttctctttgcagcggcacgggtgaaatcttgccccagtatgcatagtagctgtgtgatagcctccctctctggttgtgctcgcacagttggcccttctccaatatcagggggtggcccaggaaccgttaaaatgaggacgcgtagtcctctaaaggcgagggcgtgtagtcctctgaagttcaggacgtgtcgcctttcgacggcgagggagtgtagtcctatgatggcaaggacgtgcaatcctctaaaggtgagggcatgcccccctttgaaaatggggaaccatgtagtcctctga

SEQ ID NO: 30870 - DNA, 250 bp, Glycine max
  Peptide Sequence Number=SeqID_122555
ggttcggcaactgttcacgacatccctttgtgccatgatcaagtcaaggttgctcttgaggaagttacagatgcagatgctcccattcctgtacccactgaagaggttcagttagtgggacaaacacttaataccttcgttgcttgggagacacatcttgttatgtgggatgttgccgtgtttggggtgtttaatgataaccttcacttgtacataaagcatgaagatctatttgaaatagcacatggtg

SEQ ID NO: 30871 - DNA, 139 bp, Glycine max
  misc_feature (63)..(63): n is a, c, g, or t
  Peptide Sequence Number=SeqID_122556
aggaaacactgggtccaacaaagataggagaaaatcactcaaagtgtatcaatctcacacagnggcaaggtttatggtgagttgggactttggctcaaggcttgtagaacggatggacatgatatacgtcagagcgttg

SEQ ID NO: 30872 - DNA, 246 bp, Glycine max
  Peptide Sequence Number=SeqID_122557
atgaaggcccaagtggagaaagatgaaggcccagaggcagaggcactatcaagacaattaatgttgctgaaggcccaaactaatttgaaggcccaaacttatcaaggtaatccttgtggcgtctaccctgacttatcttccttcactggaagtggcgtctaccgtgacttatcttccttcaccggaagtggcgtctaccctgacttatcttccttcatcggaagtggcgtcatccaaactctataa

SEQ ID NO: 30873 - DNA, 518 bp, Glycine max
  Peptide Sequence Number=SeqID_122558
atgcttgatgcccttaaatacaaggtccaacatttgatggaaatgctggacattggcaatgccttcccacttaagagcgagttcgcccaatgtgagaatcggcaacttcgcggcactcgccgagatctgggcgcccgtggatccactcagtgggagttgtgccctctactccaccataaagtggggtcgatgaagtcaggcagtgaaggaaaagacatcttggtgagctgcccatcctctatgccttatgcggaagccgcagaggaatccgcagcttcgcagaagcccggacacccctcagcagctaaacctgttcctttcccataccaaagtagccacgcagtaccatggagatatacacctccgagggggaaggaagaagaagtcaccgacgtcagctcgttgtcagctaaagtaacaaatatcatgggactgagtggtgtgacctgtagtggtcgtgtgttcgcgcctccggacctaccagtccaacccgcggacgtcaagggaaaaggaaaagt

SEQ ID NO: 30874 - DNA, 525 bp, Glycine max
  Peptide Sequence Number=SeqID_122559
atgaatactatatgggtagcaacaggaattcttgggcacgtaatcgaagatattcaggaggaacagactggttccagcccgataccgtcaagaatttcgtacgattgcatgggaacagcttctctgattccttttattgaacataatgatgccaatcgagctttaatgagttctaatatgcaacgtcaagcagttccgctttctcagtccgaagataatgcattgttggaactggattggaacgccaagctatactttagatcagggtttccctgcaaaggaaactttataaactactacaggcggtatagagttatttgtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaataccttaa

SEQ ID NO: 30875 - DNA, 917 bp, Glycine max
  Peptide Sequence Number=SeqID_122560
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgggtgggaggcaagggaacagttacagaggcccaggagtgggaaccatctgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 30876 - DNA, 252 bp, Glycine max
  Peptide Sequence Number=SeqID_122561
atggaccttttcaggtttcgcaagatgatcaatatcaatgcctgtaggttgatctcgcagaagagtatggagttagctggacttttaccgttgagatttaattccttctggggaagggatgatgcaatccttcctaggaagggaccagtcactagagccactagagccatgagcaaaaggctccaagaggattcaactagagctgctaaagaaggccttagggttctcatgaacctcagggtagatttctga

SEQ ID NO: 30877 - DNA, 110 bp, Glycine max
  Peptide Sequence Number=SeqID_122562
atggatacctcagtgccctacattggggcaatgaaaggcaccatgcataaacctcaagcgaacctagggacggatcataaattctcacccaataggttccctgcgacaag

SEQ ID NO: 30878 - DNA, 585 bp, Glycine max
  Peptide Sequence Number=SeqID_122563
atgagtttcatagtggggcaggcacttcacaccttccttgcttggccgacacatctggtagttgtgttttcggcaaaaccacctccaaagcccgatccggaggtcgatgatccactttatcttatgacattgaccatcccagagcttttcttgaggccttaccaggttacatgggatgccaccgtgttcgaggtctttaatccagattttctgctctacataaagcacgaagacctcttggaaatcgcacacggtggtcaatgtctcgcatatcagcatctgactgatacaagtatgcaagcggggaattctgatatctatggattcctcgagccacagtccattcagaggtctgggcaatcacaatttgagtctgaaagttacataaagacttggatgcagagttcaaaatgtgatgtctatcttggagcctacctaaacgggtcaaacaactaccttaaggggattactaacagcctaaatcaaaggctcctgctaggtggattgtcgtcaagtgtaatagacaaaaaggaagtactgagtgcggctactatgtcatgcactggatgtccaccatcattttag

SEQ ID NO: 30879 - DNA, 148 bp, Glycine max
  Peptide Sequence Number=SeqID_122564
atgatgcaatcctaccccgcaagggcattggctagaagactccaagtagattgggctagagatccaaggaaaggccctagggttctcatgagccttaggctaagctctagcttctcatctcaaggaggtgagcttagctattacagag

SEQ ID NO: 30880 - DNA, 645 bp, Glycine max
  Peptide Sequence Number=SeqID_122565
atggcgatcgatgagctgcgggctgaaagcggcgatcggagcctgcaatttatcgccgtacgcctgccctatggcatccaggccgatgagcaggattgccaggatgccatcgaatttatccagcctgaccgtgtgctgaccgtcaatatcaaaggcgcggtgctggccagcgagcaggcgttgcgtgaagcgggtattgagctgagcgactttgttcgcggcaacgagaaagcccgtgagcgaatgaaagcgcaatacagtatcgccggcatgaccaaaggcgtggtcgtgggaacagaccatgccgcagaagcgatcaccggcttctttaccaaatacggcgatggcggtaccgacattaacccgatcttccgtctcaataaacgtcagggcaaacaactactggcgcagttgggctgtcctgagcacctttatatgaagcagccgaccgccgacctcgaagatgaccgcccttctctgccggatgaagtcgcgctgggcgtaacctacgaaaatattgatgactatctggaaggcaaaacgctggatgagaacatcgccaaaaccatcgaaggctggtatctgaaaaccgagcataagcgccgcccgccaatcaccgtcttcgacgatttctggaagaagtaa

SEQ ID NO: 30881 - DNA, 297 bp, Glycine max
  Peptide Sequence Number=SeqID_122566
atggacaatggctcttccctcaacatcatgcccaaggctactttggacaaactgcctttcaatgcatcacacttaagatcgagctccatggtagtgcagtctttcaatgacagtcaccgggataagttgaaattcatggtggagggacaactaattatagtttcgggagaagaagacatacttgaaagttgcccatcttccacgccttatgtggaggctgcaaaggagtcattggaaacatccttccagggactggatgttgtgagcaatgcttacgtggagtctcccccagtgtaa

SEQ ID NO: 30882 - DNA, 150 bp, Glycine max
  Peptide Sequence Number=SeqID_122567
atggaggtggttgccgcccagaggcttcttgaggaagattgcagagcatacccttgtacaaacaaaggacgtcgagtcctacgaagcacaggggaaaaagatattgaagtttttgaggtgaagacattgttgtcttccaaatgcaaatga

SEQ ID NO: 30883 - DNA, 108 bp, Glycine max
  Peptide Sequence Number=SeqID_122568
atggcggtttccaaactcagaatgatgcaaaggttttgggagtatagcaggagaaggagaatgggatttttccgaagctacttggactacaaggctcaaaacgcacta

SEQ ID NO: 30884 - DNA, 440 bp, Glycine max
  Peptide Sequence Number=SeqID_122569
aagatggggtagaaggagctactaaggtacgcgctaaagaaggagctgcagatgtggaaggagcctcacctggccttgccctcgctctcctagcccctctaatagccaagttaatgatcgagctcaagcgttcgaagactaggctgtcagaagcaacccctctggacctacatagtgtagaagcaaagcttcatgatgaatcaagattgattcaaagatgttttgatgataataaagatgatgacaaaggtgatgacaaaaaactcaaaggtcaatcaaagaatgagttcaagatgttcaagatagaatcaagaacacttcaagatccaagaggaaagttgaagaatacttcaagattcaagaggaaagttgatttcaagaatcaagaatcaagctttcaagaatcaagatcaagattcaagaatcaagagaaggcttaa

SEQ ID NO: 30885 - DNA, 249 bp, Glycine max
  Peptide Sequence Number=SeqID_122570
atggctatggggaatttcatcagcagactctccttccctgaggcggcgggcccgatgacacgcagagacaaaatttggtcattctgcacccttgtgtcatctagaggcggcgggcccgatgacacgcggagataccttacggttatccgcacccttttgtcatccagaggcggcgggcccgatgacacgcagagacaaaatttggtcattctgcacccttgtgtcatccagaggccggagctccgatga

SEQ ID NO: 30886 - DNA, 270 bp, Glycine max
  Peptide Sequence Number=SeqID_122571
atggagggctcattacttcaactagtcccatgttcttcaaatggatctcttagttgttgcgagggttgcccaaaggcaatatataaggcatacccagtaaaacttacaaatttgatcgtggagatttctttgtttctgtatttccggaatatgagtgtgcggcttgttttaatggatcctattgaaagtacagaacataaaaaaggatctagtcatcttttgatagagatttttatcccgtcagatatttatttccatatcgagaactag

SEQ ID NO: 30887 - DNA, 405 bp, Glycine max
  Peptide Sequence Number=SeqID_122572
atgatgagaatcatgaaactggccaaatacaggctaaagacccaagtggagaaggacgaaggcccaagtggagaaggacaaagcccccaagtggagaaggatgaaggcccagaggcagagacactatcaagactattaattacttatcaaggtaatccttgtggcgtctacccagacttatcttccttcaccggaagtggcgtctacccagacttatcttccttcactggaagtggcgtctaccctgacttatcttccttcattggaagtggcgtctacccagacttatcttccttcaccggaagtggcgtctatcctgacttatcttccttcaccggaagtggcgtcatccaaaccttcgtaacctgtatcaagcgatccaccccgtatggttcacatcactag

SEQ ID NO: 30888 - DNA, 774 bp, Glycine max
  Peptide Sequence Number=SeqID_122573
atgccaaaggtgaagcgttttagaaatccacaaaaatcagcacctcaaccacaatgtccctcaccaagtgattccacacaagctcctgaagtcccaactggtaatgtccctctttctcatgaatcaacatctgaagttccagcaatgaatcctgaaatttcttccccaccaagtgattccacacaagctcctgaagtcccaactggtaatgtccctctttctcatgtatcaacatctgaagatccacaagaagatgaaacaactagacgtcatgttgggcgtgagtctacacactgttggactgttgaggcaatagactctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaaccctagcagctgattgcaaattatttcctatggattatgatagatggtctggatcttcaggcgtacctaaagcttattttgatgattgctttgaaacaattttaaagattaatgaagctggtgcaaaatggtattacaaattgagtatgagaagaaaatgggctacaaataggcaaagcttatggaatgaattcaacgatccaaccaaaacaagagatgaaatcataaaaaatgtgccgataggcatagataaagatcaatgggctcgttttgttcattatcgtcataaaccatcaacattgctaattatatga

SEQ ID NO: 30889 - DNA, 267 bp, Glycine max
  Peptide Sequence Number=SeqID_122574
atgaagcacttcactgacaccctcatcagtgccaacatacccgggggatccactagttctagagcggccgccaccgcgggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30890 - DNA, 521 bp, Glycine max
  Peptide Sequence Number=SeqID_122575
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccctattgccgccgcaccattttacacaggaacattgattaaaagatgtatggacaagaattcgaacattagaacctaccctgatataggtgaacttgcatttggaaagacaggaaggctaatagtatcagtgtccatgtacaccgagctctacttagtttcgatagggttcttgattctggaagtcgggaaacctgtcgtgccagctgcattaatgaatcggccaacgcgcggggagaggcggtttgcgtattgggcgctcttccgcttcctcgctcactga

SEQ ID NO: 30891 - DNA, 267 bp, Glycine max
  Peptide Sequence Number=SeqID_122576
atgtcaaagaagaatcaaacaaggccgcttcaaaggataaacatttgcttcaagattgcttcaacaaacaaagctttatttcaagattcactacagatcaagccttgcctcaaaacaaagggtttcaaagtcatgcaaggctctggtaatcgattaccagaagggaagaatgaaaaagagctgttgaaaaaggttttgaatttgaattttgaacatgtaatcgattaccatatgtctgtaatcgattaccagcaacgaaactcctga

SEQ ID NO: 30892 - DNA, 294 bp, Glycine max
  Peptide Sequence Number=SeqID_122577
atggcacactttatacccttccaacaaggtaggaaattaggatgcttcccagcagcttctcaaaagctctttattcctagggaagttgtgagactctacacggtttcccttcatggaccattgtgtcaagaagagatgctaagttccttagccacttctggaaaaccttatgggctgaagataggaacaaactttcttttctctaccacttcaaagaagaagctcactagagtgaaaaacttcatggtgccaccctcaactaccccacctatgataaagagctttatgccttaa

SEQ ID NO: 30893 - DNA, 482 bp, Glycine max
  Peptide Sequence Number=SeqID_122578
catcaggaggtccgggacttccacatcaaatcatgctattccggtctcttgcgctggggcctgttgctgtttattaccgaccggagagggtcgtgcggcagtttggctacacgcagaccattcctgctcctcctatcgattcatgggtctcgtatgataatatacacaacaggtggatgcactacgaggatcatatcgtaccagcaggtgaggtgtgcgttgtgtcaggggcatgtttcagtgactacatcgactggttcttccgcatctctcatcctttcatgacaccaggccacacattagatcctctgcctcatggtcacgccccgcagccccgagtcgtccctcaggccccgcagacggatatccctcacgtgccggagccaggagcatcgtccacatctgcggaggagcctagacatgcagtggaagtttgtgatgacattgctaagaggtcggagtgccatctgagtctaggggtg

SEQ ID NO: 30894 - DNA, 483 bp, Glycine max
  Peptide Sequence Number=SeqID_122579
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccggtccagatcattcatcttaaatgaagtcattccacatggagttgtggtattgaaggatccagccacaaagaggacagagactgtgaatggcagcagaatcaaacactacttgggtggtgatgttgaaaggctcaccactattgtccaattgtag

SEQ ID NO: 30895 - DNA, 504 bp, Glycine max
  Peptide Sequence Number=SeqID_122580
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccacgggtccatgtggatcctacgatcgggaaggtcgacagtccccacagtaagaagttaagaacatatttggagattgtcgcttattataaggtcgatgtcatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 30896 - DNA, 666 bp, Glycine max
  Peptide Sequence Number=SeqID_122581
atgattatgaggggtcaagacatttatattagccaagatgaggctactacttcaccttcctctagtgaaagtgaagaagcaaaaggggaagaatctagtgaagaaatctacccccaagaagaaggacaaccattagtggttaaagagaagtgtaaggaggtaagtgtctcctccaagaatttagctaagaaggaaactcattttacaataaagacaaacattaaagaaactttccctcttagacaacctccacattttctcttttgtaaaaagacacttgctagcattgccacacctcttgggcttaagtttattcctcaagtaaagaagttgttggatgagggtttggttcgcaagagcttaaatctttgtgctttgttggtgcccaaaataggtattattaggcaccaagtccctaaaataggtggtatgatgaatgttttgagtgctgcaatcctcttttgtaaaatcactcgtacacctaacatctcatgtgatcaaggggttcccatgaaccctaagagaataaaggtcattcctgagtggctcactccaccaagtgtcgagggaaggaacccagagtatgaagaacctcgggatttgaggtcaaatcatttccaaggtggagggaatgatgcaatcctaccccgcaagggcattggatag

SEQ ID NO: 30897 - DNA, 240 bp, Glycine max
  Peptide Sequence Number=SeqID_122582
atggtgtttttcctaagctacacgaaggcaaaggctgaaaacgctcaagtgaggaatggtctcggacatggaaacatcgcgcacactcaagacatcttctcgaagatcccaacggtcagatcgtggacaagtgtcttgcgaagctgcagaccaaattttgagaagattcaacggttaacgaaggctgggaagcatttttaccgaggcagctcatgtagcttcctcaagaagcttcattaa

SEQ ID NO: 30898 - DNA, 462 bp, Glycine max
  Peptide Sequence Number=SeqID_122583
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgcttgtggttggtggtgttgggtgtttgacgcagtgcttgtggttgggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 30899 - DNA, 108 bp, Glycine max
  Peptide Sequence Number=SeqID_122584
atggaatattttaacgatcctagaccattggagctagagagattaaaggcgttgcggatccgtgggcacagtattatctccgagttagtgatcagacctagcatttag

SEQ ID NO: 30900 - DNA, 355 bp, Glycine max
  Peptide Sequence Number=SeqID_122585
gtttgatggactccaaacctatgttggtgagaggtttgatgctttggaacaacaagtggacatgcgattcaatgcaatggactcaaggatcacaaaggttgaagaagacgtcaccatcattcgcgactgccttgatttacctccaccaccaccatcagattgtcatcatcaaaaagggggagattgtggaagttgtcataccttaatttcgtctggggaccatccgttgttgggatgcgaccctcgtttgaccactttgaggaacttggcacccatcgttaggcaattcgtgaagttccgtgacatgccagaagtcaaaagaaagcattgtagcacaatccgtgaagttccgtga

SEQ ID NO: 30901 - DNA, 373 bp, Glycine max
  Peptide Sequence Number=SeqID_122586
gtcgactctagaggatcccctcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 30902 - DNA, 258 bp, Glycine max
  Peptide Sequence Number=SeqID_122587
atggacgctttctctccttccagtgatcttttcagcactttgttagaactgtttctccaaggatgtcacaatgcgttagtggagcaggcttcacatgtatccaggtcaactccttcttttccttcatgtgtcattggacacgaacgctcaggcagtgcaagtcatgaattgtcaagaatgttcgtgaacatcgatggctccgtgctgtttttggcaggaacaaattctgtcatggttgttctgccagcagatttatga

SEQ ID NO: 30903 - DNA, 534 bp, Glycine max
  Peptide Sequence Number=SeqID_122588
atgactactctgactcaaatttggatgacttttctactcagcagcatccttctgagtgaccacaactctgatctcacactgcccaaaagccagctggtctacagcattatgacgcagatcagtgtccacgtggcacaactcatcttagatttcatccatcaatttgtaggcattgcacctcctaggaacccagtggacccagaaaattccaacaaagcactgggatttcctatattgattacaggtctctgccaattctacagagtaacggtcacgccgatgaagctcatccggcctcccattaataggtcattcattgaaaaatattgcatgccaaggcaggatcctaacccttacccttggcctactcccgagcagttcagagccactgtggcatggcctggagataggcctaattttcaagagaaggcaggacctgtagatgctcaaggagctgcccaaggagacgaaggtggagctgaggatgatggagacatggcagatctgcttgattacttcattagaggagactga

SEQ ID NO: 30904 - DNA, 636 bp, Glycine max
  Peptide Sequence Number=SeqID_122589
atgggtaaagcagaggaggtgcaagagaaggtgaaggccgacatggaggccatgaaagagaaaatggccgcaatgatggaggccatgattagcgtgaataagataatggaagccaatgcagttgcaattgccgctaccagcgttgttgctaaggtgaacccgacgtccccatccggcatcaaccaaatgaatcatccaacctcagatatggtaggcaaagatttgggaagtacgggcggcccccatgatgtgcaaattcaaaacgagcacgccttctcaccatatggcttgcctctcaactatacgccacccaatgtggcgtacactcccaataagaatgtcaataactccactcctatacccattgggagccaacaaccccaaactgatcatgcacatggcaagcagttggtggtatacccctacaaaaccctttggaaggccctcagtatcacccacaactacacctcttgcattccacaaacaagtaaaaaccctcatgctatggcagaaatgggaaagttggatcatctaaaggaaaggctcagggccattgaaggaggtgaagattatgcctttgctaacctagaagagttgttcctagtactcaatatcatcacccctcccaagttcaag

SEQ ID NO: 30905 - DNA, 114 bp, Glycine max
  Peptide Sequence Number=SeqID_122590
atggcgttctttcctcttagaagtcaaccaccgggagatccttcggtgcatcgcataatttgtatcggtcacgtctatgacaatcgttttgttcagttgtatacgatgagttaa

SEQ ID NO: 30906 - DNA, 348 bp, Glycine max
  Peptide Sequence Number=SeqID_122591
atggccacatcacaagatggaaatggttgtgttctacctctagcattcgccgtagtcgaaggctacactccttacaagcatacatttgatcaaaatttagaaaaatttcatcaattgagtccagtcatagcaacacggattgataaagaaggacatagatatggtcacatgacaatcaacctctcagaatgtgtaaataaggtattgaaggattgtcgcaacataccgataacaacattggtgaaatcaacatatagtaggtgtcgaaagtactttgttgatcgtggtcggcaagcccaaagacaattaaatgaaggacaagtatattgttctaaggttgttaaataa

SEQ ID NO: 30907 - DNA, 348 bp, Glycine max
  Peptide Sequence Number=SeqID_122592
atgaaaagccttgaggcacaccttttaattgcatgtagtggttatgggacgctttgtgttgctatcgtagttagatctctcgtgaaagagtctacccctttccttttatttctttggagatggagtgccttgagggagcttgggagaccctcgaaggaagaccctgaggaggacccagaggagctacctcctgagcctgttgtggatgctcttgactttctagagcgtgatgaggacccactccctgaggaggattctcccgaggacgtcatgtcggcatctgaggcagactctatggaggagagtggccctagagagatggcgactagtggaggctcttcatcatag

SEQ ID NO: 30908 - DNA, 222 bp, Glycine max
  Peptide Sequence Number=SeqID_122593
atggaggccatgaaagagcaaatgaccacaatgatggaagccatgatgagtatgagaaaaatgatggaggtcagcacgactacagtcattgccataagtaccaccactgaggtggacccaactcacccacctggcctcaaccaagtaaatcgtccagtctcggatatggtaggtcagggaggtgaagcgttgggaagtacgggcgacccccattttgtgtag

SEQ ID NO: 30909 - DNA, 771 bp, Glycine max
  Peptide Sequence Number=SeqID_122594
atggtcccaactattgaagagtttgaggaaatattaggatgccctctaggggggaggaaaccgtatctcttctccggttttcttccttccttgagcaagattgcgactgtggttagggattcagcaaaggagttggatcgcacgaagcaaactcggaacggcgtagtgggcttgcctcggaaatacttggaaggaaaggcaagggatatggagagccaagagaagtggggcctgtttgcagatattttagccttgctgatttttggggttgtcctcttcccaaacgtcgacggtttggtagacttagccgccattgatgctttcctcgcatatcaccatagcaaggaaagtccagtggtagctatcttggcagatttgtttgacacctttgaccggaggggttgtattaattataatcccgcacttgccataagacagctagggtaccccatgaggggagcgccagcagaagggagtctctcacctttccttgtgaaagatttaggcgcacaaggtctcaaggttatacaaagaatccacaaggcgtggaggagtccgttgaggaaagacaaggagcttaggggcatccgtaatggcgtcatcggaggttatcatggatggctaagaattcacacacgagggttagattggctctccaagttgaaagttatcaatgaggagaacttcgaagttccggaggaagatgaagaagtccaagatctaaaattagagctagggaaggcaagactcgccaaggagaagttcaaataa

SEQ ID NO: 30910 - DNA, 492 bp, Glycine max
  Peptide Sequence Number=SeqID_122595
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagccccgacgattgcccttatccg

SEQ ID NO: 30911 - DNA, 76 bp, Glycine max
  Peptide Sequence Number=SeqID_122596
atggggaccgaccgagaaaagacaatagctgatgtgaacctgagtaggagtggatcgtttgatacaggctacggag

SEQ ID NO: 30912 - DNA, 315 bp, Glycine max
  Peptide Sequence Number=SeqID_122597
atgtacatcaagtatggcccaaaatacatcatgaagcatagcaaacaaaacaagttgtccaatgaacaaaaaccccccacacttattcccaaaacaattccaaagctccaaaattccttaaggatatggaaagggaaacaaggctcaaaagggctatcaaaggaattaattcaaggtaagtccatttggctagaagcttataagaacaaaattgccttaatcatttccaaatatgcatgtgaattaggacgcatcaacaagaatcaagccaaggctattgtgcaagcaatcaatggggcaaaacacaccaaatga

SEQ ID NO: 30913 - DNA, 192 bp, Glycine max
  Peptide Sequence Number=SeqID_122598
atgagctcaacgagaacagaaattctcgtgtggaacaaaaagggtaaaagctcgtttgattctgatttccagataactggcttgtggcagccaagcgttcatagcgacgttgcttttgatccttcgatgtcggctcttcctatcattgtgaagcagagttcaccaagtgttggattgttcacccaccaatag

SEQ ID NO: 30914 - DNA, 1096 bp, Glycine max
  Peptide Sequence Number=SeqID_122599
acctttgccctttccatgcagcaactggagcaattgagcaacccgaagcttatgctgcaaacatttacaatagacctcctcaacctcagcagcaaaatcaaccacaacaaaacaattatgacctctccagcaacagatacaaccctggatggaggaatcaccttaatctcagatggtctagccctcagcaacaacaacatcagcctgctccttccttccaaaatgctgctggcccaagcagatcatacattcctccaccaatccaacaacagcaacagccccagaaacagccaacagttgaggctcctccgcaaccttccctcgaagaacttgtgaggcaaatgactatgcaaaacatggagtttcaacaagagaccagagcctccattcagagcttaactaatcaaggaaagcagtgtcaaggacctcaacccgtggcaccttcctcatctgcaattgaacctgctaaacttcaatctactccagtaaaaggtgatgacaaaaatttacctaacaatttctgtgcaggtgaatcttccactggtcattctgatttgcagaagcagcacatccctcttccattccctccaagagcagttcccaacaaaaaattggaagaggcagagaaagagatcttggaaacatttagaaaaaggaatagtaagtttgacaatgccatgctagatttaggagcttctgttagtgttatgcctctgtctatttttaattctctatctctaggtcccttgcagtcaactgatgtggatggattttctcaaggatcagttcccatcattctaggcagaccctttatgaaaactgctagaactaagatagatgtatatgcaggcacactatccatggagtttggtgatataactgttcattttaatattctggatgctatgaaatacccatctgaagatctttctatatttcgtgctgaaataattgaccatgttgtagatgaatacatgactgatctttactctaatctgcatgcctctcactcttcatgcattgagtctgaaattgtacttgatcatatgtctgaatttgatgctgagagtgaatctgaaagtgatattgattgcat

SEQ ID NO: 30915 - DNA, 474 bp, Glycine max
  Peptide Sequence Number=SeqID_122600
atgtccaatcacagggacttggcactacctccggagcctgagcttggtccctcagctacttgtatcagcacaaatgggagttgtgttgatccctcagcgactgatccagacacaggtgactcaaacaaatctgggttgtacattgaagaaaatccttcccgcctggttgccctaggaagagtttatgagggatccacaacgattcacaacatccctttgttgcatggccaaatgaaggttggtgttaaggaggttaaagatgcagaggctcatgttcctgtacccactaacgaggttattttagtggggcaggcacttaacaccttcctttcttggccgacacatctcgtgaagcgtttatcagaacaggcagctgttccaacaaaacctccagataggccggatcatgaggtcgatgatcccctatatttgatgtcattgaccatcccacagatttttttgaagcctttctag

SEQ ID NO: 30916 - DNA, 991 bp, Glycine max
  Peptide Sequence Number=SeqID_122601
gaagcacttggaggagaaggcgaaggcattggcggatgaaggtgaatgggcttcgttcattgatgtctcggcgttattggtatttggagtcgttctctttccaaatgtggatggactagtggacctagcgacgatcgatgccttccttgcttatcaccatagcaaggaaagtccggtcgttcctgttttggccaatgcctatgacacatttgaccggagatgcgagaagagcggcgcaaggattgtctgttacacacctgctctttatgtatggctggggttctcaaatgtacccttgatgggaacgaggggtagtatcaattataatcccgtccttgccataagagaacttggctatcccatgagaggagcaccgtcagaagaaattatcacacatttcatcgcacgaggtttcagtgaccccaatgcgaggatacttcaaggagtccacaaagcgtggggcacgatgcaaataaaagataaggagcttaggggaagcaacaacgggatcgtcggtggctatcacaagtggctgaaggcttggacacaagagttagattgggtcccgaagctaaagacctcaaatgaggaagaggctgaaacccctgaggagagtgaggaggttcaagccttaaaggtgaaacttgaaagggcacaagcggtcaaggaaaagttcaagacaatgaccatcaagagagaccagccaagtgtcgaaggcatgatattggaaatcaagttgaaggcttaccaaaggtcaaagaggagtttgtccgaacaattgagcaagacggaagagaacatgtgggcaatcattgaccaatacaaagaaaagctaagtctagctgcaacctatgaacaaaggatagaaggcgagtatgcgaaggttcgctttcgccttaaatgggagtcaagagcttccaagactgctagccaaggccaaggcgatggtggacgtgtactcagcccccgaggaagttcatgggctctttga

SEQ ID NO: 30917 - DNA, 597 bp, Glycine max
  Peptide Sequence Number=SeqID_122602
atggcatccatcagccaacttcagtcgcagatgcaatctcagggacttgcagtgcctcctgagcctctggttggtcctctggtcttcaaaaacgatcctgagacgagtgactctgacaggtgcggcttgtacatagaagaagatcctgcccgcctggttgccatggggagagtttatgagggatccactgttgttcataacactcctttgctgcttggccaagtaaatgtgagtgtggaggaggttgcagatgctccagttcctgtacccactgatgaggtttccttagtagggcaggcacttcacaccttccttacttggccgacacatctagtcaagtctttatcacaacaagtagctgtgtctccggtaaaaccacctctgaagcccgatccagaggtcgatgatccgctttatctgatgacattgaccatcccagagcttttcttgagaccttatcaggttagatgggatgccaccatgttcggggtctttaatccagatttccccctctacataaagcacgaagacctctccgaaatcgcacacggtggtcaatgtctcagcatatcagtgttacagttgtggattctgtaa

SEQ ID NO: 30918 - DNA, 285 bp, Glycine max
  Peptide Sequence Number=SeqID_122603
atggcctccatcattgtggccatttgctctttcatggcctccatgtcggccttcatcttctcttgtacctcctctacttcacccattactctagctctagcacaggtgaagttggaagtaacaaggatatcaacaatcctaaacgtgtttggcaatagacgaagcaatgatgtaacacgatccatctattgccccaatttttgcaagatggttacttccatacttcaacttgactcgatgaaccttttcgtaaaagcacgagcttggttcaaccccataacctag

SEQ ID NO: 30919 - DNA, 487 bp, Glycine max
  Peptide Sequence Number=SeqID_122604
atggtagaagtctccacagaggccattgcctccctcgcccagtattatgatcagctgttgaggtgcttcagcttcggggacttccagctatcacctatggtagaagaatttgaagagatcctaggatgccctctagggggaaggaaaccatacctcttcttagggttctatccctcattagctaaaatttccaagatagtccaaatctcggcgcaagaattagaccgccaaaagcaagtcgaaaatggggtggttggaataccgagaaaatgtttggaggcaaaagcaagaatcttggtaggtaaaggagaatgggccttgttcatagacattctcgcactgttgatctttggaggagtcctctttccaaatgtggatgggttggtggacctagcagcgattgacgcttttcttgcctatcatgaccacaaggaaagcccggtcgttgctatgctagccgacctctatgacatctttgaccgaagat

SEQ ID NO: 30920 - DNA, 244 bp, Glycine max
  Peptide Sequence Number=SeqID_122605
gggtttccatgaaccctaagagaataaaggtcattcctgagtggcctactccaccaagtgttgagggaaggagcccaaagtatgaagaacctcgggatttgaggtcaaatcctttccaagctctagcttctcatctcaaggaggtgagcttacctattagagagctcttgcttctcaaggaagttttctcaaagaagcttctcaaggaagttttctcaagaaagcttctcaaggaagctaccgg

SEQ ID NO: 30921 - DNA, 1917 bp, Glycine max
  Peptide Sequence Number=SeqID_122606
atggtcaccaacggtacttcgacctcgaacaaaatcgtcgggatgtacgctgcacctgctggcagcactctgctgattgaccgtaactgccataaatcgctggcacacttgctcatgatgagcgatgtcgtaccgctctggctgtcgcccacgcgaaacgcgctgggtattcttggcggtattccgcggcgcgagtttacgcatgacgccattgaaagcaaggttgcggccatccccggcgcaagctggcctgtccatgcggtgatcaccaattcaacctatgacggtctgctgtacaacacggactggatcaaaaagacgctggacgtgccgtcgatccacttcgattccgcatgggtaccgtacaccaatttccacccgatttacgcagggaaaagcggcatgagcggtgaacgcgtaccgggcaaagtattcttcgaaacgcagtcgacgcacaaaatgttggcggcgttttctcaggcttcgcttattcatatcaaaggcgagtacgacgaagagacctttaacgaagcctttatgatgcacaccactacctcaccgagctatccgctggtggcttccattgaaacggcggcggcgatgctacgcggtaatccgggcaaacgtcttattaatcgttcggtggagcgggcactgcatttccgcaaagaagttcagcggttaaaagaggaagccgacggctggttctttgatatctggcagccggaagagattgatgaggcggcgtgctggccggtttcacccggtgaaggctggcatggcttccgggatgccgatggcgatcacatgttcctcgatccggtaaaagtgacgatcctgacgccgggcatggatgaacagggcaggatgagcgatgaagggatcccggccgcgctggtggcgaagttccttgatgaacggggcgtggtggtggaaaaaacgggcccctataatctcctgttcctcttcagcattgggattgataagacccgggcgatggggctgttgcgcggcctgatggagtttaagcgcgcctacgatctcaacctgcgggtgaagaatatgctgccggatctctacgcggaggatcctgatttctaccgcaatatgcgcattcaggatctggcccaggggatccacaggctgatccgtcagcacgatctgccgcgcctcatgcttcaggcttttgatgtcttgcccgagatgaaactcacgccgcacaacgcctggcagcgccaggtgaaaggggaggttgaaaccgtcgagctggaaaacctggtcggacgcgtatcggctaacatgatcctgccttacccgccgggcgtaccgctcctgatgccaggagagatgattaccgaagcgagccgggccgtgctcgatttcctgctgatgctctgttcagtaggacgtcactacccgggttttgagacggatattcacggggcgaagcgcgatgaaaacggtgtgaccgcttgccaggtgcgggttttcggttgtaacgttcaggcatcattaaaaggagaagctatgctgggtttaaaacaggttcaccatattgcgatcattgcgaccgattacgcgaaaagtaaggccttctactgcgatatcctcggttttacgctgatgagcgaggcgtaccgtgaggagcgtgactcctggaagggcgatctggcgttgaacgggcaatatgtgattgagctgttctcttttccttttccgcctgcgcgtccgtcccgcccggaggcctgtgggctgcgtcatctggcctttagcgttgatgacctggataacgcagtcaagcatctggaagcgcacgccgtcgcgtgcgaggcgattcgcgtcgatccgttcaccgacaagcgttttacctttttcaacgatccggacggtttgccgctggagctttaccagcagtaa

SEQ ID NO: 30922 - DNA, 285 bp, Glycine max
  Peptide Sequence Number=SeqID_122607
atgtggcccaaagcaagtgccaaagaccctggaaggtcagtgcacttcgccctccacgaacatacacaacatccaacgtatgaacgtggcccaaagcaagtgccaaagaccctggaaggtcagtgcactttgccccccacgaacatacacaacatgcacatgccaatgcatttccaacatcaatcaacattccattttcacatcatccttgacataaacatcatctcttctcaatggcgttatcaacaacaacaacaacaacaacctcatttcatattcatataa

SEQ ID NO: 30923 - DNA, 366 bp, Glycine max
  Peptide Sequence Number=SeqID_122608
atggcttcttggaaacgtaacagtattggttcaagacccacaacgcagtatgacacaaggagattctcttccttagatgtttggaccagatacacagataatgtcctggggagaaacattttaccagagaggaaagtagagatatatcactctgagctagatgagttgaaggctgaattggagaggcgtaatttccataaatgcctcatcaatttagtcgatgggagcatagacctagctttggtgaatgaattctatgcaaatttatacagttctgaggaccatccacaaaagcagtccaaagtcagaggtcatttggtgatgattgatgttgatagtctcaacgcattcttggagacacttgtg

SEQ ID NO: 30924 - DNA, 213 bp, Glycine max
  Peptide Sequence Number=SeqID_122609
atggaagcttgcttgtggggcttctatggaggctggatctttgagcttcaatggggtcctttaatggtgattttccaccatggagatgcagcggaagacaaaggaaaagagcttagagaggatgcttcaatggaggaaaagaaagagggagagaaagagagaggggggagcacgaaattgaaggaagaaaaagggagagaagttgaactttga

SEQ ID NO: 30925 - DNA, 583 bp, Glycine max
  Peptide Sequence Number=SeqID_122610
atggttagaactagaggcttaggtcgtgccttaggtagggttattggcagagctctgggagagaggatcgtcatgattcagatgatgctccccagcggcgaaggcctaccgcatcggcacgaaggccacatgacccatcagtgcttaccgagtatgctgaccatgttgctatcagcacatggaacggagaggtctgctcctgaaattgagggcctagttgctgccacgagactaagtcctttgatttcgtgttcaatagatactggcaatcggggacttatatccacattcgtggagaggtggcacaaggaaactagcagtttccatcttcttgtgggggaggttagcatcaccctggatgatttggcatctctgcttcatcttcctactgttggcgccttccataccttcgagcctctgcatgtcgacgaggtcgtgttgatgttggttgagttactagaggtctacggagaggcagccagggatgagacagcacagtgtcatggaccatacatacacctatcttggctacgagatatatatcagagtagatgtcaagctagacattggaatcctgcagctc

SEQ ID NO: 30926 - DNA, 483 bp, Glycine max
  Peptide Sequence Number=SeqID_122611
atgcgaacatgctttagtaaagagataaaacttccaactggtcagagcaacatatgctttttggatgaaaaacaatgtgtctatcgaggaaggagacatttcatttctaaacgaccatttagaggaaacactgggtccaacaaagatataagagaatcactcaaagtgtatcaatttcacacagatatgtctggtccaaagacctttctggatgtttcttctgttttctttcgatccttgatcgagaattttctctccttttttgctttctctcactcccttattagaggaatattccctttttttgttttctttcgagggcaaggattgacactctcacagtgggtcaaggtttatggtaagttgggattttggctcaaggcttgtagaacgactggtcatgatatatgtcagggtttggccagcggttcggggataaaggggatgtcccacattatttccatgatacgcatgcaacaatga

SEQ ID NO: 30927 - DNA, 810 bp, Glycine max
  Peptide Sequence Number=SeqID_122612
accatccgcgattcggtggccgacgtgcagttcgagatgctgctggcggtggcgctggtggtgatggtgaccttcgtgttcctgcgcagcctgaccgcgacgctgattcccagcgtggtggtgccgctgtcgctggtgggcaccttcggcatcatgtacctggccggcttctccatcaacaacctgacgctgatggcgctgaccatcgccaccggcttcgtggtggacgacgccatcgtcatgatcgagaacatcgcccgccacatcgaagagggcgagacgccgctgcaggccgcgctcaagggcgcgcagcagatcggtttcacgatgatctcgctgaccttctcgctgatcgcggtgctgatcccgctgctgttcatgaccgaggtggtggggcggctgttccgagaattcgccatcacgccggcggtgtccatcctgatttcgctggtggtgtcgctgacgctgacgccgatgatgtgcgcgcgcttgctgcgcgccgaatccgagcagaaacacgggcgctttcaccaggtcaccggcgccttcatcgaccgcaccatcgccgcctacgaccgcatgttgcagaaggtgctgcgccaccagccgctgacgttgctggtggccctggccactttcgcgctgacggtgctgttgtacatcctggttcccaagggctttttcccgcagcaggataccgggctgatccaggccatcacgcaggcgccgcagtccatttcgttcaccgccatggccgagcgccagcaggcggcggcgcggctggcgcaggaggatccggacgtgcaggcg

SEQ ID NO: 30928 - DNA, 772 bp, Glycine max
  Peptide Sequence Number=SeqID_122613
atgtttgaattagctaacgaacctgttgaaatcctgggaacaaatggtgcttggggtagtacgggaaatgagcattttgcagcactcaaaaacttctttcagccactggttaatatcatccgtaacaacggagccaacaatgtttgctggattccgggtacaggctggcaatcgcattatcaaggctatgtcaataatcagatcacaggtggtaatattggctacgctgttcatatttatcccggttactggggtggtctcaacaactatcaatcctttcagaacgcatggaatgtcaacgttaaaccgattgcagacattgcaccgatcgccattaccgagaccgattgggcaccacaaggatatggtaccttcggcattggtaataccggtacggcaggcggaagcggatttggtgccaatttaaaatacatcgtggatcaatccggcaatgtaagctggaatgttcttgccccggataacctcctccacaaaggcgatcctaatgcaggaacagcttacaacaacgattgggaagcctgcgctgccccggttaaacagtggtttcagcaatatgcatcctccaactaccccgttgccaactgcaacacaaacagtagcctggttaataatggtatttatgagatcgaatttcagactgatgccaacaaagtagttgatctgaaatcaggagaagacgccaatggtgcagtattaaggccatggacaaggaatggcgctgctgcacagcgatgggttgccattgacgcag

SEQ ID NO: 30929 - DNA, 324 bp, Glycine max
  Peptide Sequence Number=SeqID_122614
atgacgctctgtcaaaccatacagtccatttggtcgaataatctatcgtcacagacttttcctgaacgagacattcaggccatgatggtcctcatgccaggatattcccggagaaacagggctggtagtgttaagaggctgttgaccaaattatctgccaaacgcttgccttttatctttggacgtagacttcactcacatggacacaacaatcactttccatgcatgcccgttggcgtgcgttccaaacgagccctcatggacttcctcgatcatgtgatttgcctccttggcatccacacatcgcagagtgtcatgtcgtga

SEQ ID NO: 30930 - DNA, 138 bp, Glycine max
  Peptide Sequence Number=SeqID_122615
atggaccctaagagaataaaggtcattcatgagtggcctactccaccaagtataagggaaatttggggcttcaatatcttaacaaacttttacaaaaggcttgttgaattgttggaaagatccatgagtttcaagtaa

SEQ ID NO: 30931 - DNA, 207 bp, Glycine max
  Peptide Sequence Number=SeqID_122616
atggttaaagcacgtcaaaagggggggaaaagagggaggtggttgccacccagctcgcccaggcaagttgggttgcttccaccagaaggcaccgccttctattggaacaccttggaaggcctaagtgggcctgattgtgcgacaatgctccctttcaacttccgacatgccgcggaacttcacggattacctaacaatgggtgttaa

SEQ ID NO: 30932 - DNA, 114 bp, Glycine max
  Peptide Sequence Number=SeqID_122617
atggttgctaagcatgttgcgcgcaccattgcccgaagaaccaacaacgcaccaactacattgcagtcatgggcttggtaccgcatgccttttattgcaccaagagtcccatga

SEQ ID NO: 30933 - DNA, 198 bp, Glycine max
  Peptide Sequence Number=SeqID_122618
atgtgtgttggccctcgcatgagaaaagaaaatgcagaatccgatttgaggacaaatccttctcaagaggtagagaatgatgaggacatgaccaagagcaagggcaaggatccacttgaaggacttggaggacctatgacaagggctagagcaaggaaagccaagaagctcttcacaagtgttgtccatactatttga

SEQ ID NO: 30934 - DNA, 255 bp, Glycine max
  Peptide Sequence Number=SeqID_122619
atggcaaattcaacatgctttcaacaagtgtcttcacaaataactatcatgaagcagaaaactagcaagactacccatcatatctcccaaaaccccatacccacgaaaatcaaaggagaaagaagtccacccaaacctgaaatttcgaagtcccacacaaatgggcaccaaaggttgaagctttgttgggcaacaatggtggatgaagaagaaggagaaaagcaacgtgagggagagggagagagagctgtctga

SEQ ID NO: 30935 - DNA, 411 bp, Glycine max
  Peptide Sequence Number=SeqID_122620
atggaacgtgagaagcagattaataatcatctggttccgcaagacatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccgatagacttattggagggagggtcccattggcgtgcatccagtaggaattga

SEQ ID NO: 30936 - DNA, 510 bp, Glycine max
  Peptide Sequence Number=SeqID_122621
atggcttctatgatggaggccatgctaggaatgaggcaactcatggagaagaacgtggccaccgctgccgctgtcagttcggctgccgaagcagacccgactctcctagctaccgcgcatcatcctcccctaaatgcggtaggacgaggaaggaacacactggggcacaacagcaacccccatttgggatacaaccgagcggcttacccttatggattgccgcctaactacatgccgccggtcatgcaagatgatgcaggccatatcttttctcccatccttgaaggagagcctcctcgacaacccgacgaggtccacgaagatcatcaagagtatgcccaaagggatgtcgagttctaccccccgatccccgtcgaggggccggcacccaacactttgcctcagcacaacctcacagcacagtcaataatcttgtccacagaaggaccacccccggcaaccgaagaaagaagaaacttgatctcttcgagagagattgagggttgttga

SEQ ID NO: 30937 - DNA, 832 bp, Glycine max
  Peptide Sequence Number=SeqID_122622
atggctatgggggatttcatcagcagactctccttccctggtagacgcattgtttgtcactcaaaaaaggcatatgctgctctaatcggttggaatatttgtctctttgctaaagcatgtttgcattttagtggagaaaacaccgagactttttcaagtctcacaagttatccagaactacgtaggtctgagttcctcattggaggatacgtaggagcaaaagcctcgcttttgtcgaccacacagctttctgttaccatgacccaagagctggcatcttctggtggagactttttcaagtctcacaagttatctagaactacaggcgacgggcccaatgacacgcggagataccttacggttatccgcacccttttgtcatccagaggcggcgggcccgatgacacgcggagacaaaatttggtcattccgcacccctttgccattcagacacagtcgtgtccgatggcgcgcagagacaaaaattggtcattctgcacccttgtgtcatccagaggcggcgggatcgatgacacgcggagacaccttacggttatccgcacccttgtgtcatccagaggcggcgggcccgatgacatacggagataccttacggttatccgcacccttttgtcatccagaggcggcgggcccgatgacacgcggagacaccttacggttatccgcacccttgtgtcatccagaggcggcgggcccgatgacacgcggagacaccttacgattatccacacccttgtgtcatctagaggcggcgggcccgatgacacgcggagacaccttacggttatccgcacccttgtgtcatccagag

SEQ ID NO: 30938 - DNA, 726 bp, Glycine max
  Peptide Sequence Number=SeqID_122623
atgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagacgctaacattaaactctcatacttccatgggaaggacaatgtagaggctaacttagattgggaaataagggtagagcaacaacttaaaaagaagtctacttcaaaatcttatggctctcactcttatccaaagaaagaccaaagtcaaggcatcttaggggtgacaccttctaagcccaaagatgataaggggaagacaatagaaaagcaagcccctaaggctagtatgcaagagaaaactagctctataaaccaagatgaggctactacttcaccttcctctagtgaaagtgaagaagcaaaagaggaagaatctagtgaagaaatctacccccaagaagaaggacaaccattaatgcttaaggaggagtgtaaggaggtaagtgtctccaccaagaggttagctaaaaaggaaaggaattttgaaataaagacaaatattaaagaaatttccccttttagacaacctccacattttctcctttgtaaaaaaacacttgttagcattgtcacacctcttgggcttgagtttattcctcaagttaaagagttgttggaggtttggttcgcaagagcttaa

SEQ ID NO: 30939 - DNA, 282 bp, Glycine max
  Peptide Sequence Number=SeqID_122624
atgacttcctcaaatggaaattttccagcatctatacatgttctcataggcaagaactatgatgattggtgtgctcagatgaaggaggcatgggatattcaagacaaatcctatgcaggggatagcaaactcaagaaggtgaagttgcagaccttgagaaggcagtatgaacttctacaaatgagtgatcaagaaagcattgacttgggaatcattgacaaggtattaagaaccttgacgccaagattcgatcatatagtggtggcaattgagcaaggctag

SEQ ID NO: 30940 - DNA, 312 bp, Glycine max
  Peptide Sequence Number=SeqID_122625
atggcgtgtgaacacagatggattttcaacctccatttcactcctctgctggaacaacaagcatgcaagagacccctactggcagctagaatgcatgtctggactcttgaactcacacaggccctgcttggtgatcctaaaccactgatgcttccacctcttgcagcaatacatcttccttcttgcggttttcatatgatgattttaagaaggttcgaccctccattgcaatggcatgtccttccggttggccctggctttcatggcaagcatgttgcccaaccatggtaccagttttcttgcttaaggtga

SEQ ID NO: 30941 - DNA, 399 bp, Glycine max
  Peptide Sequence Number=SeqID_122626
atggcgaggatgtgtagtcctctgaaggtgagggcgtgcagccctctgatggcgaggacgtgtagtcctccgatggcgagggcgtgcagccctctgaaggcaaggacgtgtagtcctttgaaggcgaggacatatagtcctctgacggtgaggacatgtagtcctctaaaggtgagggcatgtaaccctatgaaggcgaggacgcatagtcctctaaaggtgaaggtgtgtagccctatgaaggcgagggcgtgctgtcctctgaaggtgaggatgtgtagtcctctgaaggtgagggcgtgcagccctctaaaggcgaggacgtgtagtcctctgaaggtgaggacgtgtagccctctaagggtgagggtactagtagccaagggtccacccctatga

SEQ ID NO: 30942 - DNA, 252 bp, Glycine max
  Peptide Sequence Number=SeqID_122627
atggtcattctacgtcctttgtcattcaggagcagcaagtcgagggataaacgcgtagagacaaatatggtcattctgcaccatttgttattcaggagcagagcaacaagtcgagtgataaacgcccagagacaaattatggtcattctgcgccctttgtcattcaggagcaacgagtcgagttataaacgcctagagacaaattatggtcattttgtgccctttgtcattcaggagcagcaagtcgagtga

SEQ ID NO: 30943 - DNA, 290 bp, Glycine max
  Peptide Sequence Number=SeqID_122628
gagccctggtgcttaccaacatggatggcgaagagctaccttcacccggatttcctgtctgttgtatctctcgttacaatctttcaaagaaatgaacgtggattcgaggcttttagtcctcacgggcaggatcaccttgggctaccttctggagtagagacgaaacatgaacggcagaaaccaatcaaggtacttaaggacggatgcaagtggggatggggtcacgaccgaccgatcgttgtcccttctctgtgcgaaacaagcagaggatgtcgctgcaaggcagcccc

SEQ ID NO: 30944 - DNA, 261 bp, Glycine max
  Peptide Sequence Number=SeqID_122629
tgggctaagcgtgcatccatcgctaagcgcgcttagcacaatagaagaatctggcagagcatcaatatcaaggctgcgtgctaagcgcgagatcagtgcgctaagtgcagcagttgtcttcaatcatctttcttccttctccattccgcttccagtcatcttaaagaagcaaaggactccattgatgaagaagatccaaggcctacaagctccacatggagctacatcatgtggtatcaagagcatcttcgtctatgtgat

SEQ ID NO: 30945 - DNA, 594 bp, Glycine max
  Peptide Sequence Number=SeqID_122630
atggagaggagtatgattgatgctgccagtggtggagctcttggtgatatgacccctgctgaggctaggaatttgattgagaagatggcttccaactcccaacaattcaatgcaagaaatgatgctattatccttagaggagtccatgaggtggccatggattcatcttcatccactgaaaataaaaagcttgagggaaaacttgatgccttggtcaacctagtaactcagcttgcaatgaataaaaaatctgcacctgttgcaagagtcggtggtctatgttcttctgaagatcaccatacagatctttgtccttctttgcagcaatttggaatcaatgagcaacctgaagcttatgctgcaaacatttataatagccccctcagcagcaaaaccaacaacagcaaaataattatgatctttcaagcaataaatacaatccagaatgctgctggtccaagcaagccatatgttcctcctccaatacagcaacaacaacagtcacaactaagacaacaagcaacggaggctcctcctcaaccttccttagaagagttagtgaggcaaatgaccatccagaatatgcaattttag

SEQ ID NO: 30946 - DNA, 339 bp, Glycine max
  Peptide Sequence Number=SeqID_122631
atggaggaccccttgttgcctgcagtaaaggtgagtgtggacgaggttaaagatgcagatgctccagttcctgtacccactgctgatgtttccttagtggggcaggcacttcacaccttccttgcttggccgacacatctgatcaagtctttatcacacctagggctacaaggtctgatgatctcccagccaaaaccacctccaaaggctcctgactggaggtcgatgtcgtcaaggcatctcactgaaacatgtatgcgagcggggaattctgatatctatggattcctcgagcctcagtccattcagaggtctgggcaatcgcagtttgaatcctga

SEQ ID NO: 30947 - DNA, 1164 bp, Glycine max
  Peptide Sequence Number=SeqID_122632
atggatcgactttattttgatggcatagctatatgcagtcacgtaggcttcccaaatctttttattacttttacctgcaatccaaattggcctgaaattcataagctgctgacacctttgaatttaacaccaatagataggccagaaataatctcccgcattttcaagcttaaatatgagcagatgttatcatacattacaaagaatcacctgctaggcaaagtcgtcggatacatgtacacagtggaattccaaaaacgagggcttcctcatgtccatttattgttatttttacacgccaacaacaaatatccatctccaaatgatattgatcatattatatcaacagaaataccgtcacagaaagatgatcctgaactctataaattagtgcaaaatcacatggttcatggtccatgcggaattttgaggcctgcatctccatgcatgaaggaaggcaaatgcagtcgattttatccaaaaaagtttcaggccacaactattatagatggagatggttatcctgtgtatcgtagaagaaatactggtcggacaataaccaagaatggatatgatagagttaccgttgtcatggtacatgatgacaatgaaacagttccgcatgcaaacactccgaatgatgaaatgaaggaatatatggattgcagatacatttctccatgtgaatctacttggaggatctttggttttccaatacatggtagaaaaccttctgtagagaggctacagttccatcttccaggccaacatagcgttctctgccaagaccatgatgatattgatgatctcctctctaacccaagcatttctgaatcaaaatttatagcttggatgaatacaaaccaagtttttcttgaaggtcaaaagctgacttattttgaatttgtaactaagttcgtgtataaccagaaacagagatgttggcaacttaggaaaaagggttatactattggcagacttcaatgggttcctccaactacaggggaattattttatttgaggatgatgctgactgtctgtagaggaccaatctcatttgaagatatcagaaaaattgatggtgttgaatattctacatatagagaagcatgttttgctatgggttttttacaggatgatagagaattcattgctgcaatctag

SEQ ID NO: 30948 - DNA, 621 bp, Glycine max
  Peptide Sequence Number=SeqID_122633
atggctcggaggaagctttcctcaaagatatctaggaaggacgctgcgtcagggactagtgccgctcccgagttcgatagtcatcgtttcaggagcgctgagcaccagcagcgtttcgaagccatcaagggatggtccttccaccgagagagacgcgtccagctcagggacgacgagtacacagatttccaagaggagatagctcgccggcgttggacgtcgctggtcactcccatggccaagtttgatccagatatagtcctcgagtttacgccaatgcttggcctacagaggagggcgtacgggacctccgatgccctcagtcagttcttgggatatccgctagtattggaggagggccaggagtgcgaatatggtcagagaaggaaccgggccgatggatttgatgaggaggccattgctcagctcctatgcataccaagtcaggattttgcccggaccgctgccgggagatgggtgcggatcatgcgcaccaacatgactaccttgacccagacatggatgacgttgctgctcagcaacatccagcccatcgatcataattctgacctccctctgttgaagtgtcagctggtatgtcgcctaccagacaccctctag

SEQ ID NO: 30949 - DNA, 438 bp, Glycine max
  Peptide Sequence Number=SeqID_122634
atgcagtcccagattcagtcccagatgcaatctcagggacttgcactgcctccagagcctctggttggtccctcaggtcctcgagtaagcacaaaggggagttgtgttgatccctcaggaaacgatcttgagacaggtgactcagataggtgctatggtttgtacatcgaagcaaatcctgcccacctggttgccttggggagagtttatgagggatccactgttgttcataacactcctttgttgcctggccaagtaaaggtgggtgtggaggaggttaaagatgcagatgctccagttcctgtacccactgatgaggtagccgtgtctccgacaaaaccacctcaaaagccgaatccagaggtcgatgatccgctttatctgatgagatcgaccatcccagagcttttcttgaggccttaccaggcatctgactga

SEQ ID NO: 30950 - DNA, 270 bp, Glycine max
  Peptide Sequence Number=SeqID_122635
atggctaaggaacttagcatctctatcagacacaatagtcttaggcaaaccatgaagcctcacaacttctctaaagaagagtcttgggatatgactagcatcatctaccttgtggcatggtatgaaatatgccatcttgctaaacctatccaccaccacaaagatagattctacacctctctgggtcctaggaagcccaaggacaaagtccatactaatatctacccagggtgcagatggaatggggtatacgaagtcttccctccttga

SEQ ID NO: 30951 - DNA, 552 bp, Glycine max
  Peptide Sequence Number=SeqID_122636
atgttcagcttagcggacactgtccagctaagccaattttgtagaagctgcatttgtgcaactttcgctaagcggcttcacatgtcgctaagcgatgcttggaccagatacacagataatattctggggagaaacattttaccagagaggaaagtagagatatatcattatgagctagatgagtttaaggctgaattggagaggcaaaattcccataaacgcctcaccaatttagtcgatgggagcatagacttagctttggtgaaagaattctatgcaaatttatacagttctgaggatcatccaccaaagcaatccagagtcagaggtcatttggtgaagattgatgctgacagtctcaacacattcttggagacacctgtggtattagctgagggggagaccttacccgcttactccagatattgtagtttgcctatagactacagagagatagaggctgccttatgcatacctgcccgagggttcatcttgaactcagagggccatcctaggaagattctcaggaaggatctgactacactagctcag

SEQ ID NO: 30952 - DNA, 138 bp, Glycine max
  Peptide Sequence Number=SeqID_122637
ccttacactgggacaatgaggggcactgtgcatgagcctcaagcgaacctaggggcagaccaaaagttctcacccgtcgatgtttttaaacaaaaaaagggggggggacaaaccctaggatttcaatggattgattaa

SEQ ID NO: 30953 - DNA, 355 bp, Glycine max
  Peptide Sequence Number=SeqID_122638
atgttcaatctcaaagtgaagtcgcttgcgaccaagctgatcctagtaaccggctgtgccatcaccacggttctcgttgcatccaattctttcctcatctcccagaccagtgagcgcgtgcacgcgttgaccatggatcaggccaatacggaagcccgcgccatcgccaacgtcatcgccgccgatgtcggtgaactcggcagcgctgcccgctcaatggctggcgtcatcggtcgggcgcatcaggcgaagtcgatggatcgccctggcatcgtcaacatcctcaaggccaatgtggagcagaatacttttgcattcggcagctggttctgcgaacagctcggtcttttcgatg

SEQ ID NO: 30954 - DNA, 450 bp, Glycine max
  Peptide Sequence Number=SeqID_122639
atggcgcccgtggttccacgtcgcgatgcagtcccaccgtgcgcagctcggcctcgcgccgtgactcctcaaccaggtcgcggggcagcagggcgagctggccctccggattgtgtgcgaacaggctcggatcatccaggaaccgcacgtgctcgtcgtattcgaaggccacggtcgcgatatcggcccattgcgaagggtcgcgggggccgagccacggcggacggaactcgaccgtgtgcaggcgcaggacgggcgtcatcgaacggatcagcagcgttggcagcgtgctgctgtcgtcgggcatggggggcgtatggtcgatctgctgcagcatctgcgccagcacagccgccacgtgcatgcagtcgtggccgagcaggcaggaacaccggttgcgcagcaggctgcgcggatggcgaaggctggcggccagtcgatctccacccg

SEQ ID NO: 30955 - DNA, 468 bp, Glycine max
  Peptide Sequence Number=SeqID_122640
atggctggtacattcttccatttgaaacagcaaaatagtttagagattatgagcgggacgccacaattggtggtatcagaggaaaagttggatcctagtgaacctgttatggtcttgttgtgtgaatgttgtgtatctctgaaacttgggagtaggtttcggggagtgacgttaagtcacacattgtgtgtatttctgccttcttgtcttgagcatggatgtgtgactgattcacaggattgttgtgtgtatgggataggtatggcaggacgtggtagggatcagaaccgtgatgtccttgaccgcatcacagctgtgctggaaactctagtgcaggaacgtgatgtggagccggcggagtatcggggactcatggctttccgtaagaaccacccgccaaagttcagtggagactatgatccggaaggtgctaggttgtggttagctggagatggagaagatttttga

SEQ ID NO: 30956 - DNA, 228 bp, Glycine max
  Peptide Sequence Number=SeqID_122641
atggattcctttgcttcttggaagatgaatggcagcggaatggagagaggaagagagagaggagacgccatgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 30957 - DNA, 462 bp, Glycine max
  Peptide Sequence Number=SeqID_122642
atggaatcttggggggaatactttggcggttgccttgaaaggatttttgtcccagtattctggttccatttatatggaaaaaccgaaaacaacaaacaatatccaccattgcagagacatgcctttgtaaagtggtggtcacaatttgatacctcaaaggctgctccagaacaagtcaagaacaggtttcagagcaaccctgagtttctcaagcctgctgatccagagacatcattgtttctaaatcaaaagtctcaacttgcagcattcttagcaagctcaaaatctaaagaaagtcttgctcagaatcttaaggaagttctccagctacttcaacaggaagaagaagaagaaccccccaagaaggaagtcgaatcatccgcgaataatgatgaccaagaagatgatccattctaccagaatgaggatgactgttttggtatatcgttagacgatgattag

SEQ ID NO: 30958 - DNA, 552 bp, Glycine max
  Peptide Sequence Number=SeqID_122643
ggtacaaatattggggcaactctatggcaagaattgttccctgaatttgagcccaagttgcgttgtggtggtgcatatgttattcagaacgtgaaggttgttgatactcattctgactacaaaacaacgtctgtcaaagaggtggacagacctgagattcctcctaatgttcatgccattacttcatttgctgatataatttcaggcgttgcaaaacctgatactttagttaatattgtgggtgttattgttgaagtgattgaacgcaaaacaattaatccagcatacagagtgactgtcaagttgagagacaacagtcatgttgagatcatcatgactgtgtgggaggaatatgctcttcagctggatgatgctattgagcaaaaccattttgtgcaaaagctattggttgttatgctaactcttgctaagattaaagaacccaaggacaagtatcccctcagtgtacagaatataaagcatggttcgaagttgtatgtgaatggtgacattgtagaaatccaacaattccatgataggtacaatgaatga

SEQ ID NO: 30959 - DNA, 532 bp, Glycine max
  Peptide Sequence Number=SeqID_122644
gttcccctattctgatttgtttcccacttctactagttcagtcactaaccttgattcctactttagtctcaatccaaatctttctccaccctctgtctcttccatttctcaaacatctcaagtgtctgatacagcttcggttccccttgttcctcctgggttttcttctttatcaactcagtcttctagcaacactgattctgtacctcaaaattctacttgcgctgtgtctgcctctgtccatcctgtcaattcagagcctacggcccttgcttcatccttttcaaaatatatttctataccaaattctgtaccagtcaatactcatcctatgttacatccttctctatttcttactcattttgagcctaaaactgtaaaacaagctttggcaaatgcagattggctcactgttatgcgacaagagtataatgccctactaaagaacagaacttcggacttgaatgggtcacttgaagaaactattttcatgactcagcctcctggttttgaagttgcagataagtcattg

SEQ ID NO: 30960 - DNA, 231 bp, Glycine max
  Peptide Sequence Number=SeqID_122645
atggcagcggaatggagaaggaagagagagaggagacgccacttcaaggagaagatgagtctagaagaagctcaccaccataggaggccatggataagagcttggaggaagaaggagatgaatgaagggagaggaagagaagagcacaaaattttgtgctctaaaagggctttgaaatctgaacccactaatccaagatcaattcaaggattctccactaagtgtgcttag

SEQ ID NO: 30961 - DNA, 177 bp, Glycine max
  Peptide Sequence Number=SeqID_122646
atgtcacctgacttcatgggtcaggatgacaaaggtgcagaagacgacccacttgggtatcttcgcatgtcatcggacttcactggtcacgatagcaaaaggtggggcggtcaacaaaagcgaggcttttgctcctacgtatcctcaatttgtgatgaggaactcagacctacgtag

SEQ ID NO: 30962 - DNA, 60 bp, Glycine max
  Peptide Sequence Number=SeqID_122647
atgggtgcaagggatgaatcaatcaagcacaagatcatactctcaccgggttgcggctaa

SEQ ID NO: 30963 - DNA, 447 bp, Glycine max
  Peptide Sequence Number=SeqID_122648
atgcataaggcattgcaatcaaatgctccactttcatatcctcatttgatcaccttgtttctacaacatcttaatgtccctcttgactatgagccctttgtcaaagtcaagagatctttccctatcagtgtgaatgtagtctcctctttcgaataccgcaaagagagggatggctcttgggtgaagaaggatgctccaatacaggctattgaagaccgctctccatcaccacctcctcaaagagatgattcttcatctcttatgcacaacatacttgacaggttggatggactccacaccttcgtcaataaacattttaactcgttggatagccgtattgatgccatggatgcacgatttgcagggatggacacacgtatcaccaaacttgaggaggatgttagctttgttcgtcagtgctttgaccttccactaccatcctcatag

SEQ ID NO: 30964 - DNA, 351 bp, Glycine max
  Peptide Sequence Number=SeqID_122649
atggcgacggatgcaagtggggatagggtcacgaccgaccgatcgttgccctttcccggcgctaaacaagcagagaacatcgctgcaaggcagcccagtatcctttgcattcacgctcttgggatatcctttagtgctggaagagggtcaggagtgcgagtatggccagaggaggaaccggtccgatgggttcgacgaggaggccatcgcccagttgctatgtataccggggcaggattttgcctggactgctgccgggagacgggtgcggatcatgcgcaccaacatgaccaccctgactcagatatggatgactttgctgctcagcaacatcctgcccagcgaccataa

SEQ ID NO: 30965 - DNA, 800 bp, Glycine max
  Peptide Sequence Number=SeqID_122650
aagctggcgcgcggatccatcagaagaacgacgccgacacttggaacagcttttccacgcgcggcatctgcttgcgcgagggcacgaagacgatgacgtggtcgtcggtctcgatcacggtatcggcgtcgggcaggatgatttcgtcctcgcgcaccagggcgccgatgctggcgcccttgggcaggctgatctcgcccaccggccggcccaccaccttggaattggagcggtcgccgtgggcgatcgcctccagcgcctcggccacgccctggcgcaggcggtgcaccgccgccacgtcgccgcggcgcacgtggcgcagcagttcgctcatggtggcttgcgacggcgacacggcgatgtcgatatggctgccctgcatcagttcgccataggcctggcggttgatcagcgcgatcaccttgcgcgcgcccagccgcttggccagcagcgacgacatgatgttgtcctcgtcgtcgctggtcagggccagccaggtgtccatgtcctcgatgttctcgcgttccagcagcgcctcgtcggtgccgctgccatgcagcaccagcacgctgtcgggcaactgcgtggccaggtattcgcagcgcttgaggtcgcgctcgatgatgcgcacgctgtagttttcctcggccagcgcgcgcgccagccgcaggccgatattgccgccgccggcgatcatcacgcggcgcacggccttctcggcctcgcgcagctggcgcacggcgcggcgggcatggcgcgtgtccaccaccagcaccacttcgtcgccgggcgcgatcacg

SEQ ID NO: 30966 - DNA, 1145 bp, Glycine max
  Peptide Sequence Number=SeqID_122651
atgcgcatgctgaagaacagctggccattcagctgttccgccgcctgccgcgcgggcaggatctaaccgaagaggcccaggcgctgctgccggtattgagcgacgccttcgaccgcatcgaggcggtgctgcagcagttcgaagaagggcatttccacgaggtgctgacggtggcggtggtcggcaccttcgccgtcggctggctgatgccgcggctggcggcgttccgcacggcgcacccgtttatcgatctgcgggtgctgacccacaacaatctggtcaatctgtcggccgacggcatggatttcgccatccgcttcggcgaaggcctctggcccgccacctgcaatatcaagctgttcgacgcgccgctgacggtgctttgcccgccggcggtcgccgcgcgcctgcgcacgccgcaggatctgcagcacgagcagctgatgcgcacctaccgcaaggatgagtgggaacgctggttcgcggcggcacaggtgacgccgtggcggatcaacggcccgcatgttccgccgcgaactggccgccggcgcgctgcagcggccgttcgccgccgaggccgcgctcggcgcctattggctgacccatttgaaatcgcgggatctgacgccggcgatgaaaacctttatcggctggatccgccgggaggcggaggaggaacagcagcagggctaggcagaaccgcgccggatcagcgtcggtggcagaatgacgttctgcgccggcaggtcggcgtcaccgatgcgctgcagcaggcgcgcggcggcgctgcgccccacttcccgcgccgaactggagacgaaggtcagcggcggctcggtcagttcggcctccggcacgtcgccgaagccgatcagcgccacctgccgcccgtagtaggcgtctaccccgtccgaaccgatgctgcggccgctgcgcgccaggccaaaataggcgccgagcgccaccgacgccttgtggcagacgatggcggtaatgttcgggtaatggcgcagcagttgctccgccgcttccgccgcctggcgctgccggcaatcgcactcgacgatccattcgctgcgaaacggcaggccatactgcaccagcgtggcgcaaaagccgcccagccgctcggcgcgcgtcaatga

SEQ ID NO: 30967 - DNA, 536 bp, Glycine max
  Peptide Sequence Number=SeqID_122652
aagtggacgaccatcatcttcccgatatcatcggacttgttcatctctagatgataaaagggacttcgatagtctttggataggaagggtgtgggtgaccatatgttgtctccgcgcgtcattggacttgtcatctctggatgacgaaggtgcggataaccataaggtgtgtccgcgtgctactagaccctcaggtcacgatagcagaattgagactttttcgcggtctcggccggacgacgctaacatctccgagaaggataaccataaggtgtgttcgcgtgctaccggacccttgggtcacgatagcgaaattgagacttttttgcggtctcggccagaagacgctgacatctcaggaaagctgacgaaaggtgcggataaccataaggtgtgtccgcatgctaccggacccttgggtcacaatagcgaaattgatacttttttgcggtctcggccggaagacgttgacatcttcgggaaggatgcagatgaccatattggtctctgcgtgtcaacgggctcgtttgcctctg

SEQ ID NO: 30968 - DNA, 639 bp, Glycine max
  Peptide Sequence Number=SeqID_122653
atggcacagaagaagagtactccaatcactcctaccacatccagaaggagcaaagttgcaatcccttccaagaagaggaaagaaatttcctcatctgattctgatgatgatgtcgaactagatgtctcgacatcaaagagggccaagaaatctgggaagaaggtgcctggaaatgtccctgatgcaccattggacaacatctcattccactccattggcaatgttgaaaggtggaaatttgtatatcaactgggaagagatgccttggattgcaaggagaccatggacctcatcaaggcagcaggactgatgaagacagtcaccaaattgggagactgttatgaaggcctagtcagggaattcattgtcaacattccctctgacataacaaacagaaaaagtgatgattatcagaaagtgtttgtcagaggaaagtgtgttagattctcccctgctgtgatcaacaaatatctgggcagacctactgatggagtgatagatattgctgtttctgagcatcaaattgccaaggaaatcactgccaaacaagtccagcattggccaaagaaagggaagctttctgcagggaagctgagtgtgaagtatgcaattctgcataggattggcgctgcaaactag

SEQ ID NO: 30969 - DNA, 363 bp, Glycine max
  Peptide Sequence Number=SeqID_122654
atgacaagttttcccctagccatcgttgtccgaataagcaatattttgttccacagtgggaagaagaggatgaacctgcattacaaccagatccaccagacgaggttgagacagctggttttggtgggaaatggaaatgccttgactgctgaaggattaattctagacttggaggtgaaaatccagggtcatacactgaagctaccagtgtacctacttcaagtttctggtgctgatctagtgctcggggctgcatggttggcaacaattaggcctcatctttctgattatagtactctgacattgaagttttacttgggtaatcaatttatcaccttgcatggcgagagaccctctctatga

SEQ ID NO: 30970 - DNA, 684 bp, Glycine max
  Peptide Sequence Number=SeqID_122655
atggcccatgaacaaaagttagtcgaggattttgcacaagtgtatgccgagaaagaagcaagagggagggtgattaatgcgctgcaccaagaagcgactgtgtggatggatagattcgccttgaccttgaatggaagtcaagacctcccgcgtctgttagccaaagcgaaggccatggccgaagaacagatgaaggccgatctatcggccttaaaagatcaaatggcttccatctcggagcccgccttgaatccgggcctagacagaaacacggccgtgttcggtcgaaggtatagtccgcaagcttatccttatggcctgcctccgaacttcaccccccgtgccactccggaagatttaagccaagcccctacttttgaagggcaactcccaccttatgaagactatcccggacaagacgatggggaaggagatacccatcttggccccctgctccacctcaaagatccatccccgcatgaactaccccatccaaacatagcccgccatatcccgacctcacccacacccgtaaaagaatctgttccctttgcggaagataagggaaagattgaggcgcttgaagagaggttaaaagcagtcgagggcctcggtaattaccctttctcggatttggcaaatttatgtcttgtgcccaacatcgtcatccctcccaagttcaaa

SEQ ID NO: 30971 - DNA, 204 bp, Glycine max
  Peptide Sequence Number=SeqID_122656
atggatgccttagaaatttacttgaataaagtagaaagacaattagacagaaagttgaaagttgttaggtctaatagaggtgaaacaagcttcatgatgatgaatcaagttgattcaagtagttttgatgatgacaaagatgatgacaaaaagcccaagaaaatgatttcaagattgagtcaacaagttcaagatcaagtttaa

SEQ ID NO: 30972 - DNA, 888 bp, Glycine max
  Peptide Sequence Number=SeqID_122657
atggcagagccatcaaagaagagaaagggatcatcctccaccgctaccgctgctgcccatcgccgtcacggcccatccggagcacccacagcacatattcctccttctctgtcatctccaagatcatcaacactgttttcatccgatgatcaacgtctacggtacctttctcagttttcttctagaataatcttagaccctaagtacctagacgtagagttctttaatgatgaaacgtttgattgctatcaagtgtttcaaaattctggtcttgttgatttcatgtcatttaaattgccatattatcctgaacttgtaaaggtcttctactgcaatttaaaaattcaggatggtattattatgtctgaggtgcatgcacaagcctctgaggaggatttgattcttatgtgggcttttcttaccggtcgtcagatcgactgggcccatttggttcggtaccgaatgcataaggcattacgagccaatgcacctcttccttatctacatttgattactctgtttttgcgtcattttcaaattccgcttgatgatgaaccctttgttcaagtcaagcgttcctttgcaattggtgctggtgcagtgacatcctttgggtatcgtaaagatcggaatagacaatggctgaagaaggatgcactccctcctcaagatgaacgtactccttcacctccccctcaacgtgaagattccgcactcatgaatgaagttctctccgaattacgaggtcttcgttcttatgttgatgaccgcttcgactcattagattcacgctttgccggtatggacattcgccttacacaacttgaagaggatgttggatacattcgtcagagttttgatcttccaccaccaccttcgtcttcttag

SEQ ID NO: 30973 - DNA, 513 bp, Glycine max
  Peptide Sequence Number=SeqID_122658
atgattatgaggggccaagacatttatagtagccaagatgaggctactactttaccttcctctagtgaaagtgaaaaagcaaaaggggaagaatctagtgaagaaatctacccccaagaagaaggacaaccattagtggttaaagagaagtgtaaggaggcacttgcaagcattgccacacctcttgggcttgagtttattcctcaagtaaagaagttgttggatgagggtttggttcgcaagagcttaaatccttgtgctttgttggtgcccaaaataggtattattaggtaccaagtccctaaaataggtggtatgatgaatgttttgagtggtgcaaccctcttttgtaaaatcactcgtacacctaacatcttcatggtgtgtgtacatagggacccattaggtgttgagggaaggagccaagagtatgaagaacctcgggatttgaggtcaaatcctttccaaggtggagggaatgatgcaatcctatcccgcaagggcattgggtag

SEQ ID NO: 30974 - DNA, 1017 bp, Glycine max
  Peptide Sequence Number=SeqID_122659
atggaggtacttatggcagaacgggccaatctagtctttcacaataaagtgataggtggaactgccattaaacgacttattagcagattaatagatcactttggaatggcatatacatcacatatcctggatcaagtaaagactctgggattccgtcaagctacggatacatccatttcattaggaattgatgaccttttaacaataccttctaaaggatggctagtccaagatgctgaacaacaaagttttattttggaacaacatcatcattatgggaatgtacatgcagtagaaaaattacgccaatccattgagatatggatgaccgacccctttaatccagtccatataatgtccttttcgggagctagaggaaatgcgtctcaagtacaccaattagtgggtatgagaggattaatgtcggatccacaaggacaaatgattgatttacctattcaaagcaatttgcgcgaagggctttctttaacagaatatataatttcttgctacggagctcgtaaaggggttgtagatactgctgtacgaacatcagatgctggatatcttacacgcagacttgttgaagtggttctacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacag

SEQ ID NO: 30975 - DNA, 261 bp, Glycine max
  Peptide Sequence Number=SeqID_122660
atgacggtgaaaacctctgacacatgcagctcccggagacggtcacagcttgtctcgggtgttgacgggtgtcggggctggcttaactatgcggcatcagagcagattgtactgagagtgcaccatatgcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 30976 - DNA, 297 bp, Glycine max
  Peptide Sequence Number=SeqID_122661
atggcctttgtggataactggatggtgggtaaggagagggtttgtttttggctgagtaatgacattgttggattggtgggaaacttggccatgttggaacggcagtcgcaacatggacccacttcgatcatttcgccaacgaagaccaaatccgcaaagctcgaagggaaccacttgggctgccagatccctccacctttgggtgtattctttgaaagattcatgccccctttttgcacatgttctatagttgcatcctatccggagtcatatcagaattgtgctgatactacctag

SEQ ID NO: 30977 - DNA, 180 bp, Glycine max
  Peptide Sequence Number=SeqID_122662
cgctgttcatgtgtcctccattgtcaagcgcgaagcctctggtgactgggaaacacgttattctgttgtcttccggattgaaaaaagagaaggagtagagacgagagtcgtcatcacggaaagggcaggatggacgaaatcagtgtcctatctttgctttcctcttatctccgatgagag

SEQ ID NO: 30978 - DNA, 681 bp, Glycine max
  Peptide Sequence Number=SeqID_122663
atgaaggcagtgcatgtcgcgcagtttgtcgtaaacggctatatcccgtgcagagcaatccggaagtcacctggcactgctgatcgccgtcagggcctcctcgctgggctccctcaaggacagatcatcgacatccaccaccctgtagcttcgctcggtgggatagttgagatgaagaatgtgaaccgagttctggcggccagcgtgctgatgcttgtactggcggcatgcagcagttcccagaccgccaacaagggcaatttcggcaaggctattcagaaatatcttgataccaagaacggactctgcgctgctttgcccgcgcgggaactccccttcagactggccaacgatggcagcttgggagagcgcgcgcgcctgcaggccaacgccttggtcgaggccgggttgctgagccgccaagcatctgaaatgaaatcgatgtttggcacatcgaccgtaccggctggcgagtacgcgcttacttccaaaggaaagaagttcctcgtagaaggcggcgcagaaacaattgcaggtcaagcagcgttctgcaccggcaagttcagggtgacagaggtggacacctttaccgagcccagcgagatgatgggcgtgaaattgtctcaggtgaacttccgctacaaggtcgaagatgcggacagctgggccagatcgaaagag

SEQ ID NO: 30979 - DNA, 171 bp, Glycine max
  Peptide Sequence Number=SeqID_122664
atggggggggggggggggtttggttgtttgggaaaactgccaggaaaccacattacaaacgaaacctcaaagagagttgggcttcgtcctcaaaaggaaacaacaccagaaaatctagccttccatggattcaaacagaaaacgcaaatgaaacatgaagcagaaatgtaa

SEQ ID NO: 30980 - DNA, 333 bp, Glycine max
  Peptide Sequence Number=SeqID_122665
atggcgaatcaagatgagtgggtcccattcatggatgtattagcattgttaatctttggggttgtcctctttccaaacgtggatggtttggtggacctagccgcaattgatgctttccttgcatatcaccatagcaaagaaagcccggtggtagctgtcttggtagacttatttgacacatttgaccgaaggtgcgaaaaaagtagtgcagggatcatctattgtttacccgcttgtcgcaacctacccttcggcgggagggcgacgcgtgactcgcgggatgcgtgttccacgaaaggaatacgcgcggagtcgccaccaacgtttatttga

SEQ ID NO: 30981 - DNA, 282 bp, Glycine max
  Peptide Sequence Number=SeqID_122666
atgtcataccgttctatgtgcctctgttgccggtgggtgactggggaaagagagaacggagaggagaataaggaaagggtgagggcacgacgagagcttgggtcaaccgacggtgcaaggtacaatcagggttatgagcttgagaggtccaaagggctttgttatgttgtgagtagcattgaagttgtgggtaacattgaagaagggaggaggaaaagaaaagtgatagacacaaaagaagaatgttttacttcctccaaatcatcaattgtgctaacgtga

SEQ ID NO: 30982 - DNA, 318 bp, Glycine max
  Peptide Sequence Number=SeqID_122667
atgtgggctttccttaccggtcgtcagatcgactgggctcacttggttcggtaccgaatgcataaggcattacgggccaatgcacctctcccttaccctcaattgataacgttgtttctgcgtcattttcaaattccgcttgatgatgaaccatttgttcaagtcaagcattcctttgcaattggtgctggtgcagtgacttcctttggatatcatactcgtttttccggaatggatattcgcctcacacagcttgaagaggatgtgggttatattcgtcagagtttcgatctcccaccaccacctccaccttcttag

SEQ ID NO: 30983 - DNA, 1176 bp, Glycine max
  Peptide Sequence Number=SeqID_122668
atggccctgaggaagcttgcctcaaagaggtccaggaaggacaaggcagccgaaggaactagttccgctccggagtatgatagtcaccgctttaggagtgctgtacaccagcagcgcttcgaggccatcaagggatggtcgtttctccgggagcgacgcgtccagctcagggacgacgagtatactgatttccaggaggaaataggacgccggcggtgggcatcactggtcactcccatggccaagtttgatccagaagtagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgacgggttcgatgaggaggccatcgcccagctgctatgtataccgggacaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgccagctggtatggcgcccactaggcaccctttggacccagataagtccaacaggccctgggattcccgcactgatcacaggactctgccagtcgttaggagtccccgttgcacctaccaaggtgattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 30984 - DNA, 324 bp, Glycine max
  Peptide Sequence Number=SeqID_122669
atgcagagacaaattatggtcattctgcgtcttgtatcaaccgagagaaacaaattcggtagtatcaggatgatgttctgctggcagggaggttcactggctgaatggtgtttcgctcgaacgaaattagtgtgttatctttacttcccttttatctccaataaaagacaagtaaagaggggcaactgtcataccctaatttcgtccggggaccatccgttgttaggatgcgaccctcgttggacaacttcgaggtacttggcacccaccgttaggcaattcgtgaagttccgtgacaagccggaaattaaaaggaagtgttag

SEQ ID NO: 30985 - DNA, 1407 bp, Glycine max
  Peptide Sequence Number=SeqID_122670
atgacccgctttacccgcgccattgatacgctgcaaccggctactccggctgcagggccgctggccgagaagggaccacaagaggtgcagcgcgcggcgcgcgccttcaacgcgatgcaaaagcgaatacaggaccatttgcaggagcgcgcgcggatcctggcggcgatctcccacgatttgcagacgccgattacccgtatgaagctaagagtcgagatggccgaccaatcggcactccgcgataagctgttacaggatctcgatagcatgacccgactggttcgcgaaggcatcgcgctggcacgatcggccgaaccgctggcagaagcgccgcagcggacgagtctcaatgcgttactggatagcatcgcctgtgattatgccgatatcggtaaagcggtcagttttcgtgccggtaaaggggcggacgtcatgacgcttcagccgcaggcgctgcggcggatcatgagtaacttaatcgataatgggctgaaatacgccgaaaaggtggaaatcagcctgagttacccgccgaatggcgatgttatcattcacgttgttgatgacggccccggcatcccggaaggagagctcaccgccgtactgcagccgttctatcgcctcgagcagtcacgtaatcgcgataccggcggtaccggtttggggctggcaatcgccgcccagctcgccgggcagatgcagggaagtttgaccctgcacaacctgcaacagggcggtcttgaggcgcggataaatccatatactaaaccgccgtttcacggacatatccgccatacagtcgcctgttgtaatgctgacgttgccacttcggcaacgttgcgaaggagaatgatcatggctgttgtaattgcatttttggccggtatgttgacgctgctcagcccctgcaccttaccggtgatcccgctggtgtttgccagcgtaagcgggcgtaaggggcaactgatcctgttgttgttcggtatggggttgatgtttaccgctgtatcgctgctggccacggcggcagggggatggttagtcaatctgactatcgtcgggcgttggctggcgctgggctttttggtcgttgtggctatcagtttgctgtcaacacgcgttgcaggctggctcggatcgccagcggttgcgttgggtaatcaacttaaccaacagagctatcgttatggcagtgggctcgcttcagtattcgccggactggcgattggactactttgggcgccgtgcgcgggaccgcggatgcgcgctgatgttgctgctattggggtggttcggcgcgcggctgatttcccgtttgcgcggtggtcaggcgataagtgggcggttacgccaactggctggcgtggcaatgttggccgcagtggcattaatcgccagcggtag

SEQ ID NO: 30986 - DNA, 483 bp, Glycine max
  Peptide Sequence Number=SeqID_122671
ggctacacgccctcaccttgggtactagttaccctcaccgttgagaggactacacgtcctcgccttgagaggactacacgtcctcaccatcagagggctgcacgccctcacctcagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttggggctacatgccctcaccttcagaggactacacgtcctcaccttttagaggactacacgtcctcgccatcagaggactacatgttccccattttcaaaggggggcatgccctcacctttagaggattgcacgtccttgccatcataggactacactccctcgccttcgaaaggcaacaa

SEQ ID NO: 30987 - DNA, 426 bp, Glycine max
  Peptide Sequence Number=SeqID_122672
atgaccttgaccaacaatcttgatgttctatgtatccaagaaacaaaaatcgaagccattgataggaggatatgtcagtatttatgggctgactgtaatgttaactcggaatgtgccccttcaattaatcccactctatttttaataagcaatcagccgacctcctcaattaattctatggggaattttgtggaagagagatgggaatggaagctaacatggagaaggaacttttttgaccgtgaaattgacatggtagctgattttatagctgacatcgagtcaggcaatatcaatcactccagcagggatttcctttgttggaagtctgatcctaatggcctatattccacaaagtctgcttacaaagtgctgcaggagggtcatgctagtgctattgaggacagggttcttaacatcatgtga

SEQ ID NO: 30988 - DNA, 141 bp, Glycine max
  Peptide Sequence Number=SeqID_122673
atgccttaccttctttccaaagccgtcaatcacattaagaattccttttctttagatgcctgtacctctttctttttactccgactcgacttcaaaggcacagttgactcgaggtatgaaaggattgaaccagagccgagg

SEQ ID NO: 30989 - DNA, 421 bp, Glycine max
  Peptide Sequence Number=SeqID_122674
cctctaccacagccagtacctacttatgtagagcctccaccatctctcactctagcagccggtgatgacactagaggcattcctagcccaggggttgacacctttggtgtagctgatgatgatgagaatcctgaaactggccaaatacaggctacagactcaagtggagaaggacaaagcccccaagtggagaaggatgaaggcccaagaacttttggcattttcataaaatttggtgagagcttctctatggattccttgttgaaccaatctcaaacttatcaaggtaatccttgtggcgtctactatggcttatcttccttcactggaagtggcgtcatccaaatctccgtagcctgtatcaagcgatccgctcctagtcaggatcactctggtatcagagctttggctcttgatacaa

SEQ ID NO: 30990 - DNA, 445 bp, Glycine max
  Peptide Sequence Number=SeqID_122675
ggaaaactggggaatgaccatacgccctttgtggctgctagtgaagtggcaactggattgcctagtgaaattgagttgcttttctcccttgaccttgctactttcatagccatagcaggaagcctggcaactttctttcgagacatggttgaagaaaaggctaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacg

SEQ ID NO: 30991 - DNA, 195 bp, Glycine max
  Peptide Sequence Number=SeqID_122676
gattgacggggcgaactgctagttttcggatacgagatatccaccctagtcactatggacgcatttgtccaattgacacgtcggaaggaatcaatgttggacttattggatctctagcaattcatgcgaggattggaaattctttggcacttaatcgagatattcaggaggaacagactgttccagcccgatacc

SEQ ID NO: 30992 - DNA, 457 bp, Glycine max
  Peptide Sequence Number=SeqID_122677
atgactctttcatcatggcagaataagctaaacaggaccatggctactccacctgccttgtctcctccttcttctccatctccttctctgtctaccttgaagcagacacgcaaagccacacggctacgatccttggccactagatcacttggggcagagagaccagtggtccatgtcgattctgcaaccggcaaggctgacgatccccacaagaagaaattaagaacatatttggggattgtcgctcatgataaagtcaacgtgacatacgagacttggaaggaagtccctgttgctcagaaggatttgatatgggaggatatccaggcggaatttgaaatccctgaagtatctgacagtaggacgaaaaggaagttacttcagaccgtgggcgagagatggaggcagtttaaatcagacctcacgaggaaatgggcccttgcagccgatcaggacg

SEQ ID NO: 30993 - DNA, 129 bp, Glycine max
  Peptide Sequence Number=SeqID_122678
atggataagagcttgaaggtaggagaagatgagtggagggaaaaggagagaaggagcacgaaattttatgtctcaaatgagcccactaatccaagatcaagttcaagattctccactaagtgtgcttag

SEQ ID NO: 30994 - DNA, 495 bp, Glycine max
  Peptide Sequence Number=SeqID_122679
atggcccacttggagctctcgattccatggcgcggctcaacagagcagccgcaccgtcctacctatttaaactatcctgagggaaacttcggagggaaccagctactagacggttcgattagtctttcgccctatacccaagtcagacgaacgatttgcacgtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 30995 - DNA, 375 bp, Glycine max
  Peptide Sequence Number=SeqID_122680
atgggttctgtcttgatccctgctgtaaaccaaccaacggagggtccgtgtcgccttcttaaaaacgtgcgttggggcatttcgctacccctagacgtcgtatctaagaaggggacaaattccccggaccccctaagcatgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaagtgtccatagaagccattgcatcactcacccaatactacgaccagcctttgagtgcttcacattcggagacttccaattag

SEQ ID NO: 30996 - DNA, 369 bp, Glycine max
  Peptide Sequence Number=SeqID_122681
atgtcaggaggtacacgtgattctcctcaaatttcagccagcccgcagcaattagaccttgcaccttacgcttcagggccctacaatgctcaatggtacgccccgacgcttctccatgacaagcacacgttgcgttcgagtcgtattctcggagaaacggaggttgatgaaccttggttggggttatggcgaccattgaattatcaagtagatatgggagcaagtggtgttcgtcattggaagtgtggtagacactttgtggttgattcagggatggcctttgtggataactgggcggtgggtaaggagaagctttgttattggttgagtaatgacattgttgggttggtgggaaacttggctgtatag

SEQ ID NO: 30997 - DNA, 174 bp, Glycine max
  Peptide Sequence Number=SeqID_122682
atgcacggagtcgccaccaatgtttatttgaggaaaacgtcgaaaaaactggaaaggtgtggtctacggactttaagtgtgaaaggtttgggaattgtatttacgcatggggaagggtgtttcccttgctcctacgtattcttcaattgtgataaggaaatcagacctacgtag

SEQ ID NO: 30998 - DNA, 1053 bp, Glycine max
  Peptide Sequence Number=SeqID_122683
atgaagcaaactcagaacggcgtagtaggcctgccgcagaagtacttggaaggcaaggcaagggacatggcaagccaagagaagtggggcccgtttgcagatacactagctttgctgatttttggggttgtcctctttctgaacgtggacggtttggtggacttagccgcaattgatgctttccttgcatatcaccatagcaaggaaagtccagtggtggctatcttggcggatttatttgatacctttgaccgaaggtgcgagaaaaatagtgcacggattgtctgttgcttacccgctctctgtgtgtggctgggactaggggttgtattaactataacccgcactcgccataagacagctagggtatccatgaggggagcgccaaccgaagaaagtctctcgcctttccttgtgagggatctaggcgcgcaaggtctcaaggttatacaaagagtccacaaggcgtggaggagtccgttgaggaaagacaaggagcttagaggcatccgaaacggcgtcatcggaggttatcatggatggctaagaattcacacgcggggcttagattggctctccaaatttaaagttatcgatgaggagaatttcgaagctccggaggaagatgaagaagtccgagctctaaaattagagctagggaaggcgagactcgccaaggagaagttcaagtcagctgctacacacatccggaaggagtgcaccgggttacaagaggaaaacgcggccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgtgcgaggtccaaaaggagtttggctcaacacttggaagccacggagcaaagcatgctagctatcatagggcaatacaaggaaaccttgaaccagtccatggcccatgaacaaaagctagtggaggattttgcacaa

SEQ ID NO: 30999 - DNA, 189 bp, Glycine max
  Peptide Sequence Number=SeqID_122684
atgggtgccaagtacctcgaagtggtcaagcgagggtcgcatcccaacaatggatggtccccggacgaaattaggaaacattctagtctagcgacgcgcggaattctgctctactgggcagagacgattgggtgcaattgcaaagggaagtgtcgtggttgtccaactttgtcgttttcaaaacactga

SEQ ID NO: 31000 - DNA, 357 bp, Glycine max
  Peptide Sequence Number=SeqID_122685
atgtggaaattaaagaagttagagtataacaatgaagaagagcaacacaataatgagcccatgatacataatgaacctattgtggaagaaccacaagaagtagcattaaggaggtctcaaagagaaaggagacaaattatttcgaatgattatatggacctcgtagaattgccaaaggattgtaagagagttggttgtaagtgggtcttcaagactaatgtgactctcatggcaaccttgaatgttacaaggctaaagtttttgctaagggatttactcagaaagatgacattgattacaaatagacgttttcaccaatctcacgaaaggattatttcaggattatcatggcattag

SEQ ID NO: 31001 - DNA, 132 bp, Glycine max
  Peptide Sequence Number=SeqID_122686
atgacttcacaaacttttacaaaaggtgtcaagggaaggagcccagagtatgaagaacctcgggatttgaggttaaatcctttccaaggtggaggggatgatgcaatcctaccccccaagggtattggatag

SEQ ID NO: 31002 - DNA, 300 bp, Glycine max
  Peptide Sequence Number=SeqID_122687
atggtgaagccaagaaacattctactaactctaaaggaacacaatgtcaatagttgtatgaccgttaaacagatatacaatgcaaaaagtgcatttcattgttccataagaggaagcgatcttgaaatgcaacatctgatgaagcttcttgaacacaacacctacaaaacaaaccggtacagactctcactgctcaattttatttgggtgacaccgactgggatgacattctctgccggttttgcatatgtggagggtgaacgcgttaataatttggtctggactttacaacgattctga

SEQ ID NO: 31003 - DNA, 507 bp, Glycine max
  Peptide Sequence Number=SeqID_122688
atgaaaaagaaaacaccgctaagcgcggaggatcaggcgctattccgccagctaatgaccggcacccggaaaattaaacaggacaccatcgtacaccgcccgcagcgcaagaagctcagcgaggtaccgcctaagcgattgctgcaggaacaggtggataacagccactatttttccgacgagtttcagccgttgctcaatacggaaggcgcgatgaagtacgtgcgcgcggatgtcagccattttgagctgaaaaagctgcgccgcggtgactattcgccggagctgtttctcgacctgcacggtttaacccaacagcaggcaaaacaagaattaggcgcgctgattgccgcctgccgccgcgaacatatcttctgcgcctgcgtgatgcacggacacggcaaacacatcctcaagcagcaaacgccgctgtggctggcgcaacatccgcatattatggcgttccatcaggcaccaaaagagtacggcggcgatgccgcgctattg

SEQ ID NO: 31004 - DNA, 270 bp, Glycine max
  Peptide Sequence Number=SeqID_122689
atgaggggagatgcatcaaagttcacacatatctctcccaagaaaagcgagcatgtaacttatggtgacaacaacaaaggtagaattcttggagttggaaaaataagtacgaattcttcaaactccattgaaaatgttctacttgttgaaggacttaagcacatcttgcttagttttcttctcgaaacatctcggaactttacggattccacaacgatgggtgttaaacattttgaggtggtcaaacgaaggtcgcatgccaacaaataa

SEQ ID NO: 31005 - DNA, 303 bp, Glycine max
  Peptide Sequence Number=SeqID_122690
atgtcaatccttaccctcggaagcaaaaaaggagaaggaaaatttccaatcaaagagaaagcaaaaaagaggggaaaggaaattcccaatcaaagagtgagagaaagcgaaaagaaaagaaagaaaattcccaatcaaagaatgggagaaaataaaaaaaagaagaagaaaaacgaaggaaagaaagttcctgatcaaagaagcagaagaaatgtgcagaaaggtcttttgaccggacaatatctgaacaatacagaattgtcaccaaatgaacgaaaagagggaaaggaagccatgacctaa

SEQ ID NO: 31006 - DNA, 246 bp, Glycine max
  Peptide Sequence Number=SeqID_122691
atgcagggtgaagttgcggaggcattacaatacatggtgtctcctcaagggaggaaaacatgcacatttgatgatctcgtgccttatgtggaaaaaattacaattttatccgaagagcaagagagagtcactgagccagtgtcacatggtcctgcatcagagcgtcaatttcccgcacaacagtttcacatgcttaagtcaagtattgaaactcaggggatagacagaagaagggacattgtttaa

SEQ ID NO: 31007 - DNA, 306 bp, Glycine max
  Peptide Sequence Number=SeqID_122692
atggctgtgaacatctctgacaagccaaagatcaagtattgtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgagcgctgagccttatccg

SEQ ID NO: 31008 - DNA, 720 bp, Glycine max
  Peptide Sequence Number=SeqID_122693
atggcgctgctcggcaactacttcggcacaccggccgcgccggtgacgatcctgcagggcatacgcgaggcggccaagggcgttgaagtgcgttatgcccgcggcgtcgacctcgtggaaggccgtgacgatcccggcgccacaccgctgatcgagccgacctacctgcggccctcggcggactcgcccgagcgcggcctgcgcggtgagtacttccgcacgcccgacctgtccggcactccgaccctggtgcgtaccgacgcgcagatcggcttccgctgggaccgcggctcgccgaccgacaacctgctggcacgcggcgaagcggcaccggggcaggggattcccaacgaccgcttcagcatccgctggagtggccaactgctgccacccatgtccggccgttaccggctggaggtagccggcgatgatggctaccgcctgtatctggacggcaagcgtgtgatcgatcattgggtgaatactgatcgcctgcatgccgagggcgtcgaactggacctgcaggccgggcgtgcctatgcgctgaaactggagtactacgacgaccagcgcgatgcgggcgtgcgccttgggtggcgcatgcccggcgccaaggcgcccttcgacgaagcgctggatgcagcacgcgatgccgatgtggtggtgttcgtcggtggcctcaccggcgatgtcgaaggcgaggagatgacggtcaactaa

SEQ ID NO: 31009 - DNA, 345 bp, Glycine max
  Peptide Sequence Number=SeqID_122694
atgacgactctttgcaaatccagaagaaaggtatcaaaggacaataattgtcaattttgtgaaattaagacatttccaaaaggattgcctaaagtggaaaacaagcaaaacatacaaagaaaggagctacaagaagcactcagcttcttgaaattgtgcatactgatatttgtggaccttttgatatatgatagaggtgataagtattatggaagatatgatgaaactgggcaacacccaagtccatttgctaagcttgttcagaaacgtgtatttgtgtgcaatacacaattcccggtacaccacaacaaaatgatgtatcagaaaggcgtaatagaactttaa

SEQ ID NO: 31010 - DNA, 60 bp, Glycine max
  Peptide Sequence Number=SeqID_122695
atcatggttaggacccaaggattaggtcgtgccttaaggcacgatactgacagaggtggg

SEQ ID NO: 31011 - DNA, 756 bp, Glycine max
  Peptide Sequence Number=SeqID_122696
atgcaatctcagggacttgcactacctcctgagcctctggttggttcctccggtcctcgagtaagcacaaaggggagatgtgttgatccctcaggaaacgatcctgagacgggtgactcagataggtgcggcttgtacatcaacgcatatcctgcccggctggttgccctagggagagtttatgagggatccactgttgttcataacactcctttgtggcctggccaagtaaaggtgagtgtagaggaggttacagatgcagatgctccagttcctgtacccactgatgaggtttccttagtggggcaagcacttcacaccttccttgcttggccgacacatctggtagttgtgtctccggtaaaaccacctccaaagcctgatccggaggttgatgatccactttatttgatgacattgaccatcctagagcttttcttgaggccttatcaggtttcttgggatgacaccatgttcggggtctttaatccagatttcccgctctacataaagcacgaagacctctctgaaatcgcacacggtggtcaatgtctcagcatatcagtgttacagttgtggattctgcatctcactgatacaagtatgcgagcggggaattctgatatctatggattccttgagccacagtccattcagaggtctgggcaatcgcagtttgagtctgaaagttacataaagacttggatgcagagttcaaaatgcgatgtctatcttggagcctacctaaatgggtaa

SEQ ID NO: 31012 - DNA, 445 bp, Glycine max
  Peptide Sequence Number=SeqID_122697
gtgtggatatggagcccactgaaagtgaggacgcgtagccctctaaaggcgagggcgtgtagccttctgaagttcaggacgtgtcgccttttgaaggcgaggcagtgtagtcctataatggcgaggacatgcaatcctctaaaggtgagggcgtgtagccctacaaaggtgaaggtacatgaccctttgaaggcgaggacgtgtagtcctctgaaggtgagggcgtgcagccctctgttggcaaggacgtgtagtcctcgaaaggtgagggcgtgtagccctcagaaggtgaaggagtgcagccctctgatggtgaggacgtgtagtcctctcaaggcgaggacatctagtcctctgacggtgagggtgagggcgtgcagccctctgatggtgaggacgtgtagtcctctcaaggcgaggacgtgtagtcctctcaacggtgagg

SEQ ID NO: 31013 - DNA, 201 bp, Glycine max
  Peptide Sequence Number=SeqID_122698
atgtcatcgcgacatagggatcgcgcccgcaggacaccccgtggacccaaagaagtccaacagggtcctgggcttccagctttgattacgggcctctatcagttctacggagtgcccgtcacccccagcaaggtcatcaggcctcctactaaccgagctttcatcaagaagtattgtgccccccaggcaagcgcaaggtga

SEQ ID NO: 31014 - DNA, 595 bp, Glycine max
  Peptide Sequence Number=SeqID_122699
ggattccctggtggtccacgagacccgtcagtgctcacatcatttgtcgagcatgttgcacatgccgtttggagtagacaagaacgtcctgatttgaagttagtgtcacatgggaggaaggtggcactgattgggaggccagtgcctgagattgaaggcctggtggctgccacaagattaagtccactgatagattgtttagttattactggcgatcctggacttatatccgcatttgtggagaggtggcacatttcccacgctctttctacggaggaggccagattcttgcttacggagttgctggaagtgtctgccgaggaggccagtgccgagacagcactcacacgtggagcatatgtacgattaggatgggttcgtgacatttatgagaccagatgtcaggcccggcggtggattgtagcagctcgcgcttatctgctacaccttgtcagttgcactctttttgctaataagagtgcaacatacgtgcatgtggtccaccttgacgctttccgggacctcgctcatagtggtggttacgcttgggaggttgctgcgctggttcatatgcatgaccagttagatgaggctt

SEQ ID NO: 31015 - DNA, 153 bp, Glycine max
  Peptide Sequence Number=SeqID_122700
atggtgttgcgtctccaatcatctttcttccttctccattccactaccattgatcttcaagaagcaaaggactccattgatgatgaagatccaaggcctacaagctctacatggagctacatcaaaacacttgagaaaacaaacaagcattga

SEQ ID NO: 31016 - DNA, 720 bp, Glycine max
  Peptide Sequence Number=SeqID_122701
gggaggtgcttgccgcccagctcgcccaggcgagctcaggtcgcccaggcgagccaggttgcttcctccagaagcaacagccttctggaggaatattctggagggcccaaggtatgacagcctccatgatggaggccatgttaggaatgaggcagctcatggagaaaaacgcggccaccgctgctgctgtcagttcggctgccgaagcagacccaactctcttggcaactgcgcaccatcctccctcaaacatagtaggacggggaagggacacactggggcacgatggcaaccctcacctgggatacaaccgagcggcttacccttatggattgccgcccaactactcaccacccgtcttgcaagacgatgcgggccatattgcttctcccgtccttgaaagagagcctcctcaacagcccgacgaggtccacaaagacccacaagactatgctcgaagggatgtcgagttctatcccccgatccccgaagggccggcacctagcacgttgcctcaacccaacatcgcgacacaaccaatagttttgtccacggaaggaccacccccggcaactgaagaaaggaggaagctcgatctcctcgaggaaagattgagagccgtggaaggatttggggactatccgttcgcagacatgatggatctttgcttggtacccgatgttgttattcccccgaagttcaaagtgccggactcgacaa

SEQ ID NO: 31017 - DNA, 521 bp, Glycine max
  Peptide Sequence Number=SeqID_122702
atgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggg

SEQ ID NO: 31018 - DNA, 534 bp, Glycine max
  Peptide Sequence Number=SeqID_122703
atgttgaagaacggtcgagaatcttcgcgtaattactcacagaaacgttacggaaacgttatggaagcgcctcggcttggattttcttcacggaaacaattttcctcagcaaatttaagagaatacgaaatgccaagaaggctgacccttttcttcttcactcctccccctatttatagcaaaataggggaggagcttgccacccagctcgcccaggcgagcatgttgcttcctccagaagcacagccttctggaggaaggatctggaatcccaagtgggccagattgctatttgcacccccccttttactaagtgcaccccctttctatttttttgctttcgaagaagttacggaaacttacggattgcgcaaaaacacctcttttcgacttccgccacattacggaatttcacggatcgcgcaagcctgcttccttttgatttccgagacgtctcaggacttcgtttattgtgcaacaaaggacgccaagtacctcaaagcggctaaccaaaggttgcatgtcatcaagtaa

SEQ ID NO: 31019 - DNA, 471 bp, Glycine max
  Peptide Sequence Number=SeqID_122704
atggtgcctaccaggcaccctctggacccagataagtccaacagggccctgggatttcccgctttgatcacaggactctgccagtcgttcggagtccccgttgcacctaccaaggtgattcggccgcccatcacccgggcttttattgagaagtattgcacgcaaagacaggcccagggtgatgctccgcaggccgcagacgcgccgccaccccatcaggctggcccagctggatcatttgatatggagcagtatttacggcatttgagccagggttttacttcttttccatgccccactccggatcagttcagggcagaggtcgcatggcccggagattggcccgaggcccgggcaggaaaggcaccagcagaggcacccgtagaggctcccgacgaggcagatgaggcccgcgaggacgaggagatgactgatttgcttgatttcttgggagggagcggagccacatga

SEQ ID NO: 31020 - DNA, 228 bp, Glycine max
  Peptide Sequence Number=SeqID_122705
atggaatttggtgatattgttgttcattttaacattcttgatgccatgaaacatccatctgaggatcattctattttttgtgctgagataattgatcagattgttgatgattatatgtttgattttgattctgttcttcatggtgttgtacctcttgatgctgaggaaccttcttcttctcctaccctggttcctcccactgttcagccccacccacaccagagttga

SEQ ID NO: 31021 - DNA, 553 bp, Glycine max
  Peptide Sequence Number=SeqID_122706
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtactcaacctacagaggctgggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31022 - DNA, 738 bp, Glycine max
  Peptide Sequence Number=SeqID_122707
catgggatcaagacaaatgcctccgctcaagaaaaggttctaccaagtcaagatcaagggtctagaggtcaccagtttacaagaatgaagggagttaatggggcagctccagcggcaagccttgcgcaaagcctacgggccttggcaagtcaaaacgagtggcctcctttcattgatatcctagcgttgttaatattcggagtggtcctctttctaaacatggatggtttggtggacctagcagcaattgacgctttcctcgcctttcaccacaacaaggaaagcccagtcgtcgtcgtcttggctgacatatacgacacatttgatcgaaggggagcatcatcggtggagagcctcacacctttcatcacacagggtttcagtgaccccaacgcaaggctgagagccgctaaagaggaagaggctaaagccccagaggaaagcgaagagaatgacaaactgagggacatcaatacaaccactgccaaagccttggagcaagaaaccaagagggctcggaagaaagaacacgaccgaaataagttccgaggagctttgagtttgtctcagcagctgagcaagaccaaagcaaacatgttagccatcatgggcaagtacaaagaagaactggatttggcaacagcccatgagcatatggtaatggatgagtacgcccaagtgtacgcggaaaaggaggcaaggggaagggtgattgactcattgcaccgagaagcgtga

SEQ ID NO: 31023 - DNA, 615 bp, Glycine max
  Peptide Sequence Number=SeqID_122708
atggcagcaaataaccaacaatttggtactagagttgttgcaccattaaggactactacaagtgaagtttttgtttctatggttgctgataatcagaggctggagaataaacttaaagagtttacatcccttgtaaggcagctagccattggtcaacaaaagaatatgatgatagccaatcaaccaaggttgtgtggtatatgttgtgcttctgatcattcaacagatgcatgctccacaatccaggaaacaaaacaagctgctgatgtttctgccatgcaacctggacaaccattcaaacctcaacaacaacaatataatccttattccaacacctataattctggttctagcaatattcccgcacaaacaattattaatccaaaggggaatatgagtgctattacctttagaagtggcggagagcttcttaagccaacagatgctggtgccaaaattgatgatagtgtccaaacagattctacaccaaaacatattcctctaccttttccttctagatccattcctacaaagaaagtggagcttcattctgatcttcttgagacatttaggagggtggatgtcaagattcccctattggatgcaatcaaatag

SEQ ID NO: 31024 - DNA, 572 bp, Glycine max
  Peptide Sequence Number=SeqID_122709
acgctgaggcaccttgtagtactcaaggatggataaacttggttgaaacaggcattgttggtctggctgctggtctagcgatccctcctagccgccgcctagagtgcagcctgcctgttgaagatcagatctttatcagtaatgcaacctccattttgctcattcatggagttgtatttagtacctctaagaaatatgattatccaccgttagtcagtaatgtgggttggcttggattacttagtgttgcgcgcctaggagggcagcgcgctttgggatgcggaggagcgaagcagctcgaacgaatgaatgtgagaggagcgaaaaaagcccagctccctaacctaatgcggcaccgggttcggaccgcagggaaccgtagcatgggaggatctggctcgaatacccctggttctggaaggcacatgagtccgaacgctatgttgaatgtgcgaccgacactacactacgtagtcgggaaacctgtcgtgccagctgcattaatgaatcggccaacgcgcggggagaggcggtttgcgtattgggcgctcttccgcttcctcgctcactga

SEQ ID NO: 31025 - DNA, 321 bp, Glycine max
  Peptide Sequence Number=SeqID_122710
gacaaagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcaaagcttgaaagagcccgggtagtcgaagagaagttcaagtccatagccatcaaagggctttatatggcagaactagtgagctcaagctccgaagaggtgaaaggaatcatcacgggtcaaaggcatgatcttgaaggacgagctaaaggcttgccctag

SEQ ID NO: 31026 - DNA, 822 bp, Glycine max
  Peptide Sequence Number=SeqID_122711
ctgaaaaccccagaagaagcaactgagctcatagagaacatgtcagccagtgatcatgacattctgagggacagaacccatcaacccacaaagaagagcctgtcacaggttgtaccatttgtggtgaagttcatgagacaggtcaatgcctctcaactgaagaaaacactcaagaaattcatttcatggggaatcaacaatggaaagggcttccagcaaggtccttataatcagcaaggacagtggaggacacaccctggcaaccagttcaataaagaccagggtggatcctcaaacataccaattcaacaagggcctaacatctttcagaggacaactaagttggaagagaccttgactcagtttatgcaggtaatgatgtcaaatcacaagagtactgagtcagcactaaagaaccttgaggtccaggtgggacaactggccaagcagatagctaacaagtcatccaacagttttggagctaatacgaaaaataatcctaaggaggaatgcaaggctgtgatgactaggagtaaaaagtttgtggaagctgagcataaagagagtgtggtgtacaaggagcaaacaggtgaaaagacaagtgttaaggtaaaggaaaatgatgtgaagggtaaagagaatcaggaaaaagggaagaaaataatggtccagaataaagagatggagaaccaagaaaaagaaaaagatggagaaaaagaaaaagaaaatgagaaaaatgaaaaagaggaaaaaaataagatttcagagaagagtagaagtggaaaggctgtggacaaaggtgtggaagtaccatatcttgtg

SEQ ID NO: 31027 - DNA, 696 bp, Glycine max
  Peptide Sequence Number=SeqID_122712
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacacttcttcgccccgttttcaccatgggcaaatattatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 31028 - DNA, 486 bp, Glycine max
  Peptide Sequence Number=SeqID_122713
ggggtcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccccgtaacacgcttgcctctacttacggatcaacatactaccctaacggatcaacctaactctggcaacaatgaactaaacgacatggttatgatgcttacctcaacggtggacggtgacgaagctccctcgacggtggacagtggcgttgctcttcacggaaacctcctcaatgcacctcgcaacctcttcacgacaagctcctcttcacgacaacaatggtggctgaagaagaagaagaacctcttcccgacaacctcctcttaa

SEQ ID NO: 31029 - DNA, 753 bp, Glycine max
  Peptide Sequence Number=SeqID_122714
atggctacctcaccaaaagaacttccgcttctggttcacccgctgtaccatcatctccgcaccaggacaaccagaattcaacatccaacccatacaaatattcctggtcaagcttctgtccctgagaaactggttcccagaagacaacagggagtgaagattgctgaaaaccctaaccctgcaataagtcctagggaagtagacacggagatggacaagaaaatccgcagtattgtgagtagcattctgaaagatgcttctgttcctgaagctgatgaagatgtcccaacatcgtccaacccaaatgtttctgtgcctaatgtcaagaaagatgttccaacatcttccggcccaaatgctgaagtactctcttcccccagcaaagagagatcaacagaggaagatgatcaagcgacaaaggagacccctgcaccaagggcaccagaacctgctccaggtgacctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgctatcccctccaagaaaaggaaagaaatttcctcatccgattcagatgatgatgtcgaactagatgtctcgacatctaagagggccaagaaatctggaagaaag

SEQ ID NO: 31030 - DNA, 252 bp, Glycine max
  Peptide Sequence Number=SeqID_122715
atgaatcatccaggaagcgcaagggttcatccacctccgctgcggcaactcgaacaccacgtcccggagccaccaaagcatccacggtgtcatgccctaatttcgtccggggattattacttgatgacatgcaacctttgtcccgagacgtctcagaaatcaaaaggaagctggcttacgcaatccgtgaaattccgtaatgtggcggaaatcgaaaagaggtgtttctgcgcaatccgtgagtttccataa

SEQ ID NO: 31031 - DNA, 222 bp, Glycine max
  Peptide Sequence Number=SeqID_122716
gcgcagagcgagacactacaacagcctggggatggccggcagcgggcaacagacgcaccgctgccacctccaaagtccctcagctcatctacaaaagctggagcgttgcctacgacccgtggtcgaccagcaggcgaccatgtccaaagccaaagcatgcaacaaggacaggcaaatatcctcatagctaggttccctgaccctaaccatggtgttaaaacg

SEQ ID NO: 31032 - DNA, 180 bp, Glycine max
  Peptide Sequence Number=SeqID_122717
atgtctttcctagcgatcataactccgatctccctctgcctaagtgctagttggtgtacgccacccaccaggcaccctctggacccggataagtctaacagggccctggggttttcagatctgatcataggcctctaccaatccttcggagttcaggtcacccccagcaaagtgatctga

SEQ ID NO: 31033 - DNA, 579 bp, Glycine max
  Peptide Sequence Number=SeqID_122718
atgacgactttggcaacaggcgggaaatgcatgacagcgggaaatgaaaacaatctgatttggatcgacctggaaatgaccggactggatccggagcgtgatcgcattattgagatcgccaccattgtaacggacgccaaccttaatattctggccgaaggtccggtactggcggtgcatcagtccgatgcgcagctggcgctgatggatgactggaatgtacgcacccacaccaatagcgggctggttgcgcgcgtgaaggccagccagcatgacgatcgtgcggcggagcaggcgacgattgcgtttctgcagcagtgggttccggccaacacctcaccgatttgcggcaacagcattggccaggatcgccgcttcctgtttaagtacatgccggagctggaagcctatttccactaccgctatcttgatgtcagcacgctgaaagagctggcgcgccgctggaagccagagattctgccaggctttaaaaaggccggtacgcatcaggcgctggacgacattcgcgagtccattgccgagctggcctactaccgcgagcacttcctgcagctgtaa

SEQ ID NO: 31034 - DNA, 195 bp, Glycine max
  Peptide Sequence Number=SeqID_122719
atgaatgtttcgagtggtgcaaccctcttttgtaaaatcacttgtacacctaacatcttcatgattcatgtacatagggactcattaggtgttgagggaaggagcccagagtatgaagaactttgggatttgaggtcaaatcctttccaaggtgaaggggatgatgcaatgctaccccgtaagggcattggatag

SEQ ID NO: 31035 - DNA, 437 bp, Glycine max
  Peptide Sequence Number=SeqID_122720
ttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 31036 - DNA, 777 bp, Glycine max
  Peptide Sequence Number=SeqID_122721
atgggtaaccccgttaaggaaagatcaaattggctcgccaagttgaaagtcgtcagcgaagagagttttgaagcaccggaagaggacgaagaagtccaagctctcatatacgagttaggaaagctgaaacttgccaaggagaagttcaagttggccgctacacacatccggaagaagtgtgccggattacgggaagagaatgcaactaccgcaagagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagctatcatcgccaagtaccaagaagagttaggtctagccacggcccacgagcatagggtcgcggacgagtatgcccaagtatacgcggaaaaaaaggctagaggaagggtgatcgactctttacaccaagaggcaaccatgtggatggatcggtttgctcttaccttgaacaggagtcaagaacttccccgattgttagccaaggccaaggcgatggcggacacctactccgcccccgaagaaattcatgggcttctcggctattgtcagcatatgatagacttaatggcccacataattagaatcgctaggaaacttgtatgtctctcagaccttgactag

SEQ ID NO: 31037 - DNA, 183 bp, Glycine max
  Peptide Sequence Number=SeqID_122722
atgcaatcacagggacttgcactgcctccggagcctgaggtagctatgtctccagcaaaacctgcagataggccggatcctgagcatctgactgagacaagtatgcgagcggggaattccgatgtgtatggattcctcgagccacagtccattcagagatctggacaatcgcaatttgaataa

SEQ ID NO: 31038 - DNA, 777 bp, Glycine max
  Peptide Sequence Number=SeqID_122723
atgtctcttgggggttatgaatatttagaaaaaaagttgatcgatgagaagagaaagaaaaaactagaggaagttactcaatccggaagcactaacaccgtcattgatcctccatctcccatcaaacgacacgtgaagtggaagttagcccacaccaagaaaactggtgacatgacatctgaagcagcaaaggaaattgctgacaagattgatgcgcttgaggagcaggcctcacagggttcctttgttacccatgaacatcaagatatactgactgctgccattgggcgaccagaagaccctggtcgtgtgcgtgctgtaggagtcggtataaccatcaagcaatactttggatcaacttcaaggacctcctccattgctcccgaatacctgcaacagttgacgcaacaaatcaaggaccaactggaggattcaatcacagaaaaagtcactcgacgactaatgttatccctcagccaaatgcaatcacagggactcgcactgcctcttgagcctgatgttggtccttcagctgttcgtgtcagcacaaaggagagttgtgttaatccctcaggaaacaatccagacaccggtgactcatacaaatgtgggttgtatattaaagaatatccttctcgcctggttgtcctaggaagagtttatgagggatccacaaccattcataacattcctttgctgcatgatcaagtcaaggttggtgttaaggagattagagatgcagatgctcccattcctgtacccactaaagaggttaag

SEQ ID NO: 31039 - DNA, 99 bp, Glycine max
  Peptide Sequence Number=SeqID_122724
atggaaatgatggctggacgaaatgatcgtgcgatagctgatgctctccaagccttagctcaggctatatggaatccaaataggggagaagctgcttga

SEQ ID NO: 31040 - DNA, 594 bp, Glycine max
  Peptide Sequence Number=SeqID_122725
atgcgagcacatccagagagggaggctatcacgcatctactatgcataccggggcaagatttcacctgtgccgctgcaaaaagacgagtgtggatcatgcgcaccaacatgaccacttttacatggatatggatgacgttgctatttagtaacattctgcccagcgaccagaatgccaatctccccctgcagatgtatcgggatcgcgcccataagacgcccagtggaccggaagaagtccaacagggccctggggtttccagctcatgttgcgggcctctgtcagtccaacagggtgtccattcccccagcgaggaatcgcgcccgcaagacacccagtggacccgaagaagtccaacagggtcttggagttgccaagctctaattacgggcctctgtcagttctacggagtgcctatcgcccccagcaagatcatcaggccccctactaatcgagatttcatcaagaattactgtgtccccaggcaggcgcagggcgaaacaccacagcagcctagggatggccggcaatgggcaacagacgcaccgccatcacctctagaattcacctcagctcatccacaaaaaggttag

SEQ ID NO: 31041 - DNA, 147 bp, Glycine max
  Peptide Sequence Number=SeqID_122726
atgaaggagtgttcatggttggatatgttggatatcagcttctttgacaaggaaaccaatactggtgaggttgttggaaggatgtcaggtgacacacttcttattcaagaagccctgggagagaagtacttaatggggatcctctag

SEQ ID NO: 31042 - DNA, 213 bp, Glycine max
  Peptide Sequence Number=SeqID_122727
atggcctcctatggtgtggcatctcctctctctcttccttctccattccgctgccatttatcttccaagaagcaaaagaatccattgatgaagaagatcctaggcctacaagctccaatggagcttacatcatgtggtatccaacaactcctttacttgaggaataacctcaagctcaagaggtatggcggtgctaagggatgtatcccttga

SEQ ID NO: 31043 - DNA, 279 bp, Glycine max
  Peptide Sequence Number=SeqID_122728
atgcgcatagacgaattttgtgcccttggccattcagatttcgcaaattgggtgataaacgcgcatagacgaattctgcaccctttatcattcaggagtagcgagtcgagtggaacatcaaattgggtggtaaatgctcagagacagattctgcgccctttgtcattcagatttcgcaagtcgagtgataaacgcgcagagacagattctgcgccctttgtcattcagggacagttccgctggcagggaggttcactggccgaatggtgtttcgcttga

SEQ ID NO: 31044 - DNA, 180 bp, Glycine max
  Peptide Sequence Number=SeqID_122729
atggaggcattgcgcgaggctggtgtaattgaccttgacggtaaaaaaagagattcgtgcttgatgcatccagaggtgttgcacaatgtggaaacttgcccaatagctgaggatttgctgcagggactgataagtaggggtcaaattgaaatctgcagtgcaaagaaggaggaaggaaag

SEQ ID NO: 31045 - DNA, 210 bp, Glycine max
  Peptide Sequence Number=SeqID_122730
atggataagagcttgaaggtaggagaagatgagtggagggagaaggagagaagaagcacgaaattttatgcctcaaatgagcctaatcctgatcaggcattgtccgcaaattcctcttgttggactaaactcgaccagaaccgcattaagacaaacatacaacaactaggttaccgtaccccgatccctcgtgataatacgataaactag

SEQ ID NO: 31046 - DNA, 152 bp, Glycine max
  Peptide Sequence Number=SeqID_122731
ttggttgatcctttgaccttgcagcttgagattgtaaagttgcaaactttgaaggtggggattgcgagttttgattctggaatgattgaaagggtgagggaaatcgaagattttgaagatgtggttgttgttatgacaggaaagggattgat

SEQ ID NO: 31047 - DNA, 438 bp, Glycine max
  Peptide Sequence Number=SeqID_122732
atggcaagcttcttcttccgcactttgaaatttggttcccttcttctcctccacaggtattggcatcctccattgactagctttgttcgtttcttccgccatccagacgaaggttcttccgcgagaagaaccttcttccacgcatgtggaaggggcagttggatattgaagcggaagaaggagttcttccgcgggaacctgcgaaagaaaagggagaaggttcttccgcgggttctggtggaagaaggttccgaaggttcttccgcgggatccagcgaaagaactatgtcttccgcggatctcgcagaagaacctgcggaaccttcttccgcaggcaacatttcctggtcgcggaagaacctatggaaccttcttccgcaagctacctatccttctcgtcgaagaacattcgaaacttctttcgcggagcatgttttg

SEQ ID NO: 31048 - DNA, 243 bp, Glycine max
  Peptide Sequence Number=SeqID_122733
atggaagagcttgacaacaagaacgactttgacatcgagtacaacccccttgtccccgctggcgccactatcatcgtcggtaatgaaaacatcgccgtcattgagagaaagagcttcgtgttcacacagggttgggacttcgaccccaacaacgatgtctaccattttagagaggctggaatggcaaggacaggattgatgatttatagtcttctagtattcttaaaggtgaagagtttctaa

SEQ ID NO: 31049 - DNA, 1614 bp, Glycine max
  Peptide Sequence Number=SeqID_122734
atgtctcggcactgcgattgttgttgcggcggaatcccacctgggattctgctaatacgaggaaagcaatggaacctccagacgcaccgctacatggtgctcctcaccaccttcgtcgcctacgcgtgctaccacgcgtcaagaaaacccaccggaatagtcaagagcgtcttatgccccgaacacaaaggaacctcgcaaggctggagcccattcaacggtcacgatggaacgtcgaagctgggcgaaatcgacgtggcgttcttagcgtgttactctatcgggatgtacgtggcggggcacttaggagataccctcgaccttcgcttgttcctggcaaccggaatggtcggtagcgggatattcgtatcactcttcggaatgggatacttctggaacatacactcttttttgttctacctttcaatgcaaatgattgctggcatgtttcaggccacggggtggccttcggttgtggcggttatcggtaactggttcgggaagaggaagagagggctcataatgggggtgtggaacgcgcatacctcggtgggtaacattagtggttcccttcttgcggcgagtgttttggaatatgggtggggttggtcttttgtggtgcctggtgctttgattgttggtggtggtgtggttgtgtatttgtttctggctccttatcctgaggatgtagggttctcttgtgttcatggtggtggtgatgaagaggctcaggtgaatgatgagaaaggtggtggtgttcctactagagaagggtccgtgaatagaaaaagcgttgggcttgttgaggcgtgcatgattcctggtgttataccttttgcgctgtgccttttcttcgccaagcttgttgcctacacgttcttgtattggttacccttttacttgactcagacagatgtaaattgcatgggtcataaatctttacatcttaattttgcagaaattggtgggaagtatatctcggttaagtctgctggaaacctttcaaccttgttcgatgtagggggcattgttgggggtattcttgctggctacgtatctgataaactcaatgcccgtgctataactgcagccagcttcatgtatgcagcaattccttctatgcttttataccggcattatggaagtgtttctatgaatgccaacattggacttatgatggtgactggattatttgtaaatggaccttatgcacttatcaccacggctgtctctgctgacttgggtacacatagttctctcaaaggagattctcgtgctctagctacagtgactgccattatagatggtactggatctgttggtgcagctcttggccctcttctcactgggttcatttcaacaaggggatggaatgaagttttcatgatgctagttcttggtgcttttattgcggggcttcttttgtcgcgtttgatcatagcagaaattgcagagagaagtggcaaacctttatcaagtggacagcaaaatcctgaagccactgcatctcaaccgcttctggaggaggatagactctggaaggttccaaaggggatcagaactcacaactggggatggaactcgattccttttcatcgtgaattgattttctga

SEQ ID NO: 31050 - DNA, 471 bp, Glycine max
  Peptide Sequence Number=SeqID_122735
atgaaggatattgcttcgtggaacaccatgatttctggttatgcgcaagttggactcatggccgacactcggaggttgttcacggcaatgccggagaaaaactgcttctcgtggagtgccattgtgtctggatatgtggcttgtggggatttggattctgcttggagtgtttttatgctgcgcctggtagaattggcagaaagattgttccagcaaatgtcaatgaggacattggtgacatggaattctatcattgctgggtatgttgagaatgggagggcagaggatgggttaaggctattcaggacaatgtcagaaactggggttaagcctaatgctttgagcttgactagtgtcttgttgggttgtagtgatttgtctgcattgcatctggataagcaagttcatcagttagtttgtaaatctcttttgagtagtgatacgatggatggcaggaacttcgttggttag

SEQ ID NO: 31051 - DNA, 408 bp, Glycine max
  Peptide Sequence Number=SeqID_122736
atggcaagcaaagagaaaaaaaggagctctctcgcctctctctctcccgcgtcgcgtttcaacttcttcttcttcctcggagttctgcttcttcttcttcaatcttcttcaatcatctgcttcttcaatcttcttcttgtgcgccgccgcgattccatcttcttcactgctcttggcgtttctgcttcttggcgtttcaattccttcattgttcttcgcatttcttcttcgcgtttctgcgtaggactgtgggtgtggttcttcttcacgtttctgcttcatcttcaacactcagcttcttcctcgaggtacgttttctcctttgcgttgcttcttcttcctccattgttgtcgtcgatggcggaaaccgccattgggaagttgatgggttgtttacggatcacctga

SEQ ID NO: 31052 - DNA, 228 bp, Glycine max
  Peptide Sequence Number=SeqID_122737
atgaagaggatgaaaggttttaaatgctggctttggagggtgcttcctgtgaccactgaacagttgccatcagcagttttggaccacaattcaaagcttaataatattccaacactaccccttcttctgggggcaccagcaacatcaccaatcaatcaaccgaggaaggaagaaaatggttgcaggaaaacacgctcaacaactactcattatagtaaaaaagtttaa

SEQ ID NO: 31053 - DNA, 816 bp, Glycine max
  Peptide Sequence Number=SeqID_122738
atgtttcagcctcaaactgttttagattcaaatggctatccagtctatcatagaagaaatgatgatcgtacaatctcaaagaatggagttattattgataatagatatatagtaccttacaatgcaaaattgttgaagaaataccaaacacatataaatattgaatggtgtaatcaaaatacttccattacatatctatttaaatacataaacaaaggttatgacagagtcactgttgtttttgtttatgatgctaatggtggtgcacttgagaatcctatcactcaaaatgatgagattaaagaatatgcagattgcagatatatttctccctgtgaagctacttggagaattttttgttttccaatacatgctagaaagcctgctgtcgagaaattacattttcatctgctaaggcaacacagtgttatttatgaagacgatgatgatatagatgatatcctatcaaagccaagcatttcagattcaaaattcttagcttggatgaataacaacaaatatttttcagaaggacctacttcatttgaggatattagaccagttgaaaatgttctataccctacatatagagaagcatgcttcacagtgggttttttgaaagatgacagagaatttgtggaagcaatcaaagaagctaaggactggggcacaactaattatttgaggaaattatttgtcttaatgctattaataggtgctattactaaacttgaagaactttggaatcagacatggaattggttagctgaagacattgcatatcattataaaaaaacaactctgaacacagattag

SEQ ID NO: 31054 - DNA, 267 bp, Glycine max
  Peptide Sequence Number=SeqID_122739
atgaaaggatcatatccgccgtcagtcagtaattctttcagggcgtctaaactcatgatcaacgagcttgtgctggaaatccaagaattcagagagaggcttttagatttagggattgaggatggtgatgttgatttaaatgcctctcctcaagcactagataggctattgggttgtttccttgcattcaaagtcaagccatgttgcaagatcaagagttcaatacttgactcgactgaccctacagagcttgaatttgtaagctaa

SEQ ID NO: 31055 - DNA, 987 bp, Glycine max
  Peptide Sequence Number=SeqID_122740
ctgacgatcacattggatgatgtgtcgtcactccttcatttgcctatcactggcgccttgcacagttttcatgctctttctatggaggaggccagatttttgctgacagagttgctcgaggcccggcggtggattgtcgcagctcgcgtttatctgctgcaccttgtcggttgcactctttttgctaatacgagtgcaacatacgtgcatgtggttcaccttgacgctttccgggacctcgctcaaagtggtggttacgcttggggagttgccgcgctggttcatatgtatgaccagttagatgaggcttgtaggaccaccacccgacaacttgcggggtacttgacgctacttcagtgctggatctatgagcacttccctagtgtgcaccagtgcgtgacagacgatacataccaggagacgtccccacgtgcttcacggtggttgacgtcgaagacgcacatgaagggaatcataggagcaccttacagggcacgttgtgatggtttgaccgtcacagatgagatttcatctttccagggtcagctgagatggggtcctatggtggtcacagttcgaccggagagggtgtttgcggagcacttactacttgcgggtcagctttgtctagtgcctgggcaggtatatgcagattacatggagtggtttttccgcatatctcacacattcatgataccgacccaggcatgtgaccagccgagagatgcaccagctgcagaccctgaggactacatacagtcgcccagcccccaggttccaatagcatttgacccccctccacatgtggatggttacaacggatatgaggcgattgcacagaggttggagcgtgtgctcaagcttaggatagtcactgcaggcacagagttatatgacattatgcaagattgcctgacgattgcgagagggggacccagtgctgatgggactgtcagggctcgtcagagacgccgcacggaccattga

SEQ ID NO: 31056 - DNA, 339 bp, Glycine max
  Peptide Sequence Number=SeqID_122741
atggatattatcaagagtatcagaggtcatcacacttgtctcgcgttagtactcagacaagatcatcggcaacttgacaaacgcgtcatagcacagatcatccaatcaattgtcaaaacaaattcaatcatctccatcaagacgttgatggcagagatcaaaatgttcatgaattatactccatcctacaaaaagacatggttagcaaagcaaaagagcgttggggatgattcatggaaactaggaagaatcatatgtcaagttgccaaaacttttgagagctttgcaatcttgtattctagggactgtgatggctgcccaaacagaatccgtgtttga

SEQ ID NO: 31057 - DNA, 405 bp, Glycine max
  Peptide Sequence Number=SeqID_122742
atgccttactttggagtcattgaagaaatctgggagcttaactatgttaaattcactgtgtgtgtttttaagaatcttaagcagttagcatataagaataagcctttcattacgacagaacaagctaaacaaatgttttatatccaagatccttatgatgaaaggaacacggttacaccaccgagctcccttccttccgagtcagcactttcaccatctacgctcaggaggactggacaagccacaaggctcagatcattgtctgttagacccgtgggtttggagagaccactggttcatgtggatcctaacattgggaaagctactggtctatgcaaaaagaaattaaggacctatttaggggtcatcgctcgagacaaagttgatgttacgtatattaactag

SEQ ID NO: 31058 - DNA, 399 bp, Glycine max
  Peptide Sequence Number=SeqID_122743
atgactaggggaaatctaggtgatttacaaccctttgatccaaaaatagatagaacctttcatagattagttaggcatagtgtgcattttgagcattcagagtattctgttgctggtgattctgaacattttgattttgagcattcgactactaattttcatactgagaacatggctcaacctccacctcgtgagaggactcttagggagatggttgcacctgatttcacttatgaaagcttgtgcattcaatatcctgatgaggatgttccatatgttctcaagattggactaatacatttgctgcccaagtttcatggtcttgcaggtgaagatcctcataagcatcttaaggagttccatattgtctattccaccatgaaaccccctgatgtctag

SEQ ID NO: 31059 - DNA, 513 bp, Glycine max
  Peptide Sequence Number=SeqID_122744
atggaacttattttgactgaattgaacatctggtctaaactgcggttgcaggatttgatcaaagtttttctctggttacaggattggttttgcatgttgagtcagcaattgagtagtgctttaatgtgttgggtagttggtaggcacgtagcttttatgcaatacatgcgccttattgttagacaatggcattatattgagaattgtcaggttgttgttaggaggacttatattattccacaggaggatcctgaagtagcaaagtttagagagcaaggcctcaaattcttacctgagatggaattcctttttaagggtactattgctactggttttgcagcatatgcaccatctgaggattcaagacaatatgaaggattcaacacaagaacagaagagacaaatgataacattgatgataacactgacatggaagtgaatgagcctgagatagacacgacaactcagaacacgtcttcggcaaaggaaaatggacagaggaagagagggtga

SEQ ID NO: 31060 - DNA, 633 bp, Glycine max
  Peptide Sequence Number=SeqID_122745
atggaggggattatagatgatactcaacctactttgacatttgagtgtctagctaccaatatttgctatttgtggaaggttcacttcgtactgaaggaactcgtgagaaagtcaattgcagaaacgcaggaattgaagcgctttccaactcttcaagctgaaatagcagaagcagctaatgaggggttagagagattccatgatgacggtaagaagacaacgttgcggctggtggaaatggaatcttcctatatcaccgttgatttcttcgggaaactccctcaggaagttgacaagggaaagaattcagcttcctccttgttagatgatcagtatgccaagggacacttccagaggatcggttcaaatgtttcatcttatgttgggatggtgtcacaaacgttgaggaacaccattccaaaggctgtggttcattgccaagtgatggaggctaagcgatctttattagaccgtttttatgcacaactgggcaaaaaggaggaaaggcaactcgcatggatgctgggagaagattctgtgttgagggaaaggagattgaagcagttttttggtcgggataaaatgaatcttgagttaatatacgaaggacctctcttaatgggaaaagaatga

SEQ ID NO: 31061 - DNA, 189 bp, Glycine max
  Peptide Sequence Number=SeqID_122746
atgtcgccattaggactggcgggacatgccaacgtgggcagtcccgccattggtgcctgcgagaccaacagttggaatgatactccatacttgcaaaatttgatattgaagagagtaagaaagactttgaagtttgctgaggagagaggaagaaagactttgaagtttgctcaggaagaaagactttga

SEQ ID NO: 31062 - DNA, 228 bp, Glycine max
  Peptide Sequence Number=SeqID_122747
atgaaaaagtatcggtgttgctcgtctcctcctccgtcaactcctcagtctttatggcgatgggggttcctgggaaacgctcaacatgacactcgtgctaagcgcgcatgtccagctagatcaagtggccacacgataagtcgcaggatgcgcactcttgctcgtgacaactgtcttccaatgtggcttcttgtgctaagcgggcttgcttgcactgagcggtcctga

SEQ ID NO: 31063 - DNA, 414 bp, Glycine max
  Peptide Sequence Number=SeqID_122748
atggcagtgagatctaaaacaatggcgtggagacttgaagctttcctcgtacctcgattaggtcaccatgaaatgtacctagggttaaccgaaacaacacagacctatgtttcgtttggcactcctctgatctcactcttactacctactcaccgtatttgtgtggttactcaagagattgagcgacgcatgtcaactcaagcaaaacatttgcgaactcaaaacaatcttttcaaggctcgagaagaaaaataccaatcgagaataagagtactcaaggcactttcatctggaactatagatgagagtgagggtgagaagatcaaagagaaagtaaagaaggacaaaagcataaatgtgtacttcaatggtctgctaggcaaaagattgcagttggagcagctcgtggcttaa

SEQ ID NO: 31064 - DNA, 1962 bp, Glycine max
  Peptide Sequence Number=SeqID_122749
atggccgaatcggtggagcttccgagtcgcttggcgattctcccgttcaggaacaaggtcctcttgcccggcgccatcatcagaatccgctgcacttcccccaccagtgtgaagttggtggaacaagaactttggcagcgagaagagaaggggttgattggcatccttccagtgcgtgatgccgctgaaattaagccagtgggtcccactgtatctgaaggagctgattcaacaaaccagaactcaaaagttcagagcggttcatcggattctcataagctcgatacaaagaagcagaatgatgttcattggcataacaggcatagctctcgtgaataccttttgtgtcattttgagaacctcagatcaactgctcgaccattacatttatcaaggggagtggagaaaccaagtgggagggtcacatacacagttgttcttgaaggtttgtgcagatttagtgtccaggaactgagcatgagaggaatataccatactgcgaggataacttcccttgaaatgaccaagactgaactggaacaagtggagcaagacccagatttcataatgttgtctcgccaatttaaagctactgcaatggagcttatttctgttttggagctgaaacaaaaaactggtggtaggacaaaagtccttttggacaacgttccagttcacaagttggctgatatatttgttgctagttttgagataagttttgaagaacaattatctatgctggatttaattgaccccaaagtgaggctttcaaaagctactgagttagttgacaggcatttacagtcaatacgtgtagctgagaaaattacacaaaaggttgaaggacaattgtcaaaatctcaaaaagaatttcttttgcgccagcagatgagggctataaaagaggaacttggtgataatgatgatgatgaggatgacctggctgcccttgaaagaaagatgcaaagtgcaggaatgccacagaatatatggaagcatggacacagagagttgaggaggcttaaaaaaatgcagcctcagcaaccagggtataacagttcaagggtttatctagagcttcttgctgatctgccctggcagaaggccagtgaagagattgatctggacttaagagctgcacggaagcgactggatagtgatcactatggtttagtgaaggttaagcaacggataattgaatacctggcgcttaaaccagatgcaaggggtccagtgttgtgctttgttggaccaccaggtgttgggaaaacatcattggcatcttctattgctgctgctttgggaagaaaatttgtacgcatatcccttggtggagtgaaggatgaggctgatattagaggacataggagaacatatgtgggaagcatgcctgggaggcttatagatggattaaagagagtagccgtttgcaatcccgtcatgttgcttgatgaagttgacaagacaggttctgatattcgtggagatccagcttcagcattactagaggttcttgatccggaacaaaataaatcgttcaatgatcagtatcctttattcttcaagatgtgttccctcaatttgctcttctctcctgttggatgtgatgatatatatttcgccatctgcctttttgatgatttgattgtcaaggataagttaatcttaattttagttgacttcttttactatttgaatgttccatttgatctatccaaggtagtttttgtggctacagcaaataggttgcaacccattcctccaccacttcgtgatagaatggaagtaattgagcttcctggatatacacctgaggaaaagctccaaattgccatgcggcatttgattccaagagttttagaccagcatggattgagttctgagtttcttcagattcctgaggtactgaatgtatttttatataaaaatagtttagaaaccggaaaagtttctgctccttaa

SEQ ID NO: 31065 - DNA, 636 bp, Glycine max
  Peptide Sequence Number=SeqID_122750
gattctttggacgagcaggcgtcacagggatcgtttgtcccccatggacgtcaggatatcctgactgctgccattgggcgaccagagcaccctggccgtgttcgtgctgttggagtcggtgtcaccataaagcaatactttggatcagcttcacgaacatcccgcagttcttcctccatgcctcttgaagacctagaacagctgacccaacaaatcagagaccaactggaggagtcaatcacagaaaaagtgactcgaaagatgatggaatccttcagccagatgcagtcgcagtttcagtctcagatgcaatcacagggaattgcactacctccagagccagaggttggtccctcaggtcctcgtgtcagtacaaaggagagttgtgttgctccctcagggaacaatccagggatgggtgactcagacaagtgcggcctatatattgaagaaaatccttcccgcttggttgccctaggaagactttacgagggatccacaacagttcacaacatcccgttgttgcatggccaagtcaaggttggtgttgaggaggttaaagatacagaggcaatgtctcagaataaagcacagccatattcggggtgtttaatcaaaacttcccgttgtatataa

SEQ ID NO: 31066 - DNA, 96 bp, Glycine max
  Peptide Sequence Number=SeqID_122751
gaataccaggattccgtttcagtatagctgcatggagtggagagtttccaaagcacagtggaagctagcttctcaacagatagcctgtttaaccaa

SEQ ID NO: 31067 - DNA, 333 bp, Glycine max
  Peptide Sequence Number=SeqID_122752
atgggtgcaaagcttgaacacatgaacccacagaagcctatcccgcagaagccagtggcggcatccctctctccccctgtcccacaacacccactggcggtaccacctcccgcaacaccctctctttcctatcccgccagctccaagggcgggacaccctctctctctcttatcccgccagctccaagggcgggacactctctctctctcctatctcttcccatcccgccaacagcaatggcggcacccctccccctctctcctagtcagcccctatcccgccattggcactggcggttcaagcttcccgccagtgtcaatggcggcacccac

SEQ ID NO: 31068 - DNA, 1266 bp, Glycine max
  Peptide Sequence Number=SeqID_122753
atggcgacacccaacaacagcaacattaacaacgcgacggcgaaaccaggaaccctaggcgttggcgtaggtgcccctatgaatgttgcaagagttgctgttctagaaatcaaaacccctgtcatatccacgtcgtggttgtggtttgttgcgatccttgacattgccggaaattgtgggcaaatgcaattgcaattgtggtcgcgatgtggttgtggcaagcctcaaaaccttgatattgcagctgaagttgtgtactcttatatagtgcacttagcttataattggaaagaagtgttaaaagctaattcaacttttcctgacaaggcatcctcttctggtgcgtctccccttgaccagcaatccttagatccacatccacctcaatcaacggcgagccctggtgcagcggtaaagttgtgccttggtgacttgttggtcatgggttcgaatccggaaacagcctctttgcatatgcaaggaagtgcaggtagagttgcatcacttcgacaactttccaatagttttgctcagttcaataatttacacctttcccttcgttcaaagaagccactaactagaaaggatgctgcatctatcaacgaatggagatttgccaagataaaggaatacaaggagcggaatgttgaagtggaaaatgaagcttttgaccgatacatgcagaatgtagatttactagaagaagtattagctgtgaagtcgttggatgccaatgtgccctctgcattagagtctaatgctactccaatggagagcaatgaggcaatgatccctgggataaaattgcagctaagatcaaattcaatgagaagtgatggtttgagaatgagaatacaacaaattgtaaacgagggattaaagaagctcgagaaaagtgctgtagatggtgacataaatgaatcaattgatggtgaatctaatgaagcttcaaaaaggggaaaggggattgaaaggttatcagctataagtgatcttatggataaaattaataaagcccgaactgaggaggatttgaagccgtgcttagagatgaagacccaactcttcaatttagacgaaggctctagcgcgaaagaccttcaagacaatgaaatgcatgcgaatgaaactgctgaaagtgatgtggtacaaacagaaggattggattattctttaccgaaatttgttaccatcactgagattgatctagaagttctccacaccatagacaaacacttttctacccaggatatagagcagttatga

SEQ ID NO: 31069 - DNA, 489 bp, Glycine max
  Peptide Sequence Number=SeqID_122754
atgactgttgcaaacagtattaagaaaactctcccagagatcgaaagtgctaaaaaatttatggggttagtgggagaatgctctcaaacagctaataagtctcttactgggacattaatgagtacattgaccaacatgaagtttgatggttcatttcaagaagaaacagagcttaagaatcaaggaagtcactcagtccattatgtaagccaccaagggaatcaagaagttgaaaagaaatttatgaaaaagcatgataaaggcaaagggtcattaaagatcaatgatgattctttgcaaatccagaagaagagattccttacaatccaaaccataagcccaaatgagaagttcatttttataggaaataaagtgaaagctccagtggaagcagttaggggtggaaatgagtcgagcagcttgtcaagggcctttggctcggcctatgtaaggctcgactcggctcgacttgtttactataaaggctaa

SEQ ID NO: 31070 - DNA, 1272 bp, Glycine max
  Peptide Sequence Number=SeqID_122755
atggtccttgcccttagttgtgtcctcatcactgtgttgggcctgtttaagtctgcctctggtcatgggcccttcaagtgcttcatggtccttgcccttagttgtgtcctcatcaatgagcccatggtagatgctgccgcacaagacaccggtgcagagactgacgcacaggataccggtgcagagactgacggggacgagtctgtgggatttcctggtggacccaaggacccatcagtgcttacagagtatgctgaccatgttgcgggcagtatatggtctggacagaaacgttctgagttgaagttatgctcccatgggaggaaggtgcataaattgggcaggcctgttcctgtaattgaggacatggtgtcgatcacgctggacgacatcgtgtctcttctccatttgcctatcattggcgcattccatgacttccagcctctgcgcaccgacgaggtggtggtgttgttggttgagttactgatggtcttagcagaggtggtcttggccgagagaggccaatatggtgtaccatatgcgttccatgacctcactcttgttgggaggtatgcatggggagctgctggcctcgtccatatgtacgatcaacttaatgatgccagcctcagcaccagccaacagcttgttggttacatcaccttgttacagatatacgagcacttttcgtcagttgcagagtgcaatgctgatccggactatgatgaggtgtcaccatgtgcgtgtcgatgcattgcgacgaagaagactgtgaagaaggtatctacagcgacgtacaggcagcgcctggatcgtctgaggatcccaaatgtttgctggatgtcatatgcgaagcaccgacctgtgcaggactttcatccaatttcgtgcttctcgggacagctcccttgggggcctgttgttgtcagatacagaccagagaggtgtgtgcctgactacatggactggttcttcgtcatatcatatccattcatgactgtgccacagacggttcctcctcgagatgcatatgcgacgcagcccagtcatatccctcatgaggtagcactggcatcgacacatgcggatcctgatgcgaacgagcctggacatgcagtggcttgtcatgtgatcgtggaggcgttggagcagcatctaaatgcgccaggcacatccacacatgaagaggtcatccaaaaatgtctcaggattgccaagggtgtcacagaagacgtgaggtctcgacgtaggcgccgcacggatcaacaatag

SEQ ID NO: 31071 - DNA, 491 bp, Glycine max
  Peptide Sequence Number=SeqID_122756
atgagtgcttctagtcctagtcaagctaaagaacaagatgatgataccaaacctttatggacctatgttacaaagataaaaagtgtaggtggtggtggaaattatgagataaaatgcaatatttgtgattttacctttaatggatcttacactagagtgagggcacacttgttgaagatgactggaaagggagttagagtttgtcaaaaggtaacaattgacagacttatagatttaaagaagataaacaatgaggcaacattaagggtggagaagtcaaaaacaaaatttgtatcattgcctccggtttctactcaacaccaaatggatacaaacactcttggtgttgatccaaaaaagagaaagacatcaattgtagaaaacgcctttaatttgcaagctagagagacacttgatcatgaaattgctaggatgttttactcttctggggctgccttttcatttagcaagcatcctcattataggaaggc

SEQ ID NO: 31072 - DNA, 318 bp, Glycine max
  Peptide Sequence Number=SeqID_122757
atgacccaaattatgtttgagactttcaatgtgcctatcatatatgttgcaattcaggttgtcttgtctctgtatgccagtggacgaactacagggtatgttcttcctcgtgcaattcttcggttggaccttgctggccgtgatttaacagagtacttggtgaaaatccttactgagagaggatactcctttagcacctctgccgaaaaggaaattgttcgtgatatgaaggagaaattggcatatgtggcctatgaagcaccgacaccgacacggacatcggacacgacacggacacagacacgtggacacctgtaa

SEQ ID NO: 31073 - DNA, 890 bp, Glycine max
  Peptide Sequence Number=SeqID_122758
atgactttccctctgtttccgacaccctttggcgcaaagtttccaacttcgaagctcctcccgcgtttccgcttcctcctcttccttcccctcccctccctctacctcctcttttcaaagcctagtcccttagatttcttctccgtcatcgctttctcagcagtactcttcacttccctcaatttcgcgctatctttcttcactcgattgttccccaccaaattctcatcatcatcctcttctcctcaccctgttgtatggtctattgggtcgaatccgaagcaagtaaagaacacaaattgggggtgttgggtgcaagtttacagcaaatgggacgtgtacgagggtgaatttcaaaaagggaagtgctgggggagtggggtttatcactataacatgcacgggaggtacgagggtgattgggttgatggaaagtatgatgggtatggtgttgagacatgggctagagggagcagatatagagggcaatatagagaggtccacacttgcattgatggcagccgctatgttggggagttcaaaaggggtgtcaaacatggactcggacagtaccatttcagacaagatgcatggttttggagtgtatcaatttcagaatggtcatcgaatgggattcttgaagatcctaaaagacataatagtcctactgggtctccatgtgctgtagaccataccaaggtttctaatgcagtacaggacgcacattctgctgctgaaaaagcttacaatatggcaaaggtggatggcggggtgaataaagtagtggctgtagctaataaagcagcaaacacggccagagttgcagctctgcgaggtgtcagcttggaaccactttctgtcattgaactcgatggcagattgtggaacaa

SEQ ID NO: 31074 - DNA, 231 bp, Glycine max
  Peptide Sequence Number=SeqID_122759
atggatcaatggcatcttcgtcatcatgcgcatcaagtatacaaacaaggtctggtccaattgagggtgacgttttgtggatgcaacccaaacatgtttcagaacatgtttagaatggggaagcagacagaaaactacacatcagacgagcagtgccgacgtatcaaggtgaagaacaaataccagaagaaattcttcctctgcttcggcaatgtgggttttattggataa

SEQ ID NO: 31075 - DNA, 348 bp, Glycine max
  Peptide Sequence Number=SeqID_122760
atggtcattattgtcaatgcggaagcttgtggttacgtgagcctgaactactaccaatatataaatgttgtttatacaaatgagcacatcttaaaagcttactccccacaatggtggcctcttgggaatgaagtggctattcctccttctaatgatgcatggacacttatccctgacccaactacaattcgtgcgaaaggtcgtccaaaatcaacaaggataaggaataagatagattgggtcgaaccatctgaccaccgacaaaaatgcagtagatgtggagccgaagggcataataggcgtcgctgtccaatgcaatctgagcgtgggagttgttcaaataattga

SEQ ID NO: 31076 - DNA, 534 bp, Glycine max
  Peptide Sequence Number=SeqID_122761
atggatatgtggcctactacagagtttgatgagattcaaccaccaaaatacaaaaagggtcctggaacgtgtcataatacgaggaggtgtccattgccacctctagtagtacctgaagaacaaaatgaggaacatagtgaagctgctgaaggtgtagttgagggtgcaactcaaggtgcagttgctagagttcagtctagactaatcaatgtagttgagggtggcactagaggagtagcagaggttggcattgaaggagtagctcagggtggaaatgagggtgcacctactagaggtacatctgttggagttcaggctaagcaaatgaatgttgttctgggtggaaatgacggggcacatgggaaatgtgtgcaacagtttgggcattatgggcacaacactgctgtcaatgaaaaagtacaaaaatttgttcctaaacgtaaggcaccaacaacaagcaaaaaacttaaaggttgtcaactaccaattgttgataagaacattgagctgggaattggacttactaacacttag

SEQ ID NO: 31077 - DNA, 1071 bp, Glycine max
  Peptide Sequence Number=SeqID_122762
atggaggcggatgttccaaattcacactgggaagcgatgagaaaccaatgtttggacgaggctgcggattcggcatccacgaccgcagtgtctcatcgtcacatgtccttcgaacttgactattcagacttagaggatgctaatgttgtttcattcgaagtaatgaggaagaaccccttttgggtgtacgacagagaagcacttcggctcttcagcaagttcaacaaaggtcgcttgcaacttggacacattttattgggtaatgttgatgtcctgatggctgcacacttgggtgttgtttttatgccacaaggtctgaggcatttccatcgtattgacacatttgaccctggaggctacttaagggacggtggtaagtggactgttcagcaagctgctgaattatcaattgttgctcccactatcgaagcatcattggatgcaaggttcctaagtgggttgaaggaggaaagagttgaagctgcaaaggtctctaaatcaggtggcattggtgttattgtgactgatcaacctgtagacaagcagaagttgattgatgatgttaggaaggcttttcatgcagccaaaatctgcagttatgcacagggaatgaatttgatctgtgcaaagagtattgaaaagggttgggatttgaagttggtcttgcttatttttgacatcatcttacttgcatcaaactatgatgatgcaatttgctatgttgagaccatgaatcttgatggagagacaaatctaaagctgaaacaagcacccaaagcaacttcaaagttgcaagaagactcgaactttcaaaattttagggctgtcatcaaatgtgaagacccaaatgctgggattgcttatggacgaggagttactgaagttgagagagctctatctaggagacatgaatcacatccaggccaagagttaaaaaagattagtgaatcaaagtcatccattaaaggttttaactttatggatgaaagggtagttgtcgcaacctacccttcggcgagagggcgacgcgtgactcgcgggtgcgtcttccaagaaagaaatacgcgctga

SEQ ID NO: 31078 - DNA, 300 bp, Glycine max
  Peptide Sequence Number=SeqID_122763
atgcgagttcctaatgactgttcttttgattcactcaagaatagaatgcataatacccttcagctaatcaacgatcaattagtggatgaaatctactaccgacaaccattcatagatgcagaattattgtgtaccatcaatagaacaccggatggtatactcaacctgcttcaatccactattattcctactcatgatgcaattatgtattacaacgagaagtggaacataccacaccaaggtgggtttttgggttactcattcaccggaacaaatccaataagatttgacattccttga

SEQ ID NO: 31079 - DNA, 252 bp, Glycine max
  Peptide Sequence Number=SeqID_122764
atgggttgtttccactctaagtcagcgaggcagtttcctgcacaggagaatactgttaatcttgcggcagagacagcttttactgtcagtgaggttgaagcactgtttgagctttttaggagcatcagcagttctgttgtcgatgacggactgataagcaaggaagaattccaattggcaatcttcaaaaacaagaaaaaggataacctttttgcaaaccgggtactactatacacttttctttcttcatag

SEQ ID NO: 31080 - DNA, 648 bp, Glycine max
  Peptide Sequence Number=SeqID_122765
atgaatctggaaatttcttccccaccaagtgattccacacaagctcctgaagtcccaactagtaatgtccctctttctcatgtatcaacatctgaagttccacaagaagatgaaacaactagacgtcatgttaagcgtgagtctacacaatgttggactgttgaggcgatagacgttgaagaaaccatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctagaccttcaggcgtacctaaagcttattttgatgattgctttgaaacaattttaaagcctcgattttattttaagattaatgaagttggtgcaaaatggtattgcaaattgagtatcggaagaaaatgggctgcaaataggcaaagcttatggaatgaattcaacgatccaaccaaaacaagagatgaaatcataaaaaatgtgccgataggcatagataaagatcaatgggctcgttttgttcattatcgtcataaaccatcaacattgctaattatatga

SEQ ID NO: 31081 - DNA, 717 bp, Glycine max
  Peptide Sequence Number=SeqID_122766
atgaaatggcaaactagagacatagttgaagatcacttgctatataaaccatttcctcaaaactatgttatatgggatcttcatggtgaaaagcaagcattagaatcttctcaagtggaagatgttttccaagatagtggtgttcaacctcaaaacccaatggaaatgatgatcaatgaccaatttttaaatatcatgccaaaggtgaagcgttttagaaatccacaaaaatcagcacctcaaccacaatgtcatggacctctaacacaagctccaacacattctgttccaacaatgaatcttgaaatttcttccccaccaagtgattccacacaagctcctgaagtcccaactagtaatgtccctctttctcatgtatcaacatctgaagttccacaagaagatgaaacaactagacgtcatgttaagcgtgagtctacacaatgttggactgttgaggcgatagacgttgaagaaaccatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctagaccttcaggcgtacctaaagcttattttgatgattgctttgaaacaattttaaag

SEQ ID NO: 31082 - DNA, 255 bp, Glycine max
  Peptide Sequence Number=SeqID_122767
atggaggaacggtacgagccattgaaggagcttggagctgggaattttggtgtggcaaggttggccaaagacaaaaaaactggagagcttgttgcggtcaaatacatagagaggggcaaaaagcttatatcagcattctcaacaagaagcttattatcagaacttaaagggctagcacagattgatgagaatgttcagagggagataattaaccaccgatctttaaggcatccaaatataatcaggttcaaagag

SEQ ID NO: 31083 - DNA, 1215 bp, Glycine max
  Peptide Sequence Number=SeqID_122768
atgaaaacaaggagaggaaaacgctcagaggccttttggccttcccttgtgatgaagaaatggttgaacataaagccaaaggtgtatgattttagtgaagatgaagtagacactgaaactgagagtgaagatgatggacatgggaaacctgtgttcttaaatgatgttcaattaaacttgacaagttacacattatatgttgatttttatggtgcaaatgcaccttgtaagggctacaagacaagacataaaagagggaaatcagaaactcttcgtgttcaatacataaatacaaaggaagtgagggtaacaattggcacatggaatgttgctggaagagctccaagtaaggatcttgatattgaggactggctttgtaccaatgagccagcagatatttacattattggtttccaagaggttgtccccctgagtgctggaaatgttctgggggcagaggataacacacccatccgaaaatgggaagcaatcatccgaagaactctaaacaaatcttctgaacctgaaagcaagcacaaaagctacagtgcccctcattctcctgttttaagaacttctgcttctgctgatgttctagcagacagtgtagatgttaattcactagacatgatgaatgaggagtatctaggaacttttgacagtgatgatctagaacaagaggaagtgaaaagcacatctggtataggaaagaatttacagctgaggaaaagacatgacattgatcttcagactatacttgactggcctgaacgtccattagatgcaactccacatactgattccagtccaaaattgcgtagagtactaagcagctcagacagaactggctttagctggacagataatgcttcaaaatatgctggtgtaatgaaacgatcacaccatagttctggaaatttgggcttgttatggaaagagcagaaagtgatgcctgaagaagtaattgatactattgacgacttgtctgatgtgctattggacgaggaagatgatgattattttgaagtgccaaatgacaaagaagttaatggaataggtatggtgaaatctcatcgtaagtatctccggattgtcagcaagcagatggtaggaatatatgtgtctgcttgggtgcaaaggaggttgagaaggcacattaataacttgaaagtttctccagttggagttggtcttatgggctacatgggaaacaag

SEQ ID NO: 31084 - DNA, 183 bp, Glycine max
  Peptide Sequence Number=SeqID_122769
atggaaaaacgccagcaacgcggcctttttacggttcctggccttttgctggcttttgctcacatgttctttcgtgcgttatcccctgattctgtggataaccgtattaccgcctttgactggcacgacaggtttcccgactggaaagcgggcagtgagcgcaacgcaattaatgtgagttag

SEQ ID NO: 31085 - DNA, 693 bp, Glycine max
  Peptide Sequence Number=SeqID_122770
atggagacagaaacacacacttttcatcttcctgttggagaatgtacaattgcattagaggatgtagtactacagcttggcataagggtgaacagtaggccaatcactggtgcaacctactatgattgggaggaaaagtgtgaacaatatttgactgtggttccgccaaagggagaagcaatagtaggctttgccattaagcttaattggggctctgcttgtctagcaacattgtacaaagaattgtgtagagccactaaccttgatgccaaaaccatgggtggctgtgcgtcattgttgcaatcttgggcatggtatcgtatgcccttcattgcagcaagagttaatcggacaccatcgtattcattggttacaagtggcggtgtattaagctttattggtacaccacaaggagatgtcattggttatagaatgagattagatcacatgacggctaaacagaatccaactcagtttcaggccaaagaagagaaggttaaagctgctgatgactcgcttagcgagacagattggctaagtgagatacattcgcttagcgaggcatccagctcgcttagcggatgggaaaccctagaagaggataagttagagatctgcacacccagtgcgcagccagcctgcccagtgaggacgttgtttcttctcgcgcttagcgcgcccatgctcgcttag

SEQ ID NO: 31086 - DNA, 531 bp, Glycine max
  Peptide Sequence Number=SeqID_122771
atgggtagattttgggccaatcgatgggccatcagaccttacttgaaaaaaaaacaagcgttctctcttcttcatttctctcttccgggaaagcttcctaatttcttaacttctctcttccacgacgagctcggtggtggtggtcttcttctccacgagccttctcctccagcccttggacccatttgcattcgagaagacgccggaaaaaatggcgaaagcttggtgacggtggcgccttccggaagacccatttggggttcttccggaacttccggaagaacgtgttctgaaagatttctggaagaagggttcttccggaagtactggccttccggaaagcttccggaacacctcttccggaaagtttccggaagaagtggttctttcggaaaccacttcttccggaaaatttccggaagaagggttctttcggatgacctttcagtgattccggaagcactttccggaagaccccttcttctggaaagtttctggaagaactacttctttcggaagttatttttttaa

SEQ ID NO: 31087 - DNA, 498 bp, Glycine max
  Peptide Sequence Number=SeqID_122772
atgggtgtaatacacccagaaaaggatgcttgcatgttcagacttcagagtaataaacaacatactctcagattgatgataagaagtgacattaacccaaagcattatgttggagtcaacagcttacctcacctggagtctcaaggagtggctgcttatcagttgaaccaaccaatggctctgttcaaaaacagccttttgcttgtgttagcattgagtggctacaggggaacactgggtgtgtcattccaacgtgaagaagtttctcacgatatgtttcaaagggtacaactggaattagaagggcacaaggacaagatagtgtctacagcttcactttggagcgctttactcatggttttttcaagggaattgttattaatgatatggaaaaagattggaagttttattgtgggttggatggttaagggagaaggaaagaggaaaaaggtcgcttgttcaatcgcctccgctaacaaaactaacatttgccaataa

SEQ ID NO: 31088 - DNA, 372 bp, Glycine max
  Peptide Sequence Number=SeqID_122773
atgtcaacccttaattcatcaccatgtattgaaccacatacaactacaagttgtcgacctactcagattgacatgacttctcaacatataaattcaggtagatacacaatattcaattccaaactaatagagcacgtctcgcatgacactgatgacgaacttgatataacacagggagacattgttatagattattcatttgacgacatagcaactgaggattttgctcataccgattatgatgacaatcttgaagctccatatgacaatgaaaataccggtttttacattcactgtgcaaattatgttgtattgtccttcattatgtttgataatgtaataccatgtcaaaatttctgcatttacatgtag

SEQ ID NO: 31089 - DNA, 390 bp, Glycine max
  Peptide Sequence Number=SeqID_122774
atgccaacgaaacaggtaacctaccgcaatgataaagtggtgctagtgaaggtatatgttgaaaagcctagaaagaagagctcatcatcaattcagcatcatcaccttcattatcacattcatcacacaattagacaagaggtagttcacggctctggtagcaagggatcatatggtagaagagcagggttgcttatgtactcgcatctcctacgtgaatctgcaagaggagcatcatcaacaccctcattctccaagtgggttgcaaacaacaatttccagcctccaacccagataaccccttccaacaagaaaaagccggagtatagggaaaagtcaacttgctttggcagtttgaaactactgattccaaggttcttaaggtcatga

SEQ ID NO: 31090 - DNA, 435 bp, Glycine max
  Peptide Sequence Number=SeqID_122775
atgatacaaaggttggtagcggcatgggagaaaaaatctcctactacaaacgttcacacagctaacacgagcgaaggaaatgagaacactgcagcgcatgacaaaaattggttaaggaatttggaaatgcccatattcaatggtgaggatcctatgggctggttgacaaagatcgaaagatatcttcggatgtgcaccataagggaagaggacaagatggaggctgtaatggtcgcgatggatgggaaagctctaggttggttccaatggtttcaaggttatagcctaggaaatccttttcaagtgttgctggcactggaacaagaagagacaatgcaaggattcataggccaatttgagaagtgcgttggaatggtgaaggggttggaggagccatttctggtggaagtgttgctcaatgggttaaaggaatag

SEQ ID NO: 31091 - DNA, 495 bp, Glycine max
  Peptide Sequence Number=SeqID_122776
ccgtaccatggtaacgacgcctcgtttggagttggagccgcgaaacgaccccggattgagggaggagagtcggagcttgtggccggagaagaggctataggcgctgttgattccagtgtggaggagttcatggctctgataggggttgcggttcgagacgaagagggcaatgccagcatgggcttgttgagtgcgatgctagaagctgttgtggcaacctccatggtgagtagtgagccactgcgtgagtggagaataaacggagataggaggaaggcacgggttttaactggatggcattgggctgggcttattggattacggcccagccatattttgacggttgttattggtcccaaccagattgctattgcccctaccactattcaaaattccaaatttaccctcacccacaatatacgatggaattatgattctgctgcattagaagggtgtaaaaataatattcaacagaatcaagatttcattgtgtaa

SEQ ID NO: 31092 - DNA, 756 bp, Glycine max
  Peptide Sequence Number=SeqID_122777
atggaacttagttttaagcaccattttggccttgcttgtgtcttactacttttagctgctctgtgtagctcacaggactctttcactgactcgagagcaacatattatggtagccctgattgctatgggaatccaaggggagcttgtggctttggcgaatatggaagaactgtgaatgatggaagtgtggcaggagtgtctaggctatggaggaatggaagtggctgtggtgcatgctatcaagcaaggtgcaaaataccacaatattgtgatgagaatggagcatatgtggtggtaacagactatggtgagggagatagaacagatttcatcatgagcccacgtgccttctcgagattgggaggcaatgcagatgcatctgcagagttgttcaaatatggtgtagtggatattgaatacagaagggtcccctgcagttacactggctataatgttgtgtttaaggtccatgaacacagcagaaaccctgactactttgctgtcgtggttctctatgtagatggaacatacgatgtcactgctgttgagttgtttcaggaagattgccaagaatggaagccaatgcgcagggcctttggggcaatgtttgactatagcagcccaccaaggggtgaaatctacttgaggttccaagtgagtggcagggcagggctttattgggtgcagtccaagaatgctatttctagtgattggaaggccggagcaacatatgacaccaatgttcagcttaattag

SEQ ID NO: 31093 - DNA, 255 bp, Glycine max
  Peptide Sequence Number=SeqID_122778
atgcatctacgtgatcaaggaagccttcttaacaacaaagagaagaacaagatgaaagattgcaaaaatacaagtggtgaggatgtctccttcacctctaggatctcacaatcactcacaaactcatctcaagctctcaaatcggctcctgcttcaagctctggtctctgcagatcttcacacagcaaaatctctcaaaactcttggaacttggacctttctctctttagaaaccctagacatgcaaagctctga

SEQ ID NO: 31094 - DNA, 1114 bp, Glycine max
  misc_feature (1006)..(1006): n is a, c, g, or t
  Peptide Sequence Number=SeqID_122779
atgacggaagggtgtggtgaagggtttttgccttgcaaacccttcccggtgatgctttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggacgaatcaaagcgacaagggctgaatctcagtggatcgtggcagcaaggccactctgccacttacaataccccgtcgcgtattaagtcgtctgcaaaggatctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgncccaggcaaactccccacctgacaatgtcttccgcccggatcgaccgggcgaagccgaccttgggtccaaaaagaggggcagtgccccgcttccgattcacggaataa

SEQ ID NO: 31095 - DNA, 147 bp, Glycine max
  Peptide Sequence Number=SeqID_122780
atgttgatgcacaatccgcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 31096 - DNA, 840 bp, Glycine max
  Peptide Sequence Number=SeqID_122781
atgaggcagccgaaaatgatgaccacagagatcagtaccgccagggaacaacagctcttcaacgggaaaaactttcatgtggtcatctataacaaaacggagagcgtgagcgggcttcaccagcatgattactacgagttcactatcgttttaaccgggcgctattatcaggaaattaatggcaaacgggtgctgctggagcgcggggattttgttttcatcccaatggggtcgcaccatcagagcttttatgaatttggtgcgacgcgcattcttaacgttggcatcagcagacgcttctttgagaaacattatctgccgctgctgccgttcgggctggtcgcctctcaggtctatgcggtgcaaagcgcctttctcagctatatcgagtcggttattgcttcactgaattttcgcgagactgaatttgacgaatttattgaactggtctcgttttacaccattaaccgcttgcgtcattatcgtgaagagcccgttgaagatgtgatccctcactggctgaaaaataccgtagaggatatgcacgataaaaataaatttggcgaaagcgcgctggaaaatatggtgcaattgtccgggaaaacgcaagaatatttaacccgggcgacccagcgctattatggtaagacgccgatgcagatcattaatgatatccgcatcaatttcgcgaaaaaacagctggaaatcaccaactattcggtcactgatattgcgtatgaatcaggatatagcagcccaagtctgtttattaaaacgttcaaaaggctgacttcatttacgccaagcagttatcgcaaacaactgaccaatattaattaa

SEQ ID NO: 31097 - DNA, 261 bp, Glycine max
  Peptide Sequence Number=SeqID_122782
atggtggggtacacaccttcaagctttgcggatttggtcttcgccggcaaaaggatcgaagcaggtctgaaaagaggcaaatttgatcatcctactttgatgagtgagaaagttggggcaaatgaagaggatgagaatgagggagaaacccttgctatggctaccattcctacacagtcaaatttcccatcatcccaacaatgtcattactcagccaataacagtccctctcacccaatcatccacaaagcccatccctaa

SEQ ID NO: 31098 - DNA, 720 bp, Glycine max
  Peptide Sequence Number=SeqID_122783
atgggttctgtcttgatccctgctgtaaaccaaccaacggagggtccgtgtcgccttcttaaaaacgtgcgttggggcatttcgctacccctagacatcgtatctaagaaggggacaaattccccggacccccgtattctaagcatgggaacaaatcaaaccgacaagaggttctaccaagtcaaggtcaaaagcccagataccaccagcatcaaggaattagggcggttgatggaacccctccaaatgcaagccttccgcaagacttacggaaagatcttagagttgaccatagcagaagtgcccatagaagccattgcatcactcacccaatactacgaccagcctttgagatgcttcacgttcggagacttccaattggtaccaaccattgaagaatttgaggagattctaggatgtcctctcggggggaagaaaaccatatcttttctccgggtgtctcccctctttgagcagaattgcgaccgtggtcaaagattcagcaagaggtttggaccgtgtaaaacaaacttgaaacggcatagcgggcctaccacagaagtacctagaagacaaggcgagggatatggcaaatcaagaagattgggtcccgtttatggatgtgttagcattgctaatctttggggtcgtcctctttccaaacgtggatggtttggtggacctagccgccatcgacgctttccttgcataccaccatag

SEQ ID NO: 31099 - DNA, 273 bp, Glycine max
  Peptide Sequence Number=SeqID_122784
atgaatccaaggtctccccaagagacagctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaagggttcgggagttgtatttacgcacggggaagggtgtttccctttgctcctacgtattcctcaatttgggatgagaaaatcagacctacgtag

SEQ ID NO: 31100 - DNA, 246 bp, Glycine max
  Peptide Sequence Number=SeqID_122785
agaattcaagggactaactgcctaagaattctttgtcctaacacattggagggtacatcctttgtggtacaagtagagggtacatctacttgggttgttatactgagaacaagagagggtacatccacttggttgttcaaagagaacaaaggagggtgcatcccttgtggatctttggcttgtaaaagattttacaaggttgaaagaaatctcaagaaccattggctgcttggggactggatgtag

SEQ ID NO: 31101 - DNA, 240 bp, Glycine max
  Peptide Sequence Number=SeqID_122786
atgactaggggcaatccaagtgatttacaaccctttgatcctgaaatagatagaacctttcatagattagttaggcatattgtgcatcctggtcattcagtgcattctgttgaggaggatggagctaagccagtgaggcagccacaacggcgactcaacctcgtcattctagatgtggtgaaaaaggaaatgaccaagctcttacaagctggaatcatctaccccatttttgatagctag

SEQ ID NO: 31102 - DNA, 161 bp, Glycine max
  Peptide Sequence Number=SeqID_122787
atggcagaaccatcaaggaatagaaatggttcatcctccacaaccactgctgtaggacaacgccgccacggcacatccggtgacccaccagcaccacctaatcgttgtttttcttctcaatggttattgactctattttcttcaaatgaacaacatcaaag

SEQ ID NO: 31103 - DNA, 558 bp, Glycine max
  Peptide Sequence Number=SeqID_122788
atggataatgaagagggcgtgcaagaacagatgaaggccgacctatcatccttaaaagatcaaatggcttctatcacggaggccatgctaaaactccagaaaactatagaggataatgccacggcgaccgcctccaatgcagctagggaagcggaatcggtgctacaacccgcaataaacttgggccgagatagaaacacgatggtgttcggtcggaggtatagtccgcaagcttacccttatggcttgcctccggacttcactccccgtgccgctccggaagatttgagccaagcccctaccttcgaggggcaactccctccttatgccgactatcccctgcaagaagatgatgaaggagatgcccatctaggccctctgcttcccctcaaagatccggccccccatgaattaccccaaccaaacatagtctgccatgtcccgtcttcacccatacccgtaaaagaatccgttcccttcgcagaagataagagaaagattgattcacttgaagagaggctaagagcggtagagggcctcagcaattacccgttctag

SEQ ID NO: 31104 - DNA, 247 bp, Glycine max
  Peptide Sequence Number=SeqID_122789
atgggttgtctcgaggagcataaggtcccttatgcgacgttcatgctccaaggagaagctgagaactggtggaagttcgtgagacctacatttgttgcaccaggaggcggaaacatgttcgttggagaatacacggcaaaatttaatgaacttctacagtattggcctcaataccaagatgctcgaaacgaagaagacttatgtgctcagtttgagaatgggcttcgactggagattcaaacaggca

SEQ ID NO: 31105 - DNA, 495 bp, Glycine max
  Peptide Sequence Number=SeqID_122790
atgtttttgtgtgatgatgacaataataatgatggtgataacgttagcaatagtgacaaagataaagatatcagtggtggtcacgatgatagtgacaatgacaataataacattagaggtggtggcaaaagtggtattagtggtagtggtggggtgatagaggtggtattaacgttggtggtggtgatggtgataacgaagatagtattagtggtggtagtagttgttgtgacactgatgaaagtggtattgttggtagcggtgatgatgacattgatggttgtgtggtggctgtgtggtggttgcgatgacattggtggtggttgcggtagcggtgacactaatagtgatggtggtggtagtaatgccgatggtgatggtaatgttggtagtgatgataatggtgttgatggttgtagtggtgacaatgataatgtttgtggtgatagtgatgatagaggtagtagtgatgacaacaaaaagtattattgttag

SEQ ID NO: 31106 - DNA, 1155 bp, Glycine max
  Peptide Sequence Number=SeqID_122791
gagcggaaagacaagttgatgtacgcggatcagaagagtcgcattcgtgtgaaaggcgcaccgaaacaaatcaatccgatggaaaagcccgcgggtattattgccgtgctgggtgccggtaactacagctcagcgctcgaggtgttgaaagcgatcttcttcgagaactgtgcggtcgtacacaaaccgcatcacctgaacgaagaaaccgacaggatttgggcaaagatcatgcagccgctgattgatcggcgcgttctgagcttctgcgatgccgatcggggacaagatctgacagtagacccccgcctctccaggatctactttactggtggaaccgcaacggccgaggctatcatgtcagcgacagagacgccgctgatctccgaatgcggcggtaataacccatgcatcatcgtgccgggcgaccggccatggacaaagaaggaaattgagcaccaggcagtgcagatagccaccatggcaaagttcaatggtggcgcgaactgcggtcgtccccaaactctggtgacaagcaagcactggccgcagcgcaaggaattcctcgacgcgctgcgggtcgctatctcggatactactccggccatgggtatgtactaccctggcgccgacaaggtcgtggatggttttcgacaggcctatcccgatgcggaagtactgagccccgagggcggcaagtatccgcataccgatgtcatattactcacagacgttgagcccggtggctacgccacttcacatgaagcgttcagcctggtgctcgctgaagtgccgcttgacctgccagccaatgccgcgcactttctccccggcgccgtcaagttcgccaacacccagctcctgggcacgctcgccagtgcgatacttatcgatgaggactccagaaaggcccatcagaaattacttgagcaggcggtgtctgacctggaatatggtgcggtcgccatcaacagcatgccgtccttcatttttctcaacccctatctgacctggggtggaaatgaggcaggcaagacgttcgtttctggtcgcggcaactttggcaacctactcaattacgagaacgttgagaaatcgatcatggaggcaaagtttatgtcaccaggagcacatgctctacaccaacaagcgagc

SEQ ID NO: 31107 - DNA, 447 bp, Glycine max
  Peptide Sequence Number=SeqID_122792
atgcgaagtcctctcttcactggccaaagtaaagaggaatttcaacagaggaagaggaaatcaactgccacaggaggagacccctgcaccaactgggtacccaccagaacctgctccactgttgcctacattgctagaagaagtagaatttctgatgaggaaccaagttgccaacatttaagttggaacatatggattgcgaaagttaagcattcagaaaagggaaattacccattgccttcccaactagaatcactcctacctatccctgatggacaaagtttgaggggacacatgtcccagacattgtctcaagaagaggaaagaactgctgcttcaggtgctgtgtccaaggatgctttgattgctgaactcaaggacacatgcaaggtgctggaagaaatcaaagccaccacagagaagaagatggagctggaaagcgcctga

SEQ ID NO: 31108 - DNA, 216 bp, Glycine max
  Peptide Sequence Number=SeqID_122793
ggaagaggagccggtgctgcaacccgccttaaatccgggccgagacagaaacacggccgtgtttggtcgaaggtatagtccgcaagcttatccttatggcttgccgtcggacctcaccccccatgccaccccggaagatttaagccaagcccctactttcgaggggcaacttgtagatgcaattggctttgatgttttgatgatgatcatgatgag

SEQ ID NO: 31109 - DNA, 285 bp, Glycine max
  Peptide Sequence Number=SeqID_122794
atgggtgatgtagaagaggtgcaagagcagatgaaggtcgacatggaggccatgaaagagaaaatggccacaatgatggaggccatgatgagcatgaagaagataatggaagccaatgcggttaagtggtggctggacagaaatatagaaatggcaataactgaagctacagggctccaaatgagaacaagggtgaagatgaaaggaaggaaagaatcactctttccagcgagggcaacacacaaaggttgtgaaagtcctttgatacagccagggtgttcttga

SEQ ID NO: 31110 - DNA, 240 bp, Glycine max
  Peptide Sequence Number=SeqID_122795
atggagaaggataaagcccccgagtggaaaaggatgaaggcccaagtggagaaggatgaaggctcaaaggcagagacactatcaagactattaattacttatcaaggtaatccttgtggcatctaccctgacttattttccttcattggaagtgatgtcatccaaatctctgtagcttgtatcaaacgatccgctcctactcaggttcgcatcatctggtatcagagcttcggctcttga

SEQ ID NO: 31111 - DNA, 282 bp, Glycine max
  Peptide Sequence Number=SeqID_122796
atgggtgccaagcacctcacaaggaccaaagaatggtcacatgtcatcaagcaaagaatgaccaaacttggtctctgcttgtcatcgggcccgccgcctctggatgacaaaagggtgcgaataaccataagaatgaccaaacttggtctctgcttgtcatcgggaccgacgactctggatgacaaaagggtgcgaataaccataaggtatctccgagtatcatgggtgcagaatgaccaaacttggtctctgcttgtcatcgggacagacgactctggatga

SEQ ID NO: 31112 - DNA, 921 bp, Glycine max
  Peptide Sequence Number=SeqID_122797
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgattgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaagtgtttggaggaaagggcaaaggccttggcaaatcaaggcgaatgggctttcttttatgacatcttggcgcttttgatctttggagttgtcctctttccgaatatggaagggttagtggacctagcagcgattgacgttttcctcgcctttcatcatggcaaggaaagcccggtcgtcgccattttggccatgtatgacacgaaggaagaatcaggattctatcttcatgcgaaggatgtcccaatgagaggagtgccatcagacgaaagcatcacacctttcatcgcacgaggtttcagtgaccacaacgcgagggacagagagcttaggggaagcagtaatgggatcattggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaagcagcaatagtgagctcaagctccgaagaggtgaaggatcatcacgggtcaaaggcatga

SEQ ID NO: 31113 - DNA, 111 bp, Glycine max
  Peptide Sequence Number=SeqID_122798
atggctggagggttagggttgcaaaagaagaagaataaatggggattcaaaggaaatggaagcaaaactgaaaaacaagagaaagaaaaaatcaaaataaaggaaaaataa

SEQ ID NO: 31114 - DNA, 447 bp, Glycine max
  Peptide Sequence Number=SeqID_122799
atgacggtgaaaacctctgacacatgcagctcccggagacggtcacagcttgtctgtaagcggatgccgggagcagacaagcccgtcagggcgcgtcagcgggttgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaattcaccaccagtatgacgaataa

SEQ ID NO: 31115 - DNA, 891 bp, Glycine max
  Peptide Sequence Number=SeqID_122800
atgcaaactagaaatgctttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgtacctggtcaaaaatataaagaaataacctttcctattctttccccggatcccactactaagagagatgttcatttcttaaaatatcctatatacgtaggtgggaacaggggaaggggtcagatttatcttgacgggagcaagagtaataataatgtgtataatgctacagcagcgggtatgtgcattgatattatacctccaggaccagaacttcttgtttcagaaggtgaatctatcagacttgatcagccattaacaagtaatccaaatgtgggtggatttggtcaggcggatgcggacatagtacttcaagatccgttacgtgtccaaggtctcttgtactacttcggatctattattttagcacaaatctttacagttcttaggaagaaacaatttgagaaggtccaattgtccgaaatgaatttctag

SEQ ID NO: 31116 - DNA, 228 bp, Glycine max
  Peptide Sequence Number=SeqID_122801
atgataacaaaagatgatgacaaaggtgatgacaaaaagctcaaaggtcaatcaaagaatgagttcaagatgttcaagatagaatcaagaatacttcaagaatcaagaatcaagattcaagagatcaaggttcaagactcaagaatcaagatcaagattcaagaatcaagagaaggcttaatcaagataagtatgaaaagtttttctcaaaaattgagtagcacatga

SEQ ID NO: 31117 - DNA, 915 bp, Glycine max
  Peptide Sequence Number=SeqID_122802
atgaccgatgctgacgtcgacggcgcgcatatccgcacattgctgttgaccttcttcttccgccagatgccggaactgatcgagcgcggccatatctatatcgcccagccaccgctctataaggtgtcgcgcggcaagtcctcgcaatacatcaagaacgaagcggccttcgaagatttcctcatcgagacaggacttgaagaagccacgctggaaatggcaagcggcgaagttcgcgccgggccggacctgcgttcggtggtggaagatgcacgcaccatgcgtcagcttctgggcggccttcacacgcgctatgaccgccgtgtagtggaacaggcggccattgccgggctgctcaatccggatgcctccaaagacaatgcaaccgcgcaagcttccgccgatattgttgcaaagcgtctcgacatgatctcggaagaaaccgagcgtggctggacagcctatgtgacggaagatggtggctaccgcttcgagcgcatggtgcgcggcgtgaaggacattgccgttctcgacatggcgctgctcggttctgccgatgcccgccagatcgaccgtgtggctgcacgcctttcggaagtctttgccgaaccgccggtgctgcgccgcaaggacaaggtggaaacgctttccggtccgatggccctgctcgatgcgatcttcgcgacaggccgcaagggcctgaccttgcagcgctacaaaggcctgggcgaaatgaacgccgaacagctttgggaaaccacgctcgacccgtcgaaccgctcgctgttgcgggtgaaggccgagcagggcgatgtcgcggatggcatcttcgaacagctgatgggcgacgaggtcgagccgcggcgcgacttcatccagaccaatgcgctgtcggtggcgaatctggacgtttga

SEQ ID NO: 31118 - DNA, 474 bp, Glycine max
  Peptide Sequence Number=SeqID_122803
acttatcaaggtaatccttgtggcgtctacccagacttatcttccttcattggaagtggcgtctacccagacttatcttccttaaccggaagtggcgtctacccagacttatcttccttcactggaagtggcgtctaccatggtggtgacgagtaccatcagttggacggcgctcaacgtctgttagtggatgcgatgaatgcacagatgcaacgtttgctagaccgtaccacagaggagaatgctaaacgaaatatagatgggaatagaggtaatccttgtggcgtctacccagacttatcttccttcattggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgccccgtaa

SEQ ID NO: 31119 - DNA, 162 bp, Glycine max
  Peptide Sequence Number=SeqID_122804
atgacattgctacttagcaacattctgcccagcgaccgcaatgccaatctccccctgcggaagtatcagttggtctgtgtcgtcccgacatgggtgtcataccctaatttcgtccggggacctttgcttgatgacatgcgaccattctttggtccttgtgag

SEQ ID NO: 31120 - DNA, 565 bp, Glycine max
  Peptide Sequence Number=SeqID_122805
gcgagctcctggcagtcaaccgataaaagaacaaagtccacaaagaaaggaggcttgtgtggcggctggccaactatggatcttgagtggtatctggaaattcgcctctagtaatcgattaccaaggatcgtgatggcagcgcagttaatccatgatcgcgtggtgatggagtgcctagagggagtttgggagaccctcgaaggcaatgagaggtgccgattccgtgtcacgattcaactcactgctacttcattggtacatccagaggtaccagcacgcacgcttcagcagcctgtggagtggatactacctacacctactccatatcgactagtggagccagttcaagtgatagaggtgtcatcctctgaagaagaccctgaagaggacctagaggagttacctcccaaacctactgtggatgaccttgacttacctgaggatgatgaagacccactccctgatgttgattttccagaggatgttttgtcagcatctgaggcagactctacagaggagagtggccctggagggacagcaaatagtgacgactcttcatcatag

SEQ ID NO: 31121 - DNA, 189 bp, Glycine max
  Peptide Sequence Number=SeqID_122806
atgtggagttcacatgtctggaagcacaggagaacgttctttgctgatattattaccagtatcgatactggattattcatagcattactatccctccctattcattgcagcatgactgactacttgattaaatgtggaggaaagtgggataaatggccgatactactggaaggattcctctttggataa

SEQ ID NO: 31122 - DNA, 99 bp, Glycine max
  Peptide Sequence Number=SeqID_122807
atgggtgccaagtacctcgaagtggtcaaacgagggtcgcatcccaacaacggatggtccccggacgaaattagggaattaatgaagcattgggcttga

SEQ ID NO: 31123 - DNA, 283 bp, Glycine max
  Peptide Sequence Number=SeqID_122808
aagtgctgaagttgatgtctcgctaagcgagctcaatgcgcttagcgagtgtcatccgctaagaaaggcatcaacgcgcttagcggataggaggaatctagaaggaaatctgccatgcaggcacgcgctcaacgcatcatcagctcacttagcgagtcgtttgtcaccttccaggcttagcgcgagtttggcactaagaaaaaactcacttactcgcgctaagcgcgagaatggcgctaagcacgacgtcgaggtcagtgagccccttttaagcctggaatag

SEQ ID NO: 31124 - DNA, 1056 bp, Glycine max
  Peptide Sequence Number=SeqID_122809
atggccctcacgaagaagacaggggagatgacgactgaggccgcaaaggaaatcgctgagaagattgattcgtttgaggagcaggccacacagggatcgttcgtccctcatggacgtcaggatgttctggccgctgctattggacgtccagagcaccctggacgtgtccgtgctgctggagccggtgtcaccatcaagcaatactttggattggctccacggacgtcccgcagcgcttcctccctgcctcctgacgaattacagcagctgacccagcagatcagggaccagctagaggagtccatcacagagaaagtgacgaggcaggtcatggcatccttcagccaccttcagtcgcagatgcaatctcagggagttgtagtgcctcctgagcctgtggttggtcttggtccctccggtcctcgagtgagcacaaaggggagttgtgttgatccctcaggaaacgatcctgagaccggtgactctgacaggtgcggcttgtacatagaagcagatcctgcacgcctggttaccatcgggagagtttatgagggatccactgttgttcataacactcctttgttgcctggccaagtaaaggtgagtgtggaggaggtagagatgcagatgctccagttcctgtacccactgatgaggttccttagtggggcaggcacttcacaccttccttgcttgggcgacacatctggtcaagtctttatcacagcagctgtgacactggcaaaatcacctccgaagtctgatccggaggtcgatgatccgctttatctaatgacattgaccatcccagagcttttcttgaagccttatcaggttagatgggatgccaccgtgttcggggtctttaatccagatttccccctttacataaagcacgaagacctctccgatatcgcacacggtggtcaatgtctcagcatattagtgttacagttgtggattctgcatctcactgaaacatgtatgcgagtggggaattctgatatctatggattcctcgagccacagttcattcagaggtctgggcaatcgtag

SEQ ID NO: 31125 - DNA, 429 bp, Glycine max
  Peptide Sequence Number=SeqID_122810
atggccaacaatataatcaacagcagggacaatggaggaaccaccctggaaatcagttcaatagagatcaagatggaccatccacaaggccacaacaacaagggcctaaagagcacagagtccgccataaagaatcttgaggtccaagtgtggcagcttgcaaagcaattggcggatagatcatcaagcagttttatagataatacagagaaaaatcccaaggatgaatgtaaagttgtgatgaccagaagtagaatggcaatcaaaggagatgatagtgaagctggaaagaagatggaggaacataaacaacagctgtcatctaagccaacacttgaacctgtttctgatgttgtagaacttgaagagattaatgaggagaatgaagatgataaggaagaagagacaccaataaaagagaaagaataa

SEQ ID NO: 31126 - DNA, 204 bp, Glycine max
  Peptide Sequence Number=SeqID_122811
atgacaaccaaaggacatctgagagttgattggccaagtttcaagaaaagaatagagagatccaaaaagaaaactttcaacgatcagaaagcaaagaaggtctacattacttggaaagacaacgatatggactcatctgaagattcagataatgaagttgtaaacttgagtctgatgacaaagaattatgacagcgatgaagag

SEQ ID NO: 31127 - DNA, 620 bp, Glycine max
  Peptide Sequence Number=SeqID_122812
atgcgggcgttacgactgactgatcaaaagattgcgggtaccgccttggatagtcaaggggagcgactagctctagatgacctcatggcataccgtgatttctgcgaaggaaagcgtgttccgctgcatcaagaacattctatgggcgagcccacccttggatacatcgagaacgtgcgattggtccaagatggctcagatgtcgaaagctggagcgttattggtgatgtcatcgtaacgcaagggtctctaccagaggggctaaatggatttagcatctcgttcaccgcgccactggtcgaggtcgaacaccctgaatttctactatatattccatacccccattacaatgatgccacgtttgtagccgagttggcttcgaatccgcgcatgaagatcggaaagtggatcaagaagtccgcggaagccaccgaggtggcaatatttggcctctctgtctcattcctgcttgcgccggtgtgggatgatttgtataagaacgatctgtccccgcggatcaagagttttattgcagaggggtggccaaaacttcgatcaaaaggcatgacgcttgaacatgtgcaacaggttattcactcaggccgtgtggtggagctcag

SEQ ID NO: 31128 - DNA, 249 bp, Glycine max
  Peptide Sequence Number=SeqID_122813
atgttaatttgtggaaaacgtcggaaaaaccgaaggaaactggtcgaaacgaaaattctaagttcgggagttgtatttacgcttgaggaaggtcgacaaaagcgggcttttgctcctacgtaccctccatcgaagaggaaatcagacctacgtagttctttcttaagggtgaatcacacgatttctttttacttgaaaggtgatcatttaaaggcgttggaccttaaaaatgatccatttatttggtga

SEQ ID NO: 31129 - DNA, 459 bp, Glycine max
  Peptide Sequence Number=SeqID_122814
atggataatgaagagggaatgcaagaacagatgaaggccgacatgtcggctttaaaagatcagatggcttttatcacgaaagccatgctaaaaatacaaaaattaatagaagacaatgctacggcggccgcttctaatacagctagggaagcggaaccggtgctacaacccgcaatgaacttgggccgggacggaagcgcgacgggcttcaatcggaggtattgtcctcaagcctacccttatggtttgcctccagacttcactccccgtatcgctccagacgatttgagccaagcccctaccttcgaggggcaactccttcttcatgccgactatcctctgcaggaagatgatgaaggagatgcccatttaggccctctacttcccccaagggaaccagctccccatgagttgccccaaccaaacataatccgccatgccccgtctcaatccgtcccc

SEQ ID NO: 31130 - DNA, 258 bp, Glycine max
  Peptide Sequence Number=SeqID_122815
atggaagctacaagcgagatcgtcattgaccacttgcaaagtgttgagatcttaactatgtatggcaatcaacatcattattcaaaagtgttgttcaagactgataacaatgagcttgtacaacaaatcttctcatggagtgatgacaaaggtgaagtccttgaacctaccaaaagctctgtcatcatgccaagaacaactcaagtgaagcctcaaagaactttattctctaagattgaatcaaaatcaaggttctaa

SEQ ID NO: 31131 - DNA, 675 bp, Glycine max
  Peptide Sequence Number=SeqID_122816
atgctttgctctgcgcgagaagggcggtttatcgtcgccttacgtagcggtatctggctttgtgatgcccgcggtctgctgcaacgcaaaatctgtgataacccaagtaacccggatctggcgcgttttaacgacggcggcaccgaccgggatggccgtttttacgcagggaccttctgggggccgggggattacaatggcgcgctgctggtacggattgataatgacctgacgccaaatgtggtgcagtgcgatattcatggtgctaatggtctggcgtttagcgacgataagcgctggatgtatacctccgatacgccgaacgcggtgatttaccgcacgccgctggatgagcagggcgagccgggcaaacgggaagtacttcgtcgtttccatcctggagaggggatccctgacggtgcggcggttgatgaagaaggctgttactggagcgcgatgtttgacggctggcggattgcccgcttttcgccgaacggagaacaactggaagagtatcgcgtgccggtgcgttgccccacgatggtgtgtttcggcggcgcggatatgaaaacgctctacatcactaccacccgggaaatatggacgccgacgaagtggcgcaatatccgctttccggcgccatcttcaccctgccggttgcggtggcagggatga

SEQ ID NO: 31132 - DNA, 138 bp, Glycine max
  Peptide Sequence Number=SeqID_122817
aatcaagaacaagtcaagagttcaagaatcaagaagaattcaagactcaagaagaaagcctacaatcaagaatcaagattcaagattcaagatctcaagaatcaagatcaagattcaagactcaagattcaagaatga

SEQ ID NO: 31133 - DNA, 558 bp, Glycine max
  Peptide Sequence Number=SeqID_122818
aagagaaaaggaaagaaagcctcagaggctaacattaacctttcatacttccatgggaaggacaatgtagaggctaacttagtttgggaaataagggtagagcaacaacttaaaaagaagtctacttcaaaatcttatggctctcactcttatccaaagaaagaccaaggtcaaggcatcttaggggtgacaccttctaagcccaaagatggtaaggggaatacaatagaaaagcaagcccctaaggctagtatgcaagagaaaactagctctataaagtgctttaaatgtcttggaagaggacacatgacttctcaatgccctaccacgaaaaccatgattatgaggggccaagacatttatagtagtcaagatgaggctactacttcaccttcctatagtgaaagtgaagaagcaaaaagggaagaatctagtgaagaaatctacccccaagaagaaggacaaccattagtggttaaagagaagtgtaagaagacacttgctagcattgccacacctcttgggcttgaggttattcctcaaggacccattaggtag

SEQ ID NO: 31134 - DNA, 75 bp, Glycine max
  Peptide Sequence Number=SeqID_122819
atggagcttacattacctaatttcgtctggggacctttgcttgatgacatgcgacctttctttggtccttgtgag

SEQ ID NO: 31135 - DNA, 333 bp, Glycine max
  Peptide Sequence Number=SeqID_122820
atgacgaagtctatggtgaagccaagaaacattctactaactctgaaggaacacaatgctaatagttgcacgaccattaaacaaatatacaatgcaagaagtgcattccgttcttccataagaggaatcgatattgaaatgcaacatctgatgaagcttcttgaacacaacacctacaaaacaaaccggtacagactctcactgcttgattttgttggggtgacaccgactgggatgacattctccgccgattttgcatatgtggagtgtgaacgcgctaataatgtggtctgggctttacaacgcttccgaggccttttttttaaagcgtga

SEQ ID NO: 31136 - DNA, 387 bp, Glycine max
  Peptide Sequence Number=SeqID_122821
ctggctaacaatcaagaccagccttggtctagaattttagtctctaagtatggtgggtggaaggagttgatttgtggtggaaggaggaatttcacttcccaatggtggcaggatttgaagagtatcttccagcagcatcacaatgaatgcttaactgataatttaaaatggagagtgggaagggggtccaacatcaatttctggaagcataaatggatggaggacaactgtactctccaaggaaaatatccccagttatatttaataagtaaacagcagaattcatcaatcaattatatgggagattttgtggagggtaggtgggaatggaagttatcatggagaaggacttccaaatgcactttaatttctggtcaaccaatctaa

SEQ ID NO: 31137 - DNA, 129 bp, Glycine max
  Peptide Sequence Number=SeqID_122822
atgtcgatttggaaatgttcgatcggagtcatccggctaaaggcccaagtggagaaggacgaaggcctaagtggagaaggacaaagcccccgagtggagaaggatgaaggcccaagtggagaaagatga

SEQ ID NO: 31138 - DNA, 207 bp, Glycine max
  Peptide Sequence Number=SeqID_122823
atgaacgaaagcgcaattcattgggctctgaaaaagggtgagaatggagaattccactatgcaatcactacgcatggctccaaactcgaaggtggaggacacatgaacgaaaacgcaattcatggggctccgaaaagattgagaatggagaattacactaaacaatcactaagcataggtccaaactcgaaggtggaggacacatga

SEQ ID NO: 31139 - DNA, 204 bp, Glycine max
  Peptide Sequence Number=SeqID_122824
atgggggtgcaaatagcacccaggcccatttgggccctccagaagaaaatctacgccgaggcgcttccgaaacgtttccgtaacgttttcagtgaggaatctcgcaaaggtttgaaccgttcttcgacgttcttcattcgttcttcatcgttcttcgatcttcaacgggctaagatcaattcgcctagtcaagctcgtccataa

SEQ ID NO: 31140 - DNA, 486 bp, Glycine max
  Peptide Sequence Number=SeqID_122825
atggaagtccagctctccaaaaagccttccgagttacggaaagatcttagaaacgttgaccaaggagaagtatccaagccattggcatcactacacacatactacggaccagcctttgagatgcttgcacggattcgggaagacttccaattggcactaccgcgagagcccattgaagcaattgaggccaagataggatgctctgcaaggaagagtaccggaaccataccatttcgctcggagcctctgtggggcgaaggatatggcaagtcaaggagtagttgggtcccgtttatggatgtgttagcgttgctaatttttggggtcgtcctctttccaaacgtagatggtttggtggacctagcagcaatcgacgctttccttgcataccaccatagcaaggaaagtccggtggttggtttcacacctgttccagcaagacacgaggcatccatgtccgctccagagccatcgctcgtgtactga

SEQ ID NO: 31141 - DNA, 258 bp, Glycine max
  Peptide Sequence Number=SeqID_122826
atgtctcttgccactctctttggaaaacttcaagaacatgaaatggaacttatgagactccatcaacatgaagagaatgatataaagagaaaaggaatagcacttatagcctcatcatcttttattcaagaagaaagtgacaaagaggacttgactgaaatagaagaagatgatgatgattttagattctttgtgaaaagaagaatggaaaaattcgacaagaggaatctcaaagaaaagaaagaaaagaaagcataa

SEQ ID NO: 31142 - DNA, 228 bp, Glycine max
  Peptide Sequence Number=SeqID_122827
atgccttttctttccctcattttcattttctctcttcttctctccaaaaccctttctttttcccgcagcccacaaaacctatctcagaaaaatgatgatcccggactcattcaccgttggatcgtcgcgaaatttgagtaccacgttcggaacccaatttcgagaattttcacagttgggaattgcaaaatcatgtctgagcttagaggaaaacccttcgcattgtag

SEQ ID NO: 31143 - DNA, 306 bp, Glycine max
  Peptide Sequence Number=SeqID_122828
atgacggtgcaaacctctgacacatgcagctcccggagacggtcacagcttgtctgtaagcggatgccgggagcagacaagcccgtcagggcgcgtcagcgggtgttggcgggtgttcggggctggcttaactatgcggcatcagagcagattgtactgagagtgcaccatatgcggctgcgcaactgttgggaagggcgatcggtgcgggcactcttcgctattacgccagctggcgaaagggggatgtgctgcaaggcgattaagttgggttacgccagggttttcccagtcacgacgttgtaa

SEQ ID NO: 31144 - DNA, 294 bp, Glycine max
  Peptide Sequence Number=SeqID_122829
atgccgctttccatgtgtcggaggcttggagagttggagataatgccgactaggatgactttacagttagcagatcgctccatccgcagaccctatggagtgatagaagatgttttggtcagctgtgtagtagacatgggaaagaagaagctagaaatgggcattgaagaccaaaaggttatctttgagctatttgatgaagaaaggaaattgctggaccagaatgtttgtctagaggtgaaggagagtgaagagaaggttctgaaggagagaaccaagcttgatccgggctga

SEQ ID NO: 31145 - DNA, 411 bp, Glycine max
  Peptide Sequence Number=SeqID_122830
atgacggtgaaaacctctgacacatgcagctcccggagacggtcacagcttgtctgtaagcggatgccgggagcagacaagcccgtcagggcgcgtcagcggctgttgacgggtatcgggcctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgtgttcaccatgagtatagggcttaaatag

SEQ ID NO: 31146 - DNA, 246 bp, Glycine max
  Peptide Sequence Number=SeqID_122831
atggaatctccttccttcttaggtgctttgttcttctatcctcgatcctcaaaggaaatgtttcatatgtcaggagatggatcatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31147 - DNA, 289 bp, Glycine max
  Peptide Sequence Number=SeqID_122832
gaagctgctgccagagagaaatgtggcatcattgatgttgccattgtgaaagaattttatgctaacctctacaacatggaagataagtcacctaggcaggtgagggtcagaggtcatctggtcaaatttgatgaggacacgcttaatacattcttgaagacccctgtcatcattcaggagggagagacattatcagcttattctagatttgcactctggaggcctgatcctcaagagttagctgctaagctctgcatcccagggagggggtttgagctaaatgttgatg

SEQ ID NO: 31148 - DNA, 738 bp, Glycine max
  Peptide Sequence Number=SeqID_122833
caagtcgtgctgcacccggcgccggatgcggggcagctgcaggccgaacgcgcccaggctctggtatttgtcggcgtcgcgcaaccgtgcccaggcggggtggtagcgatattgcttgcggccacgcgcatcgcgtccggtcgcctgcagatggccatgcggcaatgggcagatccagacatcttcgtacgccggcgggatcgccagggcgcggatgcgcgccaattcggccgcgcgggtgatgcgcctgccatgcgtatccaggtaatggaaggtcgcgccgttgacccgcacccgggaatagccgggcccggtgtcgtccatatagaccagcgcgtcatcggcgccgcgctcgggcggcgcggggctgcgacactacaggacttcaacgtcgccattctggtgatggacggatttgaagaggtggagctgaccgacccgcgcgacgccttgcgcgcgcagggagcgcgcaccgtcatcgtgtcggcgcggcacggcgacgtgcagggcatgcgccaccacgacaagggcgagcgcgctcaggtggacctgacgttcgcgcaagcgcgcgcggaagcggaccggttcgatgccgtgctgctgccgggcggcgtggtcaacgccgacgaaatccgcctgcatcccgacgcgcgcgagctggtgcgcgccctgcacgaggccggcaagcccgtggcggtgatctgccatggcgcctggctgctgatttcggagggcctg

SEQ ID NO: 31149 - DNA, 800 bp, Glycine max
  Peptide Sequence Number=SeqID_122834
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatgtttatgctcatttccatgctatcaaaagaaatggtggttatactggtgaacccgattctcctttgaacaaaaccggtttgaaacagctcaatgatctctacatccctggagaacaagaaaatcttccaaagtttgctagaagggggctcaatttttttgagacgcgggaggagagtaatgagcaaaacagtggaagcaacaacactttgtctgagtctaaacgtgtgacaaaagatgagacagtaattttggccttgaagaaagccattgccaaattagaagatgaaaaggaagctggcttgcttcaatatcagcagagtttggagaaaatgtctaatctcgagttagagtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 31150 - DNA, 297 bp, Glycine max
  Peptide Sequence Number=SeqID_122835
atgggtgaaaagacaggtgctgaggtgaaggaaaatgatgtgaatggtaaaaagaatcaggaaaaggggaagaaaataatggtccagaataaagagatggagaaccaagaaaaagaaaaagaaggagaaaaagaaatagaaaatgagaaaaatgaaaaagaagaaaaaaaaagatttcaaagaagagtagaagtggaaaggttgtggacaaaggtgtggaagtaccatatcctgtggaaattggaaataactatgccctttggcgaagctctacagcagatgttgtggcgtccctaa

SEQ ID NO: 31151 - DNA, 468 bp, Glycine max
  Peptide Sequence Number=SeqID_122836
atgaggggcactgtgcatgagcctcaagtgaacctaggggcagatcaaaataccctcacctttagaggactacacgtcctcaccttcagaggactacacgtcctcaccatcagaggacttcacgtcctcaccatcagaggacttcacgtcctcaccttcagaggactacacgtcctcgccgtcagaggattacaagtcctcaccatcagaggacttcacgtcctcaccttcagtggactacacgtcctccctgtcaaaggactacacgtcctcaccttcagagggctacacgtcctcgccttcagaggactacacgtcctcgccttcagaggacaacacatcctcgccattagaggactacacgtacccaccttcaaagggctacacgcccttacctttagaggacaacacgtcctcgccatcataggactacactccctcgccttccaaaaggcgacacgtccttga

SEQ ID NO: 31152 - DNA, 457 bp, Glycine max
  misc_feature (31)..(31): n is a, c, g, or t
  Peptide Sequence Number=SeqID_122837
caacgcggcctttttacggttcctggccttntgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccatgagaaagcactggtcagtgatgaaaggaggtcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31153 - DNA, 303 bp, Glycine max
  Peptide Sequence Number=SeqID_122838
atgacttccaagattattttgatgatgccaaagaataatgagtcaagcaagtttcaagaatcaagattcaagaataatcaagatcaagattcaagattcaaagcgtacatctacttgggttgttatactgagaacaagagagggtacatctcttgtggatcagttcaagtggagcatacatccacttggttgttcaaagagaacaagggaaggtacatcccttgtggatctttacttgtaaaggattttacaaggttattggaaatctcaagaaccggtggttgctttggggactggatgtag

SEQ ID NO: 31154 - DNA, 588 bp, Glycine max
  Peptide Sequence Number=SeqID_122839
atgccgggagcagacaagcccgtcagggcgcgtcagcgggtgtttgacggttttcgggtctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatcatacaggggcttcagccctgacctattgatgtaccctttcaccatcgcttgggaggtatcatcgatggctatggttgtgcttgtgcttgtgcttctgcctgcagttgatgtcgttaggccaactctccatcatcatgtgttgatgcaatcacatgtcgccattgtgcctcgggatctgagacaaaggcagtacattccatgcgagccatctgaaaaaaaacaatga

SEQ ID NO: 31155 - DNA, 141 bp, Glycine max
  Peptide Sequence Number=SeqID_122840
atgggtgacctagaggaagtacaagaacaaatgaaagccgacattttaccacccaattacacaccaccagccatacatgaagacgtgggtcacattcctcccctcatcctcgaaggggaacctcctcgacatcctgacgag

SEQ ID NO: 31156 - DNA, 270 bp, Glycine max
  Peptide Sequence Number=SeqID_122841
atgacagcatggagcggtatttacagcacttggttcgccagtaggcggccaaccacagggggcagcctcagtcagcagagccagggtttcgctccttttgcgtgccctactccagatcagtttagggctaaggttgcatggcccggagattggcctgaggcccaagcagaggaagcgctcgcagaggctcccagcgatgcagaggaggcctgcatggatgaggagatgacagatttactcggtttcttgggagggagtggagccacatga

SEQ ID NO: 31157 - DNA, 510 bp, Glycine max
  Peptide Sequence Number=SeqID_122842
atgacgtacaggcagcgcctggatcgtctgagaatcctagatgtctgctggatgtcacatgcgaagcaccgacctgtgcaggactttcatccgatttcgtgcttctcgggacaaatccgctgggggcctgttgttgtcagatacagaccgaagagggttatgcgccagttcggctacgtccagtgcattcctgcacaccctgtccattcatgggtgtcatatgatgacatgggcgatacttggacgcactactcagaccatctggcgatagcaggtgatctatgtgttgtgccaggtcagtgtgcacctaactacatagactggttctttgtcatatcgcatccattcatgactgcgccactgacgaatcctcctcgagatgcatatgcgacgcaacccagtcatatccctcatgaggcaacaccggcatcgacacatgcggatcttgatgcggacgagcccagacatgcagtggaagcttgtcatgcgatcgtggatgcgttggagtag

SEQ ID NO: 31158 - DNA, 114 bp, Glycine max
  Peptide Sequence Number=SeqID_122843
atgcatggagttaggatcatggttatgaccagaggattaggtcgtgccttaggtcaggtcactagcagaggtgtgggcagaggagaacatgatgattccgatgatgctccatag

SEQ ID NO: 31159 - DNA, 535 bp, Glycine max
  Peptide Sequence Number=SeqID_122844
gcatctcactgaaacaagtatgcgagcggggaattcttatatctatggattcctcgagccacagtccattcagaggtctgggcaatcacagtttgagtctgaaagttacataaagacttggatgcagagttcaaaacatgatgtctatcttggagcctacctaaatggcggacactggcaaatggtcgtcatcgtgcccaaggaacacctagttgtctggttttgttcattgcataacaggccagacaactaccttaaggggattattaacagtgctttaaaaggttttgatgatgctccacagcctaaatcaaaggctccagctaggtggattgtcgtcaagacaaaaggaagtaccgagtgcggctactatgtcatgcactggatgtcaaccatcattttaggaagttttaggaataactgggaagcgtattttaacgatcctagaccattggagccagagagattaaaggtgttgtggatgcagtgggcacagtattatctccgagttagagatcagacacctaggatttag

SEQ ID NO: 31160 - DNA, 282 bp, Glycine max
  Peptide Sequence Number=SeqID_122845
atggcgatgatcttccagcatggccttacggcgatcgccgaagcccggagcgatgccagcgcttcaggccgccacgcagcttgttatgccggggtaccaagcgcttggcgccttcctgacgattgcctgcagaacgagttgcggtcgtggactcgccggccagacgttgtcttcgagaaccgggagcatctgcaggaggatgaagcgtccttcgacggtcgcgccgaaggacttgttccggttacgaccctagtaggggccgagggtgaccttcacggttag

SEQ ID NO: 31161 - DNA, 160 bp, Glycine max
  Peptide Sequence Number=SeqID_122846
atgcaaacctcccaaggaggggacctatcaccggagccatggctaggagacttcaggaagattgggccaaggatgcaggagaaggccctagggttcttgtcataccctaatttcgtccggggacctttgcttgatgacatgcgacctttgtttggtcctt

SEQ ID NO: 31162 - DNA, 387 bp, Glycine max
  Peptide Sequence Number=SeqID_122847
atggaagggttagtggacctagcagtgattgacgctttcctcgcctttcatcatggcaaggaaagcccgatcgtcgccattttggccatgtatgacacgtttgaccggagatgtgaaaagagcggcgcaagaattgtttgttgtacaccggctctctatgtgtggctggtttcgcacctttttctccaagaaggtaggcccgtctatccgctacaaggtcatcgctcgtgcgtcgaaaaaaggaaaggcgaattgggaccaactcttggctaccccatgagaggagtgccatcagacgaaagcatcacgcctttcatcgcacggggtttcagtgaccacaacgcgagggtactccaaggagttcgcaaggcatgggatgcggcgtga

SEQ ID NO: 31163 - DNA, 640 bp, Glycine max
  Peptide Sequence Number=SeqID_122848
gggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgggaattcaag

SEQ ID NO: 31164 - DNA, 1371 bp, Glycine max
  Peptide Sequence Number=SeqID_122849
atggtgccaactattgaggagtttgaagagatattaggatgccctctcggagggagaaaactgtatcttttctccggctttcttccttcgttgagcaaggttgcggctgtgattggagattcagtgaaggaattggatcgcacgaaacaaactcggaatggcatagtgggcttgcctcggaagtacttggaagacaaggcaagggatatggcgagccaagagaaatggggcccgtttgcagatgttttagctttgctgatttttggggttgtcctctttccgaacattgacggcttagtagacttagccgccattgatgctttcctcgcatatcaccatagcaaggaaagtccagtggtggctatcttggcagatttgttcgacacctttgaccggaggtgcgagaaaaacagtgcacgggttgtttgttgtttacccgctctctgcgtatggttgacttcacacctattccgacaagacacgagacacccgtgtccgcttcaaagctatcgctcatgcgctgaaaaaggaagagtcgtttgggaccaacatttggctgggatagggggcagcacgatcaattggtttcctcgttggaaggaaggcaaggaaggagttcttttctcgtgtggggactatcctaatgtgccactgatagggactaggggttgtattaattacaatcccgcactcgccataagacagctaggatatcccatgaggggagcgccaaccgaagagagtctctcgcctttccttgtgaggaatctatgcgcgcaaagtctcaatgcgatacaaagagtccacaatgcgtggagaagtccgttgaggaaagacaaggagcttagaggcatccgaaatggcgtcatcggaggttatcatggatggctaagaattcatacgcgagggttagattggctctccaaattgaaagttatcaatgaggagaaattcgaagctccggaggaagatgaagaagtccgagctctaaaattagagttagggaaggcaagactcgcaaaggagaagttcaaatcagctgctacacacatccggaaagagtgcactgagttacaagaggaaaacgcggccactgcaagagcccttgaacaagaaaccaaaagggcccgcaaggaggaatatggtcgagagaaattccgaggagcattgtggggtagcaacaatgagcttaagctccgaagagaggagagagatcggtcacgggtgcatggcatgatcttaaaagaggagttagttgcttgcgcgaggtccaaaaggagtttggctcaacacttggaagccacaagagcaaagcatgctagctatcatagggcaatacaaggaagaattgaaccagtccatggcccatga

SEQ ID NO: 31165 - DNA, 324 bp, Glycine max
  Peptide Sequence Number=SeqID_122850
atgatgggcaatttcacagctacaggttgggaatggaactttaaatggagaaggcaacttttcgatgatgagatggagatggctgtaaagtttttacaagatctagaagatatcagcatccacccggaccgagaagacaagtggatttggaaggaagatgcatcgggtgtctattcagcagggagcgagtacaagaagcttatgtcagcccaaactgatgaaatcaggatggtgtttttactgagttatggaaggtcaaggctcctagcaaagctacgttcttcgcgtggagactactcggggatagattaccaacaaaaatga

SEQ ID NO: 31166 - DNA, 717 bp, Glycine max
  Peptide Sequence Number=SeqID_122851
atggcacgaatcaaaagggtaattatgcacctaaatgatgtcgaaagacaacccggcgtaattaagcaaatgcaggttcctgaggggtttcgccttggcggatgggtttatgttttaagcaaccctagcatgccaagaatgttcaagatcggcatgacaaccaacaaccctaaagccagagctaaggagatatcttcagctactggcgttcccacgccttttcaaattgaagcgtcatttcattgcgacaacccagcaaagtctgaagcggctattcacaaggcgctttctgaatggagggtaagcgagtcccgcgaattcttcagtttggaccttgaagaaatcctttattgctgtgaagagcactgccagggcagggctgatatggcagttgaggatatggcgtttgaatacaatatcatctgctttgagaagctaactgagcttaacgtatcagcattgtttgatgagcttggcctcacaacatttggcagcaagttagccatcgcagaacgcctaatcagattcggttatgaaatcacctacaaccgattaatccaaaataatctgtcactcgtcctgatcgacgagaaggcaattcctatcatgagcgcagagcagcagcaatttgaagaggaagaaaggcaagttgccgagtattaccagaagcgagaagaaggtggcatttgcggaccatatataccggtggacatttaa

SEQ ID NO: 31167 - DNA, 834 bp, Glycine max
  Peptide Sequence Number=SeqID_122852
atgcaaaatgcacagaaggtcatttcgacataccgccgcaagcgcattctggtgtgcctggccgttgcatttctgacgcttgccgtcaccctgacaatccgatttatttcacagcgtagccaaaatcaacagcgcatccagacggtgacccgcaatatggtgatcgcgatggacaatatcctgcagccgctggcggcaaaacacgctaccctgctgagtatggtgggcaaaccctgtcaggatgtgcatcttgagctgcgtaaaaccgcggccacactgcagaccgtacgctcaatcatccttgttcaatccgggatggcctactgctccagcatttttggcccgcgccatgtggccattcatcagctgcagccaacgttgccggcagtcaacccgctgttggccttttcaaccgataactcgctgctcaaaggcacaccggtactgattcagtggtatccctcctccgtaagcggtgccgacggcgcgttgttaattatcaatattgagctgcttggcgaattgattctcaaagaaaaatcatcgttgataagcgacatcagcctcacggtaggcaacaagagttttctcagcgatgttggcgttgttgcaagcgatcggttgccgggtctgccgataatttaccggcaaagttccagccagtttccctttaccatcaacatcagcggaccgggagcctccgcggtagccttagaagagctgcccgccgaattaccgctggcgctgatgttcagcctgttgatgaccggtatcgcctggttgacgaccgcaggacgaatgactttctcgcgcgaaataagtgggatcctctag

SEQ ID NO: 31168 - DNA, 397 bp, Glycine max
  Peptide Sequence Number=SeqID_122853
gggcatttggttattgtgtcaggggaagaagagatcttggcaaccttgcctgtccgatacgacattgatggtagcccgggtgatgttggggaatggttacgagcccggaatgggtttaggcaagaacaacgacagcagaaccagcctgataagcaccagaggaaaccgtgggaagtttgggggggcccgccctgccacatcagcaggagctttataagcacgggtctaggacacgaaagccaagtcgttgcgatatgcgaggatgactctccgagtggttcagatctagtacgaccatgccctcctggttttcgactaggaaattggcgagtggaggagcgcccgaacatttacgcgacaagcataatgcaaccctttgtggcttttaaactctaca

SEQ ID NO: 31169 - DNA, 165 bp, Glycine max
  Peptide Sequence Number=SeqID_122854
atggaccctatcaagactgcacaaaatgatgcatggactgactcgacactcagatgcaatgtgggaactgtgttgagtttgacgagaccacccggttgtgcacgtaacagcccccctcccataggtgatcagcctgggagcccaaaggtgttccctaccaggtga

SEQ ID NO: 31170 - DNA, 608 bp, Glycine max
  Peptide Sequence Number=SeqID_122855
atggaacaacgccgtttttccggcaaaggccactggtatcacgaaacccagtcaaaccacgcgcagtcggatgcgctgcccctggtgcccgaagccgctaacgttgacgatcgttttttgctcgatttagccctgcccgatgagattgtcgccgcctgtaccggctggcttgcccctgccagagccttatgccatcagctgtttcccctctcacttcccgtcaatcgtctgcgaacgctcagcgcctatgaccggttaagtaccgcgttgacggttgcgcaggcctgtggcgttcagcggctatgcaaccattatgccgcccttcttgctccgctgccgggtcctgactcctcccgcgaaagtaaccggcggctggcgcaaatcacgcagtatgcccgtcagctcgccagctcaccggatgtcattgatgacaaggcgcgaaaccagcttgatgaggtgggtctctctacctatgacattgtggtgattaaccagatcatcggcttaatcggttttcaggcgcgcgtggttgcggtctttcaggctctgcttggccatcccgttcgctggttgccgggccatcatattcagccgaacgccctgccagc

SEQ ID NO: 31171 - DNA, 342 bp, Glycine max
  Peptide Sequence Number=SeqID_122856
atggtggacaccctgccagtgttttactatgagaagttggtaggctacatgtcgtccagctttgcggacctagtatttgccggggaaagaatcgaagtagggttgaaaagaaggaagtttgattatgtttcctccacaagtgccaatgctaaaaggatcggagcaactggggcaaaaaggaaggagggagatgcccacgccgtcacttcagcgcccgcgtggatcaagcccccgcagacatctcatggtacacatcagtacgtgcaacatcatccgagcttctcagctcacgccgggaactcctctaatttagcacccgtgcagcctaaggcacccgtctag

SEQ ID NO: 31172 - DNA, 261 bp, Glycine max
  Peptide Sequence Number=SeqID_122857
atgctattcggctcagcttattttcatggtcatgatctagagaagccaagaggtggctgcattcattcaaaggttgcatgttgtgctatttgtggtggtgctcatgagtcaggctgctgtattcccactgaggatcatgcacatgaagttaactacatgggaaaccaacctagacaaattttaatgcaagtggattctcaggatttcagcagggccaaaattataactagtagtatggacagtgcgagctcatcctggtaa

SEQ ID NO: 31173 - DNA, 930 bp, Glycine max
  Peptide Sequence Number=SeqID_122858
atggctacctcaccaaaagaaacttcagcttctggttcaccctctgtaccatcatctccgcaccaggaacaacctgaattcaacatccaacccatacaaataattcctggtcaagcccctgttcctgagaaactggtccccaaacgacaacagggagtgaagatttctgaaaaccctagccttgcaacaagtcctagggaagtagacacggagatggacaagaagatccgcagtattgtgagtagcattctgaaaaatgcttctgttcctgatgctgatgaagatgttccaacatcttccaccccaaatgtttctgtgctgatgctgataaagatgttccaacatcttccactccaaatgctgaagtcctcccttcacccagcaaagaggactcaacagaggaagaggatcaagccacagaggagacccctgcaccaagggcaccagaacctgctccaggaacccattgccaacaagttggcacctggcattgcagaaagattacaaagcagaaagggaaaaacccccattactaggtctggacgaatcaaaactatggcacagaagaagagcactccaatcactcctaccacatccagatggagcaaagttgcaatcccttccaagaagaggaaagaaatttcctcatctgactctgatgatgatgtcgaactagatgttcccgacatcaagagggccaagaaatcagggaaaaaggtgcctggaaatgtccctgatgcaccattggacaacatctcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtcta

SEQ ID NO: 31174 - DNA, 210 bp, Glycine max
  Peptide Sequence Number=SeqID_122859
atgccactcaagactcagataaaagaaaagggaggaagctggtattggattagtggatgtaggaatcacatggccaactatagtgcactattttcaaaagcattgatgagtctgtcaaagaaagattcgactggaaatggaagtgtggttgaatcaaaaggagaagggctactcgtcattggagctgaagcagtctacactcatccatga

SEQ ID NO: 31175 - DNA, 174 bp, Glycine max
  Peptide Sequence Number=SeqID_122860
atgggtgttaagtacctcaaagtagtcaagcgagggtcgcatgctatcaagcaatggtccccagacgaaattagggatgacccttcgctcaaggaacatgcacaactcatccttcttccagattcttcctcgcgcttagccgaggattattgcgctcagcggttggctcgctaa

SEQ ID NO: 31176 - DNA, 666 bp, Glycine max
  Peptide Sequence Number=SeqID_122861
atggatatgtctagaagtggaactagatctaattcatcagatgctaatacaggcacaaccacaagtgcaacaacctccttaggttcaagacctagaagcaaaaattctctgggaaataggactgatattgggtggaaacatgggacaaatgttttagggaatggtaaaaaatttaaatgcaactattgctcaaagatcaacaatgggggaatttttagattcaagcatcattttgctgggactagatgggattctgaaccttgttcttcggtgcctgaagaagttaagatgtttatgatgaaattcgttgcagaggttgctaatgcatcagagaagagaagaaaattgaacaatactcatgaagaaggtgtacatactgagggaatggagacaaataccactcaaagtggaatagaagggaaatggatgtttgctttcaaaggaagaggaaaagaaaagtttgttcaagctagtggtgagggagttcaagcaactttaaatcaattgtacaaaaaaggtaacaaagataaagttgatgatcaatgtaatgaattttggtactgtcataccctaatttcgtccggggacctttgcttggtggcatgcaacttgtgtttgctcattttgaggttgatcgaggccgtacccgaatcaaataaacattaa

SEQ ID NO: 31177 - DNA, 432 bp, Glycine max
  Peptide Sequence Number=SeqID_122862
atgaccgatttttttggcatcgatttctatacacctaattcagcgacatcatatttagctactttactacagtttgattcaccacattcatttggagaacaaggtcaaagttcttcaactgctactaccaacattgaaactactaacatagaactacaacatcatcatgacgtggaagaaccattcatactggaaagaagaaatccacaacgtaatcgacgtccaccaccttgtgggactggtcatcgtcttggttattttgatgaagccaaagaatcaagagttaagcaaagtttcaagcaaagattcaagaatcaagtttcaagtttcaagtttcaagattcaagattcaagaatcaagaatcaggaataatcaagatcaagattcaagactcaagattcaagaatcaagagaagactcaatcaagataa

SEQ ID NO: 31178 - DNA, 345 bp, Glycine max
  Peptide Sequence Number=SeqID_122863
atgaaagataagagggatgaggaagaaaaactagaaaatcaaaagaaaaagaaggatagtaaggccttgtctttaaaggccaaggggaaggaaaacgaggaaaaagattcctccaagaagactgttaagaatgaaaatcattttgcaataaaaggtgatatcaaaagagcactccttcttaaacaatctttctaccttctcgtatcaagggaaacatcccttagcactgccatacctcttgggcttgaggttattccacaagtaaaggagttgttagataagggtttggttcataagagcttaaatccttgtgctttgttggtgtcccaaatagggactctttag

SEQ ID NO: 31179 - DNA, 297 bp, Glycine max
  Peptide Sequence Number=SeqID_122864
gctaagtctctagcgttgctttctcttgaggatcaagcacagttctctttgagagtatccatgatttggctcagcatcggcccatcatcaacatggaggatttcgtggcttaagtggcctggcaagaagtctagccttcttctctggggcaaggtgacgctcctacagcccaggatgatgcaatcctaccccccaagggcattggatagaagactccaagaagattgggccaaagatgcaagagaaggccctagggttctcatgagccttagggtagatttcgggcccatgggctaa

SEQ ID NO: 31180 - DNA, 309 bp, Glycine max
  Peptide Sequence Number=SeqID_122865
atggagaaagaaggcggaccagtgaacagaccaccaattctcgatggaagcaactatgaatattggaaagctaagaatggtggccttcctcatcactggatagcagaacctggaaagtgctgctgcttggaaagaatgaaactggaaaccagagaggacttggatttaatcctaagtctgctggcaaacactaccatagaggaccaagaatttgttcctgccaaaaacaggactggagccacgatgtcacaacatcggtctcgacatcatggaatgcagctactctcggataggctgaaaaaagagtaa

SEQ ID NO: 31181 - DNA, 901 bp, Glycine max
  Peptide Sequence Number=SeqID_122866
tcaaaatcaagagcttagaggtcaccagtttacgaaagttggggcaattaatgggtcaacttcaacggcaagccttccgcaaagcctatggacttctagctagtgccgacttgaaagagtttgaagaaatcctgggatgcccactgggaggaaggaagccatatcttttctctgggttctatccctccacgacaagagttgccaaggtagtgaaaacctcagcacaagagttggaccgtgtaaagcaaaacagaaatggagtagtcggagtaccaaggaagtgtttggaggaaagggcaaaggccttggcaaatcaagttgtcctctttccaaatatggaagggttagtggacctagcagcgattgacgctttcctcgcctttcatcatggcaaggaaagcccggtcgtcgccatttttggccatgaaggaagaatcaggattctatcttcatgcgaaggatgtcccatgagaggagtgccatcagacgaaagcatcacgcctttcatcgcacgaggtttcagtgaccacaacgcgagggacataaagcttaggggaagcagtaatgggatcatcggcggctatcataagtggctgagagtccaaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggtagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatga

SEQ ID NO: 31182 - DNA, 432 bp, Glycine max
  Peptide Sequence Number=SeqID_122867
atggtgaaagttggaacctcttacgtgccgatcaacgtctcattttcgccaaaaagttggcccagggcttcccggtatttattcggcgcaaaggtgctcccagtggcttctgtttctatcagctgtcccctccctgttcagctactgacgggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 31183 - DNA, 387 bp, Glycine max
  Peptide Sequence Number=SeqID_122868
atgggaacaaatcaaactggaataaggttttatcaagtcaagattaagggcctagatattaccagcattaagaagttggggcggttaaggggacctctccaaatgcaagccttccgcaaggcgtatggaaagattttagatttgaccatagcagagatatccacagaagtcattgtatcagtcacccaatactatgaccagcctttgagatgcttcacgtttggggacttccaattagtaccgactgtcgaagaatttgaggagattctaggatgtcctcttggggtttcggcgagaggaattggatcgtgtaaagcaaaatcgaaacggtgtagtgggcctactacggaagtacttagaaggcaaggcaagggatatggcgaatga

SEQ ID NO: 31184 - DNA, 291 bp, Glycine max
  Peptide Sequence Number=SeqID_122869
ccggaatcgctagtaatcgccggtcagccatacgtcggtgaattcgttcccgggcctttgtacacaccgcccgtcacactatgggagctggccatgcccgaagtcgttaccttaaccgcaaggagggggatgccgaaggcagggctagtgactggagtgaagtcgaaagagagggatggggtttctcttgcttttggcatagcgggccccggcgggaggcccgcacgacgggctattagctcagtggtagagcgcgcccctgataattgcgtcgttgtgcctggactgtga

SEQ ID NO: 31185 - DNA, 620 bp, Glycine max
  Peptide Sequence Number=SeqID_122870
atggtcattgaccaatccctattttatgatttcaccaaattgcctagtgaaggtgtgccttttgagggtgcactgattgatgaatggaaattcgatttctctgtgcatgatgcccgctggttggtttgcaccaaccaagcggatatgaccggaagacttcttgccggttcattggcttttgaaagccgcatcctccattaccttatagttcgcattttgcttcctagatcttcaaaccttgcccaggtttctgaagaagatctcattgtcatgtgggcctttcataaaggtttacaaattgattgggcacatcttgttagatatcacatgcataaggcattgcgattgaatgccccattgccttatcctcaccttgttaccctcttccttcaacatttcaacatccctcttgattctgaaccttatgttccaatcaagagatcattccttataggcgcttcagtcatagcatcctttggttatattaaggagcatgatggctcatgggtaaagaagggtgctagaaatattggtgaagaaggacatgagggagaagactcatctcttctttcgaagattttggaaaggtttgatggtcttcaaacctttgttggtgagag

SEQ ID NO: 31186 - DNA, 1187 bp, Glycine max
  Peptide Sequence Number=SeqID_122871
aaaaattgtcggccttcccgaacggaaatggccgacaatttagcgggttatcagacagctggtcgcgcgataatactgcgggtttccatgcggacttcagcgatagttacgtcaatcacctcagtgactttgtaaactgtttcacctttaatctgcacggtgccactttcctggctacagaccagttcgtcacgaacggcatgcaggaatggggcagggataaaggcgacagcaccgttatccaccagacggacacgcatcccgccgcggctgatatcaataatctccgcagcgaagcgggtgtcggttccggctttatcctgcaggaaacgcgcgtacagccagtctccaacgtcacgttccgccatgcggttcagacggcgacgttctgccatctgcacggtcgtgtcgtcctgagggcgtgcaatcgtttcgcctttgataatcgctttcagcagacggtggttaaccatgtcgccatatttacgaattggggatgtccaggtggcgtaagcttccagaccgaggccgaagtgcgggcctggttcggtgctgatttcagcgaaggactggaagcggcgaatacggctatcaaggaaaccggatggctgtgcgtccagctcgcggcgaagcttgcagaatcctggcagcgtcaggacttcttccggatcaacatgcacatcgtgattcttcagcagggccgccagcgcttcggtattggccggatcgaatccggtgtgaacgttgtaaataccaaagcccagcttgtcgcgcagcacgcgtgcggcgcaaatgttggcggaaatcatcgcttcttcgacgatgcggttagcaatgcgtcgcggctcggccacgatatccagcacttcgcctttctcaccgagaacaaaacggtaatccggacgatctttgaacaccagggcgtgggttgtacgccattcgccacgcttcaggcaaatacggtgcagcagacgaatctgcgctgcaatggcatcggattcaggtttccagctgccggtgttttccagccagtcagagacattgtcataggccagcttggctttggattcgatggtggcggcaaagaattcgatatcgtcttcaatcgtcccatccgcggcgatggtcatgcggcaggcgagagccgggcgcacttcatttgggcgcagcgagcagagatcgtctga

SEQ ID NO: 31187 - DNA, 365 bp, Glycine max
  Peptide Sequence Number=SeqID_122872
atggcacacaatcaagggtgggagcaggagttaggtctttacaatcaatatgaagaagaaagaacttctaatcttgaaaggggacaagagttacaaccttactatcaaaatgtagcagaaagaggttccaatctgaataaactgttaatgcaattcatggaaacagctaaatcaactcaacaagcactccaaagtgtagaaatccaggttggtgagctagcagatgtagtaactcaatttatgtccagacgagaaaaatcctttgtagaggctgaagctcaagagaaaagccctataaaagagcatgagtcaagagaaaaagatgaggagaaagatgaggaacaagcacaacaacaatgggataa

SEQ ID NO: 31188 - DNA, 336 bp, Glycine max
  Peptide Sequence Number=SeqID_122873
atggctactcagttgaaccaagctcagtcccaaaattctgacaaattgccttcacaaactgtgcagaatccaaaaaatgtgagtgtcgtcaccttgaggtctggcaaccaaattcaagcgcctccaccagtagcagcacctgcacctgaacctgtcaagcttccttctacacctgacaaagaggatgagatagttgcacaaaagagaaagcttcctaacaaaaattttcatgtaggtgaaccttcttctagtaattctgacttaccgcagcctcatatccctcttccattcccacctagagcaattccaaacaaaaagatggaagaagcagaatag

SEQ ID NO: 31189 - DNA, 573 bp, Glycine max
  Peptide Sequence Number=SeqID_122874
atgccgagaggaatgagtaaattaaatcatttacaacatctggatttctttgttgtgggcaagcatgaagagaatggaatcaaagaattgggaggactttcaaatcttcgtggtcaacttgaaattaggaacttggagaatgtttcccaaagtgatgaagcgttggaggcaaggataattgataaaaaacacattaatgatttatggttggaatggtctggatgtaacaacaacagtaccaacttccaacttgaaatagatgtgctttgcaagttacagcctcactttaacattgaatcgttgcaaatagaaggctataaaggaaccagatttccagattggatgggaaattcttcctactgcaatatgacacgtctaaccttaagtgattgtgacaactgtagtatgcttccttcacttgggcaactaccttctctcaaggtccttgaaatttcaggattgaataggctgaagactattgatgcaggtttttacaagaatgaagattgtcgttctgggacgccctttccctcccttgaatctctggtcatttttgaaatgccttgttgggag

SEQ ID NO: 31190 - DNA, 165 bp, Glycine max
  Peptide Sequence Number=SeqID_122875
atggcacggagcgtgtttgctctttgcccctatttgggagttgtatttacgcttcaggaaggtattagcacctcttacgtcgacaaaagcggggcttttgctcctacgtaccctcctttgaagaggaaatcagacctacgtagttctttcttatgcgtgaaacaa

SEQ ID NO: 31191 - DNA, 249 bp, Glycine max
  Peptide Sequence Number=SeqID_122876
atgagaaacacgattttcactctctcctcgtctccaaatgccacccaaaccctaacacctccttcttcaccacccatgaccttcggtggctgccatgagctgccgttgcttgccgccaaacccccacaccaagaggaacattttaatcgaagcagaatcctcagaatcctcctcaaggattcggtggagaaaatccccccaatcctccatttcaaagcttctttgagggtgtttttacacttcctttaa

SEQ ID NO: 31192 - DNA, 273 bp, Glycine max
  Peptide Sequence Number=SeqID_122877
atggaatggataaagagaatgaagaaggtggttggaagaatcactcctccagaattggtgtcacgcacaaggtggtgttccttgataaaccaatttcttgaatcactcaaaattaagacacaaaaacatgtggaaaaatgcttagctcttggtcagccaagagtgacgcaatcctacccccgaagggcattggatagaagactccaagaagattgggccaaagatgcaagagaaggccctagggttctcatgagccttagggtagatttctga

SEQ ID NO: 31193 - DNA, 132 bp, Glycine max
  Peptide Sequence Number=SeqID_122878
gagagtctacctcctgtggcttactgtagtacccctggattagaccaaacatacctacatgaggtggcgaaggagaagaagcacagacttctgacgatgctcgagtgcgacgaacacgatgctcgaccttag

SEQ ID NO: 31194 - DNA, 159 bp, Glycine max
  Peptide Sequence Number=SeqID_122879
atggaagaggcagagaaagagatcttggaaacatttagaaaagtagagtcaactgatgtggtaattcatttagctaatagaagtgttgcctatcctgctggtttcctagaggacgtcttagttagagttggtgaactaattttccctgttgatttttaa

SEQ ID NO: 31195 - DNA, 492 bp, Glycine max
  Peptide Sequence Number=SeqID_122880
atgggtgccaagtacctcgaagtagtcaagcaaaggttgcatgccatcaacaatgatccccgggcgaaattagggggtctcgtcatttgcggtcgagcccgccctctccctctcgcctatattcgccttcgtcttccccttgtctttcgaccttgtcgcggatggcatctcattcccaacacgtacaacggacgcgtcttgccttcagtcgggcccctgcacggaatatttccatggtactgctttatcacatttgtaagggatgggtgcaggcgtcttttctatgaagggttggaagccttgggacctctgagtggtagtgtccctggtgaaatggatcaccaaaggcttaggcttacttgggtttctatcacccgactgcatggatacctcccattcatccttctttgcgtgacagatttcaatatgccccctacttatcattccctgcagcagctcctcaactattgggcatgtttccacatcatgtga

SEQ ID NO: 31196 - DNA, 318 bp, Glycine max
  Peptide Sequence Number=SeqID_122881
atgacggcgacagcgacgaagtctatttccttgaagcctttgggaagagacgacaccgtgaggcgccatttggtggaggagattccgattgtggtgcctaggcacgccgtcaagcctctggcgacggtgacattggaaagcacggaccaaagaaaccgctccctcgacacccacattgtcctcgctcgaacccacaaatccccctacattgccggaaaacctacattgtcctcgcttgaacccacagaaccccctacactgttcgcgaagtctggctcaaagaaaacccaacatacattgttgctactagggtgctga

SEQ ID NO: 31197 - DNA, 738 bp, Glycine max
  Peptide Sequence Number=SeqID_122882
atgtataccggggcaggatttgcccggacacttgctggaatacgggtgcggatcatgcgcaccaacatgaccaccctgactcagatctggatgactttgctgctcagcaacatccagcccagcgatcataattccgacctccccctgccaaagtgtcagctggtgtacgccatcctgacacggatgagcattcacgtggctcagttaatcgctgatgccatctatctatttgcaggtatggcgcctaccaggcaccctctggacccggataagtccaacagggacctgggatttcccgctttgatcacaggactctgccagtcgtttggagtccccgtcgcacctaacaaagtgagacaggcccagggggatgcttcgcagggcgcagacacgccgccacctcatcaggctggcccagctggatcatttgatacggagcagtatttgcggcatttggttcgccagcaggcggccaaccaccgggcgcatgtacagacccataattgtctttaccagttgagcctcagcctacagagccagggttttacttcttttccgtgccctactccgaaccagtttagggcagaggtcgcatggcctggagattggcctgagacccgggcaggagaggcgccagcagaggcaccagcagaggctcccgacgaggcagatgaggcccgcgaggacgaggagatgaccgatttacttgatttcttaggagggagcggggccacatga

SEQ ID NO: 31198 - DNA, 483 bp, Glycine max
  misc_feature (356)..(356): n is a, c, g, or t
  Peptide Sequence Number=SeqID_122883
atggataacgaagagggagtgcaagaacagatgaaggtcgacctatcggccttaaaagatcaaatggcttccatcacggaggccacttccaatacagctaaggaagcggaatcggtgctacagcccgcaataaacttgggccgagacagaaacacgatgagtttcaatcggaggtatagtcctcaagcctacccttatggtttgcctccggacttcactccccacactgctccagacgatttgagccaagcccctaccttcgagggacagctccctcctcatgctgactatcctctgcaagaagatgatgaaggagatgcccatttaggccctctacttcccctcaaggaaccagncccccatgagttgccccaaacaaacatagtctgccacgtcctgtctccatcagcacccgttaaggaacttgttccctttgcaaaagaccagggaaagattgatctacttgaagagaggctgagagcg

SEQ ID NO: 31199 - DNA, 417 bp, Glycine max
  Peptide Sequence Number=SeqID_122884
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcctctgagaacttcctcataatttcaacggatttatctgaagtcgggaaacctgtcgtgccagctgcattaatgaatcggccaacgcgcggggagaggcggtttgcgtattgggcgctcttccgcttcctcgctcactga

SEQ ID NO: 31200 - DNA, 1186 bp, Glycine max
  Peptide Sequence Number=SeqID_122885
atggctacctcaccaaaagaaacttcagctcctggttcaccctctgcaccatcaaaccaggaacgacctgaattcaatatccagcccatacaggtgattcctggtcaagcccctgttcctgagaaactggttcccaaaagacaacagggagtgaagatttctgaaaaccctagccctgcaacaagtcctagggaagtagacccggagatggataagaagatccgcagtattatgttccaacatcctccaccccgaatgtttctgtgcctgatgttgataaagatgttccaacatcctccgctccaaatgctgaagccctcccttcacccagtgaagaggaatcaacagaagaagaagatcaagccacagagaagacccctgcaccaagggcaccagaacctgctccaggtgacctcattgaccttgaagagaaaggttacaaagcagaaaagggaagacccccatcaagaggtctggacgaatcaaaactattgcccagaagaagagcactccaatcactcctaccacattcagaaggagcaaggttgcaatcccctccaagaagaggaaagaatttcctcatccgattctgatgatgatgtcgaactagatgtctcgacatctaagagggccaagaaatctgggagaaaggtgcctggaaatgttcgtgatgcaccattggacaacatctctttccactccattggcaatgttgaaaagtggaaatatgtgtatcaacgcagacttgcggttgaaagagaactgggaagagatgccttggattgcaaggagaccatggacctcattaaggctgctggactactgaagacagtcaccaaattgggagactgttatgaaggcctagtcagggaattcattgtcaacattccctctgacataacaaacagaaagagtgatgagtatcaaaaagtatttgtcagaggaaagtgtgttagattctcccctgctgtgatcaacaaatatctgggcagaccaacagatggagtggtggatattgctgtttctgagcatcaaattgccaaggaaatcactgccaaacaagtccagcattggccaaagaaagggaagctgtctgcagggaagctaagtgtgaagtatgcaatcctgcacaggattggcgctgcaaactgggtacccaccaatcatacttccactgttgccacag

SEQ ID NO: 31201 - DNA, 519 bp, Glycine max
  Peptide Sequence Number=SeqID_122886
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaaccccg

SEQ ID NO: 31202 - DNA, 180 bp, Glycine max
  Peptide Sequence Number=SeqID_122887
atgagaaagcgccacgcttcccgaagggagaaagggcggacaggggggcggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 31203 - DNA, 270 bp, Glycine max
  Peptide Sequence Number=SeqID_122888
atggcttctccacctgcctcccctcctcctcctcctcctcctccttctcatcctcttcctccttctgctccttcggacgcatcggcttcgccgtctgccgtgaagcggacacgcaaagcctcacgtggacgccacctacgagaactggaaggaggtccctactgcttagaaggacctaatttgggaggatattcaggatgtgcgcaaaaaggcacaggtcatccagaagcagaacactgccccccacgtgctgtctcgtgggggttatga

SEQ ID NO: 31204 - DNA, 324 bp, Glycine max
  Peptide Sequence Number=SeqID_122889
atggctacttcattggtacatccagaggaaccagcacgcacgcttcagcgcactatggagtggatattacctacacctactccatatcgactagtggagccagtccaagtgatagaggtgacgtcatctgaagaagaccttgaggaggacccagaggagctacctcctgagcctgctgtggatgctcttgactttccagagggtgatgaggacccactccctgatgtggattctccagaggacgtcatgtcagcatctgaggcagactctatggaggagagcggccctggagggatagcgactagtggagactcttcatcatag

SEQ ID NO: 31205 - DNA, 373 bp, Glycine max
  Peptide Sequence Number=SeqID_122890
gaatccattgatgaagaagatcctaggcctacaagctccaatggagcttgcatcaaaatccttttcaagggggagggaatgatgcaatcctaccttgcaagggcattggatagaagactccaagaagattgggccagagatgcaagagaaggccttagggttctcatgagccttagggctgttgcttctggaggaagcaaccttgctcgcctgggcgagctgggtggcaagctcctcccctattttgctataaatagggggaggagtgaagaagaaaagggttcagccttcttggcacttctctctctcgaaattgttgaggaaaattatttccgtgaagaaaatccaagccgaggcgcttcctcttcaacgg

SEQ ID NO: 31206 - DNA, 144 bp, Glycine max
  Peptide Sequence Number=SeqID_122891
atgtggaccaccacgggggaggagcttgccacccagctcgcccaggcgagcaaggtcgcttcctccagaagcaacagctttctggaggaaggattggaaggcccaagtgggccaaattgctatttgtaccccctttattactaa

SEQ ID NO: 31207 - DNA, 114 bp, Glycine max
  Peptide Sequence Number=SeqID_122892
atgggggtgacaatagcacccaggcccacttgggccctccagaatattcctccagaagagggaggagtgaaggagaaaggggttaagcccttctggtatttcaagatcacttaa

SEQ ID NO: 31208 - DNA, 579 bp, Glycine max
  Peptide Sequence Number=SeqID_122893
gcgggcatatgggtaccgaagagatcgacaccattattccggtccttgaagaaatgcgcgcaaaagggatgcacttaagcgggccgctgcctgctgatacccttttccagccgaaatacctggataatgccgacgccgtgctcgcgatgtaccacgatcaaggcctgcccgtgctaaaataccagggctttggccgcggggtgaatatcactctcggtttaccctttattcgaacgtccgttgaccacggtactgcgctggatctggcaggccaggggaaagcggatggccacttagcccgtaaacgtttcgggcaaaacttccttaacgatcagttcgtgatcgaaagcattgtctcggctattaacccgcaaaaaggtcaggcgatggtcgaaatcggcccgggccttgccgcgctgaccgagccggtcggcgaacgccttgacgcactgaccgtcatcgaactggaccgcgatctggccgcacgcctgcaaacgcacccgttccttgggccgaagctgaccatttatcagcaggatgccatgaccatgaactttggtgagctgtcagagaaaatgg

SEQ ID NO: 31209 - DNA, 120 bp, Glycine max
  Peptide Sequence Number=SeqID_122894
atgaaaattctaagttcgggagttgtatttacgcttgagaaaggtcgacaaaagcggggcttttgctcctacgtaccctcctttggagaggaatcaatctacgtatctcggatcctctag

SEQ ID NO: 31210 - DNA, 690 bp, Glycine max
  Peptide Sequence Number=SeqID_122895
atgcatagatctcccacaggcgatttacttcctctggacttagaaattgaggctacattgcgaaggaacagagccgagaggagaaggaaacttctgcaagacagaacagttgcatccattcttgaggaggagactcatttctctgacttattatcacctgattcaccatcatcaagggaatccgccactcaattacctgaagttattaccatggtagaagaacatgaccagaggattacccttgaggattactcaagtagtttagtaccacaatttttcaccagcattgcatgtcctgaagggcaagctaacaacatcaactacccacattccttaattcatttaatacaagggaacttatttcaaggattacctaatgaagacccctatgcacacttggcaacgttcattgaaatatgcaacactgttaagattgtcggtgtaccagacaaagccatgaggctcagccttttctcattcctcattggcaggagaagccaagaggtggcttcactcattcaaagcattgaagaggttcagaggcttgttgagaagaactcccactcatgggttttccgagccaatccaattgaatatgtttatagatgggctgagaccacaaaccaagcaactgctagatggttctgcagggggaaagataaaactgaagaccccggaagaagcaactga

SEQ ID NO: 31211 - DNA, 537 bp, Glycine max
  Peptide Sequence Number=SeqID_122896
atgcagcctgatattcggcagaggcatcagcaggaaggccataaacaccaggttgagaagaggatggaaattcagatagcctgcccacagcagaccaaacttcaccagaaagtagaagttccagccggaaaggccgcgccatgttccggctggtttaacgtggcgaggttttataaacaacactctggccgtatcacggatacgacgtatggaatggcgtgcgtagtagccaagcgggaaaaagatcagcgcacagactataaccagttgaatgatatcgctgatattcatagtgcgttctccgcgttgtctgttaataagcgaagaggctccggcacccgtcgccagacatgtccatcatgtctggcattgaggatcggtttcgcatcgctcgtgatagcgagcggtttagcccattgttctggctggagcgcacgcatctgcaccagttccgcgctgatggcattatcttcgaaccaaatcatacggttcgagaagatatcaccggtcggcagggggaagatgtggttaagcgca

SEQ ID NO: 31212 - DNA, 684 bp, Glycine max
  Peptide Sequence Number=SeqID_122897
atgaaacctatgcaacctcaacaaaagttgcggatgaccatgtcaaactgggcacatagcaattccatgataggtcttaagttgctatgtgtcaactcacgaggtgttagggctttcacaacagaggctcacgaggtggtagtttggtttggaaaatctagttgctcatatgaaacctatacaacctcaacaaaagttgaggatgaaggatcggtttccaaggccagggaaaatttaaacaagcatgttcaagtggcaaacaaacattcatatggccaaattcatagggatagatatcatcatccctccaattttgtcatgagaagctacaaagacaagacaggtgaggatggaagtaaccagcacagaagatcattctcagtcggcatcaaactactttcagggaacaagtcatcatcatcaacttcatctgtgtctggatcaacttcattttcattttcaaacaaatcatatggatgccaagtgcgacagctattgaaaaggtgcaacaatgcaaattcagagatagaaaatacaatccagggagcaattgcacactgcaaaaagtgtcagcaaatgttttcttcaaagaagactacaagtgaagtaggaatctactcaatgtctgcatctagaacctcagtttgtgagcatcatgagagagtagagctttggaggggttga

SEQ ID NO: 31213 - DNA, 396 bp, Glycine max
  Peptide Sequence Number=SeqID_122898
atgggtgaagtagaaaaggtgcaagagcagatgaaggccgacatggaggccatgaaagagcaaatggccacaataatggaggccatgatgagcatgaaaaagataatggaagccaatgcggttgcagttgccgctatcagcgctgttgctaaggtgaacccgacgcccccatttggcctcaaccaaatgaatcatccaacttcagatatggtaggcaaagatttgggaagtacgggcggcccccattatgtgcaaattcaaaacaagcacgcctttccgccatatgacttgcctcccaactatacaccacccaatgtggcgtacactcccagtgagaatgtgatcgaggccgtacccgaatcaaataaacatgaaaatccagtaattaggaagtga

SEQ ID NO: 31214 - DNA, 564 bp, Glycine max
  Peptide Sequence Number=SeqID_122899
atggcttcccgaaagagaaaggcacctgccttagcatcccaggcccgctatgaccgctctagattcacatctcaagaggcctgggatcactactctgatatagtgattggcagaaagatcctgcctgagagaaatgtcatgatttaccacacagaatttgatgaattcaagtatgagcttgagagaaggaattggcacaaggatctgaccaatttcatggatgagagcattgatgttgccattgttaaggagttctacgctaacctttatgatcctaaggataaatcacctaagcaggtgagggtgagaggccacttaattaagtttgatgaagatgccctcaacaccttcctaaagacaccagtgatcattgaggaggaggagagcctatctgcctattctaggaagaatttaaccactcttgctcagacctggagtgtcctttcactctccaacttggcacctacctctcatacatcagacatcacactggataaggccaggttcatctacggcatcatccaaaacatggacatgaacttgggatacctcatcttgagttaa

SEQ ID NO: 31215 - DNA, 956 bp, Glycine max
  Peptide Sequence Number=SeqID_122900
gtcctcgccttcaaggactacacgtcctcgccttcagagggctgcacgtcctcgccttcagagggctgcacgtcctcgccttcagagggctgcacgtccttgccttgagaaggctacacgtcctcgccttcagagggctacacgcccttgcctttacagggctacacgtcctcgcttttagagggctacacaccctcgccttgagaggaatgcatgtcctcgccttcagagggctacacgccctcgccttcaaagggctgcacaccctcgccttcaaaggactacatgtcctcgcctcaagagggctgcacgtcctcaccttcagagggctgcacatcctcgccttcagaggactaaacgtcctcgcctttaggggactgcacgtcttcgccttcagagggcttcatgtcctcgccttcagagggctacacatcctcgctttcagaggactacacatcctcgccttccgaggactgcatgccctcgccttcagtgggctacatgtccttgctttcagagggctccacatctgtgccttcagggaactcaagttcctgggccacccctctgatctcggaggagggccaactgtgcgagcacaaccagtggaggaggcagggatcgcgctcacaagacatccagtggatccgaagaagtccaacagggtcctagggtttccagctctgattatgggcctctgtcaattctacagagtgcccgtcgcccccagcaaggtcatcaggccccctattaacaggtctttcatcaagaagtaccgtgcccctaggcaggcgcaaggcgaggcaccacagcagcctagggacgaccagcagtgggcaatagacacaccgccaccacctccaaagtccacctcagctcatctacgaaggctggagtgttgcctacgacatgtggccgaccagcaggcgaccaagtccaaagccaaaggtaagtga

SEQ ID NO: 31216 - DNA, 404 bp, Glycine max
  Peptide Sequence Number=SeqID_122901
ggaattgctcttaaagcatcatcttcaatccaagaggaaagtgacatagaagattcagttgacttagatgaagatgaagatcttagcctctttgtcaaaagattcaacaaatttattagaattagaggaaatcaaagaagacaaaatttcaaacctaaaagaaggactgaagagtcatttcaagtcccaaagtgctttgagtgcaatcaacccggacatctgagggttgattgtccaatctttaagaaaaagatagagaagtctgaaaagaagactattggagataagaaggcaaagaaggcctatatcacatgggatgataacaacttagaatcgtctgatgattctgaaaaagaaatgattaatctatgtctaatgggcaaaaattatgaaacgacgaagag

SEQ ID NO: 31217 - DNA, 361 bp, Glycine max
  Peptide Sequence Number=SeqID_122902
cttgggaggattgatggggacccggtgttgagagaaacgaggatatgggctacgtgggagtacgtgagctcagttggaggtgggcaacaggggatgatgaggaagtgtagaagggtgaaacttcctgcttttgttgttgaccacagagtggtacctggagatatgtcgcgggggtcaggagacccttggggacgtcaggcgagctcctggcagtcaacagataaaagggacaaagaccacaaagcaaggaggcttgtggtggctggccagctgcttaaaaatgaagacagcccggctaagatggtctctgcctgtgtaatcgattacacaaagggatgggtcactggtaatcgattaccag

SEQ ID NO: 31218 - DNA, 492 bp, Glycine max
  Peptide Sequence Number=SeqID_122903
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccttcgtctcttgccaggctcagcacacgactggcaccaagcccaaatccatttactcgcgctaagcgcaacggtggcactaagcgttacatcacgatttcagagcctatttaa

SEQ ID NO: 31219 - DNA, 960 bp, Glycine max
  Peptide Sequence Number=SeqID_122904
atggccccgaggaagcttgcctcaaagagatccaggaaggataaagcggctgaaggaaccagttccgctcccgaatatgacaaccaccgttttaggagcgctgagcaccagcagcgcttcgaggccatcaagggatggtcatttctccgggagcgacgtgtccagctcagggacgatgagtataccgacttccaggaggagatagttcgccggcggtgggcatcactggttacccccatggccaaattcgacccagacatagtcctcgagttttatgccaatgcttggcctacagaggagggcgtgcgagatatgcgatcctgggtgaggggtcagtggatcccgttcgccggtggtgggcatcactggttacccgagcttttattgagaagtattataggcagagataggcccagggggatgctttacaggccgcagacgtgccgccacctcatcaagctggcccagttggacaatttgatatggagcagtatttacggcatttggttcgccagcaggcggccaaccaccgggcgcatcctgcagagccagggttttacttcttttccgtgccctactccggatcagtttagggcagaggtcgcatggcctggagattggcctgaggcccggtcagcagaggcaccagcagaggctcccgacgaggcagatgaggcccacgaggacgaggagatgactgggactaacgtttgttatgtgttgattgacttttgttttgtacatacatatcatttgagtcgttacgttagtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggtttgggagttgtatttacgcacggggaaggtattag

SEQ ID NO: 31220 - DNA, 321 bp, Glycine max
  Peptide Sequence Number=SeqID_122905
atggcctccgtggagacctctgccatggttaggtcccagatcttacctgataatccccaaggtggtcatatctctcttgatggtttccagaggtatcatccccttcaacaacatattgcggcagtagggactaccagcaacaatatgttatcaaagaggaaaactctagatgagggttcactgttatcaagcaagtcagagacccagcatgaccacagattcacctccactccttatgttcccatggacctggatatagggccccccttttcaactcaccgtgtgtacaaaaaggtgttggtgtttgtgtgcatcaaatga

SEQ ID NO: 31221 - DNA, 189 bp, Glycine max
  Peptide Sequence Number=SeqID_122906
gccttgaatcttcttcatcaatggggtcctttgcttcttgaagatcaatggcagtggaatggagaaggagtaaaggtgattggagatgccatggataagagcttgaaggtaggagaagatgagtggagggaaaagagagaaggagcacgaaattttatgcctcaaatgaggtctgaacttgaagtgtaa

SEQ ID NO: 31222 - DNA, 222 bp, Glycine max
  Peptide Sequence Number=SeqID_122907
atggacattctcaccctaggtcaagtcgtttgtttccctcgtcgaaagactcaacatttgtcgatcaaggctaccaaagtttcccctgctatcccgagacaagtgaattcaatagcatgcggagaccatgacaacgatctattttgtcactttcaaggcaccaaggcttttgctgatgcacctgatgtcttttatgctccttcttttgacaggtttcgctga

SEQ ID NO: 31223 - DNA, 201 bp, Glycine max
  Peptide Sequence Number=SeqID_122908
atggctctgagaaagctttccgcaaagagatctaggaggggcgccgcggctgaagggaccagtgccgctcctgagtttgacagccatcgttttaggagcgctgagcaccagcagtgtttcgaggccatcaaaggatggtcgttccaccgagagagacacgtccagctcagggatgatgagtacacagattttcaggaatag

SEQ ID NO: 31224 - DNA, 96 bp, Glycine max
  Peptide Sequence Number=SeqID_122909
ggaccaccaccgaaacaacagcaaacggaagaagaaacaaagcaaacggaagaagaaacaaagcaaacggaagaagaaagaaagaaagcgcagtaa

SEQ ID NO: 31225 - DNA, 663 bp, Glycine max
  Peptide Sequence Number=SeqID_122910
atgggtcagccccagcgacaagcttttcacaaagcttacggtaagatctgggacctagccatggcagaggtctccacagaggccattgcctccctcgcccaatattatgaccagcctttgagatgcttcacctttggggacttccagttatcacccacggtggaagagtttgaagaaatcctgggatgccctctgggaggaaggaaaccatacctcttctcgggattctatccctctttagctagaatttctaagatagtccaaatctcgacgcaggaattagaccgcggaatgcaagtcgaaaatggggtggttggagtaccaaggaaatgtttagaagcaaaagcaagagtcttggaaggtaaaggcgaatgggccccgttcatggacatcctggcacttttgatcttcgggggggtcctctttccaaatgtagatgggttggtggaccaagcagcgattgatgcttttctcgcctttcatgaccgcaaggaaagcccggttgtcgctatcttagccgatctatatgacgccttcgaccgaagatgtgaaaagaacagtgcaaggatcgtttgttgtactctggccctctacgtatggttggttttgcacctttttcgccaagaggtgagacatgcttgcccgctagaaggccaccgctga

SEQ ID NO: 31226 - DNA, 745 bp, Glycine max
  Peptide Sequence Number=SeqID_122911
ggctacacgccctcaccttcagagggctacacgccctcgcctttagagggctacacaccctcaccttcagaggactacacgtcctcgcctttagaggactacacgtcctcgcatttagaggactacacatcctcgccatcagagggttgcatgccctcgccttcagaggactacacgtcctcaccttcagagcactacacatcctcgccatcagagggctacatgccctcgcctttagaggactgcacgtcctcaccttcagaggactacatgtcctcaccttcaaagggctacacgccctcgcttttagagcgctacaccccctcgccgtcaaaggactacacgtcctcactgtcagaggactacacgtcctcgccttcagaggacttcatgtcctcgccgtcagagggctacacgcccacaccttcagagggctacacgccctcaccttcagagggctacacgccatcacctttagagggctacacgccctcaccttcagaggactacacgtcctcaccatcagaggactatacgtcctcaccttcataaggctgcacaccctcgcctttgtagggctacacgtcctcaccttcagagggctgcacacgctcaccttcatagggctacacaccctcaccttcagaggactacacgtcctcgcctttagaggactacgcgtgctcaccttcagaggactacacgtccccgcctttagaggactacacgccctcgccaagagagg

SEQ ID NO: 31227 - DNA, 219 bp, Glycine max
  Peptide Sequence Number=SeqID_122912
atggagaagaagacagaaagaaggacaagacaacgcgaaggagatgaaacatacctaggcatggtggcgaaggagaagaagcagagacttgtgacgatgctcgagtgcgacgaacacgatgctcagatgcacacagggacggttaacatcggttttctggagaaaactgatgttaacataacaaacgttaacatcggttttctaaaaacccgatgttaa

SEQ ID NO: 31228 - DNA, 351 bp, Glycine max
  Peptide Sequence Number=SeqID_122913
atggggttgaatcaatttagatttttcaacatggttcatgacatcttggtcaaggtgaaactggaagtaacaaggacatcaacggtcctaaatgtgcttggcagtagacgaagcagtgataggaaaatgcaagggtcatgcatgagcgaacatgaaaacaaaagcccggaaaatgatctcttcttagttgcgcatttgggggcacagtgccccatgtgtacagttaagaaggtgatatggaccttccagcttcccgtgacaaaggaagagaccaacatacaatgcatgctagagataaaatatgggagtgatttgatccgcactgacttttggagtaaaaacatgggataa

SEQ ID NO: 31229 - DNA, 486 bp, Glycine max
  Peptide Sequence Number=SeqID_122914
atgtcatctattgtttgcaaggatcacgcccacaagacacccagtggacccgaagaagtccaacagggtcctagggttccagctctgattatgggcctctgtcagtcctacagggtgtctgtccccccagcagggtcatgccatcatgacatagggattgcgcccgcaagatacccaatggacccagagaagtccaacagggtcctggggtttccagctctgattatgggcctttttcagttctacggagtgcctatcgcccctagcaaggtcatcaggcctcctactaaccgagctttcatcaagaagtactgcacccctaggcaagcgcagggcgagacaccacagcagccaggggatggccggcagtgggcaacagacataccgccgccaccttcagagcctctcagctcatctacaaaggctggagcgttgcctacgacccatggccgactagcaggcgaccaagtccaaagccaaaggtaa

SEQ ID NO: 31230 - DNA, 360 bp, Glycine max
  Peptide Sequence Number=SeqID_122915
atggaaagggagatgataacaatgatagtagacacgttaccggtgttctactatgagaaaatgcctggggaaaatggagagaatgagaaggaggaaggaacccatgttgtgactgtcattcctacatggccaaatttcccactaactcaacaatgtcattactcagccaatatcatccaatctcattacccaccacccattcatccacaaaggccatccctaaatcaaccacaaagcttgcctaccgcacacccaatgccaaacaccacccttaacacaaaccaagacaccaaccagggagggagttttccagtgaaaaaagcctatagaattcaccccaattctggtgtcctacactaa

SEQ ID NO: 31231 - DNA, 267 bp, Glycine max
  Peptide Sequence Number=SeqID_122916
atggcttacacccacattccggattcaacaagcgattctcctcaaatttcagccagcccatatcaattagacttcacattttatgcttcggggtcatacaatgctcaatggaatgccccagggctcctccacgataagcacacgttgcgttcgagtcgtatcctcagaaaaatggaggttgatgaaccttggctagggttatggctaccattgaattatcaagtagatatgaaagcaagtcagcataggacactggaattggggtga

SEQ ID NO: 31232 - DNA, 423 bp, Glycine max
  Peptide Sequence Number=SeqID_122917
atggtttctagaggtatcttccccttcgaaaaacatattgcggccgtagggactaccaacaacaatatgttatcaaagagaaaaactctagatgagggttcactgttatcaagcaagtcggagacccaacatgaccatagattcacctccactccttatgttcccatggacccgggtatagggccccttttcaactcacttcccttatggagtcgccaactgtcgaaacctacccttcggcgggaaggcgacgcgatggctcacgagtgcgtcatccaagggaggaaggctcgcggagtcgccaccaatgtttattcgaggtgtggtctacgaactttattcatgaaaggttcgggagttgtttttacgcatggggaaggtattagtaccccacacgtccgtcacaagggacgacagccttaa

SEQ ID NO: 31233 - DNA, 726 bp, Glycine max
  Peptide Sequence Number=SeqID_122918
gactccttagaagaacaggttatgcaaggttcctttgtaccccatggtcgacaagacatactgaacactgccattgggcgacctgaccatgggggtcgcgttcgtgcagcgggctcaggtgtcactattactcagtactacagaagggcatcaaggacatgcaacaactcatccacatccatcagccaacaacaattagatgaagttgttgcaaggcttagggaagacatgactggtcagattagggaagaattgaggactcaaattaaggaagaattgaggactcaactagaagaggaaaataaaaggagcttggaaataatgaccatggcattgaaagaggctattaaaaaggagttgtctcataaaggatccccagagtcactcctaattcagccggacatacaacaattaggtgcacgtgtcaacactaagggaagtaatgttgttatcaacgtccagccatcacgggaacatggtggtgatgtcataccaatgatgggactgtatgtgcagcgtaaggctggtacactagggttggtggccatggggaaaataatggagggggattcagtcatacacacaatggcttatgcaaatgatgttgtcagggtaagtgtagaaacagttattgatcctgaggctgaggtcccctatgccacgtcagaaatacaatatgtgaagcaggccgtcgatacatttgtagcttgcccacacaccttgtga

SEQ ID NO: 31234 - DNA, 312 bp, Glycine max
  Peptide Sequence Number=SeqID_122919
atgcaacagggacaggcagatatcctcatagctaggttccctgaccctacctatggtgttaaaacgctaccccgcggattcctcgtcgcgtcacttgaagattcctttttgtccttgctcgtcgattccacacaagcctctaccatgccaaaacgaaggagacttagtatggaattcagaaaacaagctagtaacagtgctctgggtcaaacacccacatcactatatgaaagagctgagagcatttcgggttttacaaaggaacgtcatttggaattccgaccacgccaatgtgaccggggttcagtgtag

SEQ ID NO: 31235 - DNA, 318 bp, Glycine max
  Peptide Sequence Number=SeqID_122920
cgcccaatacgcaaaccgcctctccccgcgcgttggccgattcattaatgcagctggcacgacaggtttcccgactggaaagcgggcagtgagcgcaacgcaattaatgcatgcaagcttggcactggccgtcgttttacaacgtcgtgactgggaaaaccctggcgttacccaacttaatcgccttgcagcacatccccctttcgccagctggcgtaatagcgaagaggcccgcaaccgatcgcccttcccaacagttgcgcagcctgaatggcgaatggcgcctgatgcggtatttactccttacgcatctgtgcg

SEQ ID NO: 31236 - DNA, 210 bp, Glycine max
  Peptide Sequence Number=SeqID_122921
atgacatgcggagacaaattatggtcattccgcacaccttttgccattcagacacagtcgtgtccgatggcacgcatagacaaattatggtcattctgcgcctgtgtcaaccaagaggaacgaattcggcagtatcaggatgatgttggtcgttcggtgctgatcattttcaaaatttttgcaggttccgctggcggggagattgactga

SEQ ID NO: 31237 - DNA, 79 bp, Glycine max
  Peptide Sequence Number=SeqID_122922
atggctacaccaatgagtattgcttgctatttggataacgatgaaactggtcagtcaatagacgttaagcaatatcgag

SEQ ID NO: 31238 - DNA, 954 bp, Glycine max
  Peptide Sequence Number=SeqID_122923
atgaggggagcaccgacggaagaaagcatgtctcctttccttgtgagggatttcggcgcacaaaatttcaaggctatacaagcagtccataaggcatgggaaaccccgttaaggaaagatcaagaacttaggggcattcgtaatggcatcattggtgggtaccatgaatggctgaaagttcatatacgaggtttagattggctcgccaagttaaaaatcgtcagcgaagagagttttgaagcaccggaagaggacgaagaagtccaagctctcaaaagcgagttaggaaaggcgaaacttgccaaggagaagttcaagttggccgctacagacatccagaaggagtatgccggattacgggaagagaatgcaaccaccgcacaagcccttgaacaagagaccaagagggctcgcaaggaagagtatggccggaacaaatttcgcagagctctgtggggtcccaaaagaagcttgtctcagcgtttatgcgagacggagaccaacacgctagctatcatcgccaagtaccaagaagagttaggtctagccacggcccacgagcataggatcgcggacgagtatgcccaagtatacacggaaaaagaggctagaggaagggtgatcgactctttacaccaagaggcaaccatgtggatggatcggtttgctcttaccttgaacgggagtcaggaacttccccgattgttagccaaggccaaggcgatggcagacacctactccgcccccgaagaaattcatgggcttctcggctattggaaaaacaccataactaaacgcgccacaaggcatccttatcgcaccagatccaaatatagaacgatgggtgatcaagaggagacacaggaacagatgaaagccgacatgtcggctctgaaagaacagatggcctccatgatggaggccatgttaggaatgaggcaggggatcctctag

SEQ ID NO: 31239 - DNA, 634 bp, Glycine max
  Peptide Sequence Number=SeqID_122924
gttgccgtcccttgggacggacgtgtggggtgttaataccttccctgtgcgtaaatacaactcccgaacctttcacttaaaagttcgtagatcgcgtcttttccggttttttcgacgttttcctcaaataaacgttggtggcgacttcgcgcgtattcctttcgtggaaaacgcatcccgcgagtctcgcgtcgccctcccgccgaaaggttgcgacagttacgagcccgaaatgggtttaggcaaggacaacggcggcataactagcctgataagcgccaaaggaaatcatgggaagtttgggcaagaagatgaaggaagatcgccctgccatataagtaggagctttataagcgcgggtctaggggatgaaggccaagtcgttgcaatgtgcaaagatgatgccctgagtgggtcggatttggtacgaccatgccctcccgatttccgactaggaaattggcgagtggaggagcgcccgggcatttacgtgacaagcataatatccaacgacgagtccctcgaaggtactaatacctgggagacccgcccaccgacttcgagcaagaaacgagtcaaacagaagatgaagagaacgaggatgtgggacttccccaagagttggaatggatag

SEQ ID NO: 31240 - DNA, 51 bp, Glycine max
  Peptide Sequence Number=SeqID_122925
atgaaaggaagggcagaaagaacactggacaaggaagaggatgaagagcac

SEQ ID NO: 31241 - DNA, 1299 bp, Glycine max
  Peptide Sequence Number=SeqID_122926
atgggatcaagtcaaatgccttcacttaaaaagaggttctatcaagtcaaggtcaagagcctagggaccaccagtctaaaagagttagggcagttaatgggtcagctccagcggcaagcttttcgcaaagcttacggtaaaatctgggacttagccatggtagaagtctccacagaggccattgcctccctcgcccaatattatgatcagccgttgaggtgcttcaccttttgggacttccagctatcacctatggtagaagaatttgaagagatcccaggatgccctctagggggaaggaaaccatacctcttctcaggattctatccctcattagctagaatttccaagatagtccaaatctcggcgcaggaattagaccacaggaagcaagtcgaaaatggggtggttggaataccgagaaaatatttggaggcaaaatcaagaatattggcaagtaaaggcgagtgggccccattcatagatattctcgcactattgatcttcggaggagtcctcttttcgaatgtggaagggttggtggacctagcagcgatcgacgcttttctcgcctatcataaccacaaggaaaacccggttgtcgctatgctagccgacctatatgacaccttcgaccgaagatgtgaaaagagcaatacaaggattgtttgctatactccagctctttatgtatggttagtttcacaccttttttgccaagaggtgaggcatgcttgcctgctagaaagccaccgttcatgcacagagaaaggaggggcaaattgggaccaactcttagcgagcaaagaaagagcatctgtcaactggttccctcgatggaaggaaggaagaactggagttcttatttcatgtggaggatttccaaatgttcccttgatggggacgagaggttgcatcagctacaatctcgttcttgctataagacaacttggctaccctatgagaggggcaccaccaggggatgagctcacgcctgtcatttcacgaggtttcaataagaccaacgtggagacacttcagaaggtccgcaaggcatgggaggtgttgcaagagaaggacaaggaacacaggggaagtaacaatggacccatcggtggctaccgtaagtggttgaaagcccacatgcaaggtttggattggctcccgagtttgagaaccgctaaaagggaggaagtcgaggcaccggaggaagacgaagaggtgcaggcccttagggcagaacacgagcaagcccaaactgtcaaagaaaggttcaaaacagcagctctaaaaatctga

SEQ ID NO: 31242 - DNA, 1438 bp, Glycine max
  Peptide Sequence Number=SeqID_122927
atgggtgccaagtacctcgaagtggtcaaacgagggtcgcatcccaacaacggatggtccccggatgaaattaggggtgcatatgaccacattggtctctgcgtgtcgttggacttggggtctcggaataacgaagctacggataaccgtaaggtgtctccgtatgccactggacactcggatgaccacaatggtctctgcgtgtcgttggagttggggtctcggaatgaagaagctacggataactgtaagatgtctccgtatgccactggacactcgggtgagactaaattgtctcgaccgaaaaaggctgacataaggtgtctctgccaccggactcttgggtcgctggatagcaaaaaggtgcggataactgtaaggtgtctccgtatgccaccggactcttggggtgcagatgaccacattggtctctgtgtgtcatcggacttggagtctcggaatgacaaagctacggataaccgtaaggtgtctccgaaaggtgcagataaccatattggtctctacgtgtcatcggacttggggtctccgaatgacgagttgcggataaccataaggaagagtgcagatgaccacattggtctctacgcgtcattggactcggggcctccgaatgagaaggtgcttataacctctcggccgaaagacgctgacatctcccggaaaggtgcagatgaccacattggtctctgcgtgtcatcggacttggggtctccgaataacgagtcggaagacgctcacagctccaggaagagtgcagattaccacattggtctctacgtgtcattggacttggggtgtccgaatgatgaggtgctaataaccgtaagacttgggatctccgaattttgtggtgcggataaccgtaaggtgtctatgcatgcatccgaactcttgggttaccggatagcaaaaggacgagatgcagatagctgtaaggtgtctctgtatgccaccagactcttgggccgctggatagcaaatggtgagactaaatggtttcgggcaaaagacgctgacgtcttcgagaagggtgcagatgaccacattggtctctgcacgtcgtcggacttggggtctcggaatgacaaagctacgtataacaataaccatattggtctctacgtgtcatcggacttggggtctccaaataacgtgtctcaaccggaagacgctgacatcttcggaaagggtgcagatgaccacattggtctctacgtgtcattggacttgggctgtccgaatgacgaggctgcggatgaccacattggcctctctgtgtcatcagacttggggtctccgaatgacgaggtgagacgaaaatattctcgaccggaagctatcgacatctccagaaagcgtgcagatgaccacattggtctctgcgtgtcatcggactctgggtctccgaatgatgaag

SEQ ID NO: 31243 - DNA, 213 bp, Glycine max
  Peptide Sequence Number=SeqID_122928
atgttggtggcgactctgcgcgtattcctttcgtggaacacgcatcccgcgagtcacgcgtcgccctcccgccaaagggggcatacagtgctcaatggaatgccccagggctcctccatgatatgcacatgttgcgttcaagccgtatcctcggaaaaatggaggttgaggaaacctagcagggattatggctaccatttaattatcgagtag

SEQ ID NO: 31244 - DNA, 234 bp, Glycine max
  Peptide Sequence Number=SeqID_122929
atgccaccgctgatggtgattgagcgtaaaatgtttccacatcacccaggtgggcgtggtgctgctgaccctgacgctctgcacgggctggcgcggtcgtccgcgtggtctggttcaacgtcgcgggtgcgggcattctcacccttgcctattttggcagccgcttcatacagcaatttgctggctaagaaacaaaggagttccccctggaacacatctctaccaccacgctga

SEQ ID NO: 31245 - DNA, 243 bp, Glycine max
  Peptide Sequence Number=SeqID_122930
atgacttcctatggtagtgagcttcttcttgactcatcttctccttcaagtggcatcttcaatcatctttcttctttctccattccactgtcattcatcttcaagaagcaaaggactccattgatgaagaagatccaaggcctacaagctccacatggagctacatcagttactacacggtctttttggttatgcctgaattgcttacaacatgatagaataggattttctagtttgggctaa

SEQ ID NO: 31246 - DNA, 624 bp, Glycine max
  Peptide Sequence Number=SeqID_122931
atggaggataccaatgagttgttgcacctcttggtggatgctatgaataggggattgcgtgatgtcaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcagtctccatcaccaaaccaaccaagtccaccatcccacccccctttagattcagaggttcccatagaaaaacaaaaactgtcacaagcgaaggagatccga

SEQ ID NO: 31247 - DNA, 129 bp, Glycine max
  Peptide Sequence Number=SeqID_122932
atgacccgtggccgaccagcaggcggccaagtccgaagccaaagtcatagcaggacacacctagttgctcatgatcctaggtatttgaataaaacaagcacaagctcggaaggtagcaagataccttga

SEQ ID NO: 31248 - DNA, 101 bp, Glycine max
  Peptide Sequence Number=SeqID_122933
atggatgcaagggattcatcattcacgaacaggagattcatgcaaaaaccggtacccaatgctggtcgttctctcacagttaaggttcacacactcaccgg

SEQ ID NO: 31249 - DNA, 245 bp, Glycine max
  Peptide Sequence Number=SeqID_122934
tgggctaactatgcatccaccgctaagcgcagcttcagtgtgcttagcgcgatagaagaatctggtagggcattagcatcaaggctcaacgcacgactggcgctaagcccgaatccacttactcgcgctaagcacgagggtggtgctaagaacaacgtcgcgaatttagaagcacaccatagtgcctatttcgggaaaagagctctggaggcagcaagagaagcaacttttgcagagatacctag

SEQ ID NO: 31250 - DNA, 231 bp, Glycine max
  Peptide Sequence Number=SeqID_122935
atggagacgatgcaaaagaccttacatggcatgcaaatgggagaaactgcgatggaatgctccgtcattcggctgattcctcccgctccaggaaatgatatcaatgtttatcttagtccgttgattgaagacttgacaaatttgtgggatgagggggtttcaatgtttgatgggtttcaaaatgatgatgttgtctatgatgatatcgggcccaagatagccaggaaatga

SEQ ID NO: 31251 - DNA, 513 bp, Glycine max
  Peptide Sequence Number=SeqID_122936
atgtttggaagcaaaggcgagagtctttgggcaactcaaggcgaatgggcccccgttcatggacatccttggcactttttgatcttcggggtggtcctctttcccaatgtggatgggttggtggatcgggcagcgattgatgcttttctcgccttttatgaccgcaaagacagcccggttgccgctatcttagccgatctatatgacacattcgaccaaagatatgagaagaacaatgcaaggatcgtttgctcaaacaaagaaggagtgtctgtcaattggttcccccgatggaaagaaggaagaaccgggattcttatttcgtgtgggaaatttccaaatgtttccttgatggggacgaagggttgcatcaattacaatcccgtcctcgctataagacaacttggttaccctatgagaggggcgccatcagaggaaggcctcataccttttattacacgaggtttcaatagaaccaatgcgggggtgcttcagagggtccacaaggcatag

SEQ ID NO: 31252 - DNA, 445 bp, Glycine max
  Peptide Sequence Number=SeqID_122937
ttcacaacatccctttgttgcatgaccaagtcaatgttggtgttgaggaggttaaagatgcagaggctctcgttcctatacccactcacgaggttaccttagtgggacagacacctaacaccttccttgcttggccaacacatcttatgaagcgtttatcagaacaagcaattgtgtctccagcaaaacctccagaaagcccgaatgaagaggtcgatgatcccctgtacctgatgacattgaccatcccacaactgtttttgaagcctctccaggttatgtgggatgctaccatattcgggccacagtccattcagagatctgggcaatcacaatttgaatctgaaagttacatcaagagttggatacagagttcagaacgagatgtttaccttggagcctacctgaatgggctagacaactaccttaagggaataattaacag

SEQ ID NO: 31253 - DNA, 181 bp, Glycine max
  Peptide Sequence Number=SeqID_122938
atgactgatcctcttttgactaatccacctgcctccacaccttctccttcggacgcatcggcttcgccgtctgccgtgaagcggacacgcaaagcctcacgtctacgatcgttgtccactagaccacctggtgttgagagactagtggtgcatgttgatcctgttaccgggaaggccgacg

SEQ ID NO: 31254 - DNA, 558 bp, Glycine max
  Peptide Sequence Number=SeqID_122939
gactacacttctcgccatcagagggctacatgccctcgcctttagagggctacatgccctctcagaggactacatgactacaggtcctcgccttcaaagggctacactctctcaccttcagagggctacagtcctcgccttcagaggactacacgtcctcgcctttcagagggctacacaccctcaccttcagaggactacacgtcctcaccattcaaagggctcacactctctcgccatcagaggactacatgtcctcgccatcagagggctacacgccctcgccttcagagggctacacgccctcaccttcagaggactacacttccttgccataagagggctgtacgccctcaccatcaaagggctgcacgccctcgccttcaaagagctacacgccctcaccttcagaggacttcaagtcctcacctttagagggctgcacgcccttgcctttagaggactacacatcctctctttgagcgggcttcacgccctcgcctttagaggactacatgtcctcaccttcagagggctgcacgtcctcgcctgcagagg

SEQ ID NO: 31255 - DNA, 405 bp, Glycine max
  Peptide Sequence Number=SeqID_122940
atgtggttccctggcagttttcccttcaccagttatcccaaattcgtgaatattaaccagtgcacgcttcgtgttcgattaattgcctctgagcctcctaggaggaaacaacttgtttttaatattagggtacggcctcgatcaaacttcaacaatggacgaaaatcacaagaagattctcaagtccttaggtgttacaaatgcaaccaaattggtcacatcaaggccaattgtccttcaaatgaagattggactgagaaaagtgaaaagaaaaggtttgatgaaagaaggaccaagaaagcctacattgcttgggatgacaatgactcatccgatggttcagaaaaggagattaatcttctaaccaaggattatgaaagtgatgagaacatctctcaagaatga

SEQ ID NO: 31256 - DNA, 273 bp, Glycine max
  Peptide Sequence Number=SeqID_122941
atggccaaaatacatcatcaagcatggccaacaaaaacatatcacccaacgaaacataccccccctcacacttattcccaaaacaattccaaagctccaaaattccttaagggtagggcttataagaacaaaatgcctagatcatctcccaacatgcatgtgaagcaagaagtatcaacaagagtaaagccaaggctattgtgcaagcaatcaatggggcaaaatacaccgaataaaatagatgatgatggctcaaattctcaccaagggtaa

SEQ ID NO: 31257 - DNA, 425 bp, Glycine max
  Peptide Sequence Number=SeqID_122942
agattcaacattcaatttcgagggtctcgatatattacgggactcaatcagacatccgagtaaaacgttattgtcgtttgaattggctcagaggttcaacattcaatttcgagcgtctcgatatgttacgggactcaatcagacatccgagtaaaaagctattgtcgtttgaattaggtcagagattcaacattcaatttcgagtctcgatatattacgggactcaatcagacatccgagtaaaaagttattgtcgtctgaattggctcagagcttcaacattcaatttcgagcgtctcgatatgttacgggactcaatcagacatccgagtaaaaagctattgtcttttgaatttgctcagagattcaacattcaatttcgagggtctcgatatcttacgggactcaatcagacatccgagtga

SEQ ID NO: 31258 - DNA, 327 bp, Glycine max
  Peptide Sequence Number=SeqID_122943
atgacattgaccatcccagagcttttcttgaggccttatcaggttacatgggatgccacggtgttcggggtctttaatccagatttctcgctctacataaagcacgaagacctctccaaaatcgcacacgatggtcaatgtctcagcatatcagtgttacagttgtggattcttatgcgagcggggaattttgatatctatggattcctcgagccacagtccattcagaggtctgggcaatcgcagtttgggtctgaaagttacataaagacttggatgcagagttcaaaacgcgatgtgtatcttagagcctaccttaatgggtaa

SEQ ID NO: 31259 - DNA, 457 bp, Glycine max
  misc_feature (421)..(421): n is a, c, g, or t
  Peptide Sequence Number=SeqID_122944
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttgatccattaggggccttcctttgtagtattccagggagggantgtcttgccaatgtgtttggtcattttgtacattga

SEQ ID NO: 31260 - DNA, 494 bp, Glycine max
  Peptide Sequence Number=SeqID_122945
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgtttcagcccgaccgctgcgcctttatccg

SEQ ID NO: 31261 - DNA, 240 bp, Glycine max
  Peptide Sequence Number=SeqID_122946
atgatgaatgtgttgagtgttgcaaccctcttttgtaaaatcagtcatgcaccccacatcttcatgattcatgtacatagggactcattaggtaggaataatcaacatgaaaatacagaaaaaggtgtcgagggaaggagcccagagtatgaagaacctcgggatttgaggtcaaatccttccaaggtggagaggatgatgcaatcctaccccccaagggtattggatagaagactctag

SEQ ID NO: 31262 - DNA, 699 bp, Glycine max
  Peptide Sequence Number=SeqID_122947
atgttgtatttcaacggaagagtatatgaagacaatgatggtgtaatatttgaaggcagtaaaaaggttattcagattaaacgcagaattagtttcaatgctttgaaaaaaaaattggagataagatttttagtttcaggaaaatatgttgcgttgcaaatttgtgatgacgaagatgttgaaagtatgatcaaaagttttcaacaacaacaacaaatgttagttctagaattatacgtagaaaatattgttggcggttctatgtttcatgctgcaaattctgttacgtcatgtggacataatgtacctcatcatgagtcggaactgccaagaaatataagcaatttacatgacgatgaagatgatgatgatgattatcttgcatctaactcatacgttgaagagtctttcgatgaagatgataatgtcgatggaatatctgatacagacgatgaagtcaccgacatcgttgaaccagtttcaattgttcacccaaccgaaggtgtaccagaaattaaaaatccattttggaatgatgctttgcattataataatatcaattggagtcattcggacgaggaggacatttgtggtttggacatgccaacgacttttaatgttggacaagaattatatgttggcatggattttgatagtaaagatgcagtcaaaaatgcactgaaacaatatgtgatgaag

SEQ ID NO: 31263 - DNA, 345 bp, Glycine max
  Peptide Sequence Number=SeqID_122948
atgagggttcactgtaatcaagcaagtcgaagacctagcatgaccacagattcacctccactccttatgttctcatggacccggaacataagaaaaaaagacaaagaaaaagaacaaaagggaagtcagagtaaagaaagcacactgattgattggcctaactctctaacaatagtccccagtggagtcgccaactgtctcaacctacccttcggcgggagggcgacgcgagggctcacaggtgcatcttccaagaaaggaaaatgcgcggagtcgccaccaacgtttattcaaggaaaacatcggaaaacccaggaaaagacgtggtctacgaactttaagtga

SEQ ID NO: 31264 - DNA, 216 bp, Glycine max
  Peptide Sequence Number=SeqID_122949
atgatgataacacaagatgatgacaaagttcaagataagaatcaagaagaattcaagactcaagaagaaagtctagagacaagaatcaagactcaaggttcaagatctcaagaatcaggaatcaagattcaaggttcaagatctcaagaatcaagatcaagattcaaggctcaagattcaagaatgaagagaagactcaatcaagataagtattaa

SEQ ID NO: 31265 - DNA, 672 bp, Glycine max
  Peptide Sequence Number=SeqID_122950
attggcttgccaagttaaaagtcgtcagcgaagagagttttgaggcaccgaaggaggacgaagaagtccaagctctcaaaagtgagttaggaaaggcgagacttgccaaggagaagttcaagttggccgctacacacatccggaaggaatgtgccggattacgggaagagaatgcaactaccgcgagagcccttgaacaagagaccaagagggctcgcaaggaagagtatggccggaataaatttcgcggagctctgtggggtagcaatagtgaactcaagctgcgaagggaagagagggaccagtcgcgagcacatagcatggtcttgaaagagaagttagttgcctgttcaaggtccaaaaggagcttgtctcagtgtttatgcgagacggagaccaacatgctagctatcatcgccaagtaccaagaagagttaggtctagccacggcccacgggcatagggtcgcgaacgagtatgcccaagtatacgcggaaaaagaggctagaggaagggtgattgactctttacaccaagaggcaaccatgtggatggatcggtttgctcttaccttgaacgggagtcaagaacttccccgattgttagccaaggccaagacgatggcggatacctactccgcccccgaagaaattcatgggcttctcgactatt

SEQ ID NO: 31266 - DNA, 582 bp, Glycine max
  Peptide Sequence Number=SeqID_122951
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctgcacctctgtggaaccaagtccgtcgctaccttctctctccaaaacggccataatggtggcacgtattatgctcaggaacgggaatgcctcgggaatgccgacgtggtcgatatcaagggaaatccatacaagtatggattagggaatgagcccgggatgccggggaggaggaacgtgccgtcaagattttgggcggatagggtatggcccgaccgtattagccagtgtttcaccagcgctgggatggtgtccgaggaggaggtggccgcaatagaagaggagttccctcaagacccaccaagttttgtgcagccatgccaccccgattcccaagtgggaaactggcgcgtgataagtcagtcagaagtctataccgttgattcaatgtaa

SEQ ID NO: 31267 - DNA, 303 bp, Glycine max
  Peptide Sequence Number=SeqID_122952
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatca

SEQ ID NO: 31268 - DNA, 1149 bp, Glycine max
  misc_feature (4)..(4): n is a, c, g, or t
  Peptide Sequence Number=SeqID_122953
atgnccaatcaaggagactgggtcccgtttatggatgtgttagctttgctaatttttggggtcgtcctctttccaaacgtggatgttttggtagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaaaaggagaatagattgggaccagctcttggccgggataggaggtagaacaatcagttggttcctccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgccgacgaatatgcccaagtatacgcggaaaaagaggctagaggaagg

SEQ ID NO: 31269 - DNA, 153 bp, Glycine max
  Peptide Sequence Number=SeqID_122954
atggaggttgaggaaacccagcagaggttatggctaccattgcagtatcaagcaaggatgacctttgtggataattgggtggtgggtaaggagaagggttgttattggctgagtaatgacattattgggttggtgggaaacttggctgtatag

SEQ ID NO: 31270 - DNA, 297 bp, Glycine max
  Peptide Sequence Number=SeqID_122955
gtcgactctagaggatcccctacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcaacggagaagaggcccacgaggatgaggagatggccgatttgcttgacttcttgggagggagtggagatac

SEQ ID NO: 31271 - DNA, 942 bp, Glycine max
  Peptide Sequence Number=SeqID_122956
atggcatattctccaaacaagataaaaaacatcgacgactcagaagaaactcttaaacttgctgtgaggatcagtgatctatggtttattgggacgcctaacaaatctgagcaagctgagatggtttttgtcgactccgattgtgttctagacgacctcccttttagaaaatacaggtttgctatatttgccgatgttgtggctgggcagtttgaacctgacctattggttgacgttatcggtgttgtggttgtctttcgccatgtttcaggaaaaggtagaaggtttttaaagttcttagatgatcatgaaggtcatgacccaattacagttctattgacccatggtagaataaaggaagctcagggatcttatccgccatcagtcagcaattctttcaaggcttcgaagttaattattaaccaaccggtgatggagattcaagaattcaatgaacggcttgtagagttgggcattgaggcccggtcagtttttaaatcccatagtcaaggcagttcacagctttcaggttctatccaattatcatcaaaggaatcattctttgaaaaggctgaggcaaagactattgctgatattaacaccatctctgaagatggtgatgttgatttaaatgcttcacccgaagcacttgataagctgttgggttatgtgcttgtttttaagataaaggtgcaacccaagttcaggaattctgtcgttttgaaatgttcaactgactcaagcttaattgatgctgtgatggacatgctacctgatgctgaggcatgtttcaaggaactccacaaattgtcaaagttcatacaatacctacacaaatgttatgaattcaagtatatggcgaaagacggaacaagtaagatttggaaatacaaatcacagattgctagacagaaaattcagaaaacatgttcttcacaatga

SEQ ID NO: 31272 - DNA, 288 bp, Glycine max
  Peptide Sequence Number=SeqID_122957
atggggccaactatgaaatttgagtcaggaaacacaaggacatgcaaaagaccacgtcacgcctcaaggaaacatatctggacctatcaaatcacccaatccatgctgggggcaccgtatccactggggattggtgataagtatgtcgttcaaccttggtataaattccttcaagaaagtgattttagccatggagacgaactgtcattctactataggcatgatgaaaaaatctgggaagttgttattagacacgaaatagattgggatgacggcgacatagattag

SEQ ID NO: 31273 - DNA, 249 bp, Glycine max
  Peptide Sequence Number=SeqID_122958
atgacatattatttttcatggtttacccacatggatcatgaggtatcttctcaaactgttaattttcctgatattcaatgtgatgttcccaaagtcaaaggagataactataagatatggaaggagagaattcttctgcaattgggatggatgaacatagactatgctataaggaaagacgaaccacctacaatcgctgatgaaagtagcccagctgctattgcgttaagaccaaccggcttaacgtga

SEQ ID NO: 31274 - DNA, 1119 bp, Glycine max
  Peptide Sequence Number=SeqID_122959
atggtgattggcacaggaatgtcgacaaatatgaattttcatagttctgcacttctgcttcctatactcataatagtaggtgagaggttctcagaaattgttggaagtccatattatatggctccggaagtgctcaagcggaattatggaccagaaatagatatatggagtgcaggagtaattctctacatcttattgtgtggagttcccccattttgggctgaatccgagcaaggagttgcacaggccattcttcgagggcttatagatttcaaaagggaaccttggcccagtatttctgaaagtgctaaaagccttgttaggcaaatgttagaacctgaccctaagcttcgattaactgccaaacaagtgcttgagcatccctggctccaaaatgctaagaaggctcctaatgttccacttggagatgttgtcaagtcaaggcttaagcaattttcgatgatgaacagattcaaaagaaaagcccttagggtcattgctgatttcttatccaatgaagaagttgaagacatcaaagatatgttcaagaagatggataatgataatgatggcattgtttccattgaagaactaaaagctggattccgaaactttgggtctctactggctgactctgaagttcagttgcttattgaagctgtagatagtaatggtaagggaacactagactacggggaattcgttgctgtttcccttcatttaagaaggatggctaatgacgatcatcttcacaaggccttctcctattttgacaaagatgggaatggatatattgaaccagatgagctacggaatgctttgatggaagatggagcagatgactgtacagatgtagcgaatgacattttcctagaagtagacacggacaagatgggttgctttccacttggtgctgtgcgagtcacgaaggattggtgcagtcagaatatgtttatcaaagtacgaatatcttgtacttcgaattcagcactccgttttggtcattctatcctactgccggttgtttcctccaaggtatactctgggatgctgacaacatctattatttgtttgtctcagcatgagcctggaagatatgctggttctggcagtgcctga

SEQ ID NO: 31275 - DNA, 924 bp, Glycine max
  Peptide Sequence Number=SeqID_122960
atgcgtttgatgttgaaagtatttgcagtcataaaattagtattggtgatagtgcaccctagtgctcatgcattgagcagagatgagttccctcctgactttgtgtttggtgcatcaagttcagcttaccaggttgaaggagcagcaaatgaggatggcaggaagccaagcatatgggatacttttgcccatgctggaaatgggaatatgtatgaaggtgatggagatgttgcatgtgatcaatatcacaaatataaggaagatgttcagctcatggtcaacatgggcttagaggcctatagattttccatatcatggtcaaggcttattccagatggaagaggacaagtgaatcaaaagggggaattcaaccacatgttacattacatcattgggacctaccacaaacacttgaagatgaatatggaggatgggagagacttcacaacatatgcggatgtgtgctttagagaatttggtgacagagttcagtattggactacggcgaatgaagccaatatatttgcaatggaaggctatgatctaggagagtttgcacctaatcggtgttctccctctgtagctaactgttctagaggaaattcctcaactgagccatatttggtagcacatcatatgttgttagcacatgcttcagctgctaggttgtataggaagaaatatcaggccatgcagcatggcttaattgggtttaatcttctgctttttggtcttcttccacgaacaaattctactgaagatgtaagggccactgaaaggttccaagatttcactatggggtgtcttgcagaactccattttgatttctccacgttccacgagctctctgatgaagtggtttctaatctcaatgtgctttgtacagctatggaatactggattcttagtcattgcaatagctga

SEQ ID NO: 31276 - DNA, 450 bp, Glycine max
  Peptide Sequence Number=SeqID_122961
atgaatcgagagaagaaaaaaaatgcaaaaacccatttgcatatgtacatatgcacatgtgtatcaataataaggaacatacttaacgtgggtcgtggcttgtggctcgtcttgactcttgagagaaagggctctgagagagaagggttcaaagaggcagcggcgatggagagatctggcaatggattgcacagtggcatggttgtcagaggagagggcgatggcgaactggtggagctagagggggggggggtcgggttcggagggagctttaccgaccaaatccacaaatttggaggccagatctacaatgttggtgaccaaatctatggcttctctggggttgtgagtgttgtggtggagttggtttggggcgaggttggatgtgcgtttttggttagtagtgaacgactggttttgcttgtggttatggtgggaatgagaagatga

SEQ ID NO: 31277 - DNA, 1149 bp, Glycine max
  Peptide Sequence Number=SeqID_122962
atgagttgccaagcatggcccgaacccatagttcgagtccaatccttagctgaaagtggcctaagttcaatcccttcacgctacattaggcctcactcccaaagaccctccaataccacttcttttccaactcctaaaccttttcaaactgatcatcatcatggtcatgatcagaaaacttccgatcatgaccatgatcatgatcatgttaacattcccgtcattgacctgaaacatgttttctcggaggatccgatcctccgagaacaagtgtttgggcaggtggaccaggcatgtcgggagtgggggttcttccaggtggtgaaccatggtgttagccatgagttgatgaagagttctagggaactgtggcgtgagttcttcaaccagccacttgagatgaaggaagagtatgcaaactcccccaccacttatgagggatatggtagtcgcttgggagtgcagaaaggtgccaccttggattggagtgactacttctttctccattacatgcctccttcacttaggaaccaagctaagtggcctgcatttccagaatccttgaggaaagtgattgctgaatatggtgaaggagtggttaagctaggaggaaggatactcaagatgatgtcaataaaccttggtttgaaagaagatttccttctcaatgcatttgggggagagagtgaggttggtgcatgcctaagggtgaatttctatccaaagtgccctcaacctgacctcacttttggactctcccctcactcagatcctggtggcatgaccattcttctccctgatgattttgtgtctggccttcaagtaagaagaggagatgaatggattacagttaagcctgtcccaaatgccttcatcatcaacattggtgaccaaattcaggtgctgagcaatgcaatatacaagagtgtagaacacagggtgattgtgaactcaaacaaagatcgtgtgtccttggccttgttctacaacccgaggagtgatttactcattcaacctgccaaggagcttgtgacagaggagaagccagccttgtactcaccaatgacctatgatgaatacagactttacattaggctaaatggaccttgtggaaaggcccaagttgaatcattggcctcccaaacatga

SEQ ID NO: 31278 - DNA, 387 bp, Glycine max
  Peptide Sequence Number=SeqID_122963
atgaggatcgtgtcatggcacgaccaagcagagccagggaaggggaggacgcgaaaagtccgggtgaaaaggggttattgggcgtgggttgggcccagaggtaaaggccaagggaggaggcgacgagtagaggggaatgaaagggtaagaagtcgagggggaagtggagccaggtgttattgtcaaggtcgaagagggagagagaggtgtagggtgagtgaggggtgtggtggtggcgattgcagagggcgaagaggtgagggaagaatttggggaggaagcgacacaagaagaagcgtggttaaggaggattcgagggtagaggagaagaacgcgagtatggtggaggcgaaaggtgaggaagctaaacggaggataagaaaatga

SEQ ID NO: 31279 - DNA, 492 bp, Glycine max
  Peptide Sequence Number=SeqID_122964
atggcttttcatagtcagttgaaggataataatgctggtcctttctctttgagaccctccacagtagacgaaatccttacaattgagataaagccaggttggaagaaaggaacaaaaataacttttccggaaaagggaaatgagcagagaggagttatcccttcagaccttgtctttattattgatgagaagcctcatagtctctttaaaagggatggcaatgatcttgttgtcacccagaagatatcgcttgtagaagccttgacgggctacacagcgcagctgacaacccttgatgggcggagtcttacaatccccattaactccactattagtccgacatatgaagaagttgtcaaaggagagggtatgcccattccgaaagaaccttccaagaaagggaacttaagaatcaagttcaatatcaagtttccctccaggcttacatcggaacagaaaagtggcatcaagcgattattgacatctccctaa

SEQ ID NO: 31280 - DNA, 627 bp, Glycine max
  Peptide Sequence Number=SeqID_122965
atgtccttagagatcactctcggggaatggggttgtgctttgggcaccagcccagctgctggtacacccagcaaattaggtgaatttgttcttcgttgcaccgccgcctccatcgttcgtgctgtcgtcgcgccaccagtgattgtcactgtagtcgtcttgtcgttgtccatcaccatcgtaagtgcccttgtcgctcttctttgtcggattctatgcgaaggcacggtttgggggattaaggatctgtctaagacatacggattgttatacggattatcaagctgccatcatggccaagctctgcacaccgaacggtcagttcattctaaatgccgatggggtcgatggaacgtcctgagctacttcaacctcgctccgacctttcacaccttcgacttgaatgtggaccaggctcgactcatctacgggctgcgcgagaaactggcccagtgcccatactcgcttagtgaccagctcacgcttagcgtgaagaaggccaatgagaaagctcaaggtcgcgcttaccatgaacaccgtgctaagcgtgtgattaaaccgccattgttgctaagaccaggattgcatgttcaacgcgaagttagcgtgaaaagtaagctaccttga

SEQ ID NO: 31281 - DNA, 225 bp, Glycine max
  Peptide Sequence Number=SeqID_122966
atgtggtggaagtttaatggtgtcaagtatccaacacttcaagcaattgctaaggatatattagctattctagtatctaccgtagcttcagaatctgcatttagcactggtggttctacgagctataaagttgttgctgaaagtgctaatgtaatgaatgaaatggtttcagatgatgaaggtgaaatgatgggtgttgctggtgtcactaatttggaggaatga

SEQ ID NO: 31282 - DNA, 306 bp, Glycine max
  Peptide Sequence Number=SeqID_122967
atgcatatcagaatccataaactccttgtactccaccagttttctaatgaatttttggctgcactgaatccagtgcaacgcaatcaggaagaaccaatgaatcctgtagagatcgagtatgcagatgctttaatggagctttgtgaggagatgagtatcaaggccattagtctgtggtctgcaattcagacaagggatgactggttagatgatagtttcacaaaaaatcgtgccgccgttacctttcgttgtgcccttgatctctgtcgtgccatccctagcctcgtaacctccttcatctcataa

SEQ ID NO: 31283 - DNA, 768 bp, Glycine max
  Peptide Sequence Number=SeqID_122968
atgttaggaacatcaaggccacaatttgtgctgtttgggtcttccattgttcaatacagttattatgaaggttggggtgctacactttctcacttgtatgctcggaaggatgccaaggagcaaccatcattggtgattgtgtactttggtggtaatgattctactcttccaaatccaaatggccttggtcctcacgtacctgtagaggaatacaaggaaaatatgagaaagattgctatccatatgaagaaattcttgagcagcgtgtgcttaaaacttgatcttatgttgatggttgctaagtttgatacaaatcctaatgattggcagtgcctttctgagaagactcgcacaatatttctcactactcctcccatcaatgaggctcaaatccataacaacagtgatccacatggcctgctactaaggacaaatgaagcttgtctaatatatgcagaagcatgtttggaagtgtgccatgagatgaatgtcaaggccattgatctatggtctgctattcagaaaaaggataactggagagatgtttgcttcattgatggaattcatctttcaactgagggaagcaagatagtaacaaaagagatattgaaggtgctcaaagaagcagagtgggagcctagtttatattggaggtcaatgccaagtgactttggggaagattcaccatatgatccagttggacctgatggaaagtcaactattaatctctccaactttgcatttcccaacaatgaccaatgggactag

SEQ ID NO: 31284 - DNA, 405 bp, Glycine max
  Peptide Sequence Number=SeqID_122969
atgggtgaacaagatagtggtgaaggagatgttgaaggtctcaaacaagcagagtggaatcaagccttcactggaaatcagtgcgatgtgttggaaaatgagaaatgtatagtaaaagacgtatcaaatgacattgtcgttaaagatttatgtcgttatggatttatgtctcaagaagatatagatgcatgttcgcaattagaactagacatgcaagccggagatgttcgtgcatgtgacgtcgtaccactagcatggcgtggcgtcgtcgtcgttccagttggagaaagtgacgacgctggaggcatccacgacggacttcagagtgaaaagcacgatgccgtcggaggagatagaaacagagggacggaaatagatgagcagagtaacgatcatttagaataa

SEQ ID NO: 31285 - DNA, 858 bp, Glycine max
  Peptide Sequence Number=SeqID_122970
ttgaaggttggtgggctaggtgatgtagcaaaggccataggatcaacactgctctctgatgataatgttaggatatgggacgtgtgctctacatcgttaggctcaccgcatccgaggtattgtcctccggaacaaagatgtttacaaactgcccatggcctcaattatgaaacaagtaaaatgtttatgaatccctttatatttggaggttaccctgatataatgaaaaagaaagctggatcaaggcttcctttcttcactcaaaaggaatcaaatctggtcaagggctcaattgatttcctgggaataaacttttactactcacttattgttaagaacagtcctagccgcctgcagaaggagaatagagattacatagcagatatatcggtggaaattgatagattttttccaaatggcacatctacagatgaggttccaattactcccaagattttcctagcggcgttagattcactaaagaattcttatggagacattccaatttacatacacgaaaacggccaacaaacacctcacaattcttcattagatgactggccgagggtgaaatacttgcatgaatacataggaagcttggctgatggactaaggagtggattaaatgtaaaaggttattttgtatggtccttcttggatgtactcgagttgctaactggatatgaatcaagttttggcctatattacgtagatatgaatgatccgagcttaaggaggatacctaaggtttctgctgaatggtattcaaattttctgaaaaggaagcctattgacccaaagatctccaaggaaattgagaaaaatgcaaatgtgctttcacaatacctcactgcataa

SEQ ID NO: 31286 - DNA, 756 bp, Glycine max
  Peptide Sequence Number=SeqID_122971
atggacattgaacccccttcgagttcacccgaaagattcaagctttacgatgagctggaactgctcgagtttcaggacaagttcgtgatcaaatctcatcaatcccccaaccatggcttctggattaaccgtcttgatggcagcatcaatgtatttgatgatgatggtgacacattctctggaagtccattgaggacatctacaatttatggtgtggtgggaaccataagattggttgtaggaacttatgctattgtaataacttctcggaaggaagttggaagtttccttggctttccagtatatcgcttgatgtccatgagattacttgcatgtaatgaagctttgaggttttcaactgctcaagaaaaaaaggatgagactttcttcctgaccctattaaaagtagtggagtcaatgccaggcttgtactattcatatgaaacagatattacattaaacttgcatagaagaagcaagttagtagaaggctggacaagtaagccaatctggaagcaggctgaccctcgatttgtctggaacaaacatcttttggaggagcttattgagttgaaggaacaagaatgtggagaagaggagctaaccttgaaggtattattatacattatttattatcaacttccagaaattcctttctatagtttctctgcagagttggctatgttttccactagcattttgtctgtttctgagatgagaattggctctgtagtcaaacatgctgaaggactttga

SEQ ID NO: 31287 - DNA, 213 bp, Glycine max
  Peptide Sequence Number=SeqID_122972
atggaggctgagtttgtttcctgttttgaggctacctcgcatggtcacatcgatgtcaagtacttagccataagagaacgtgttaaagagaagaaagtggccattgaacacgtcaacattgagttgatgattgctgatcctttaactaaatgcatgccaccaaagaattttaaggatcatgtagtacgaatgagacttggttccatgatgtaa

SEQ ID NO: 31288 - DNA, 1251 bp, Glycine max
  Peptide Sequence Number=SeqID_122973
atgggactgttaaaagccgccgttcgtgacaggtgcgtcgctgccggagctcgtcgccgccgttcgtgccggtgcgtcgctgccggaggtcgtcgcggctgcgtgcgcgtgtggggtgcgggagggacgcggctggtgcaggggaggctcgcggttgggttctctcttagatggaaggttgttctgaatcacagagctgtgctggaggggctggttggtaaggtggactttactattaggcatctctcttcatccacaacttcatttcctagcacatggacattcagtagtggtcaaccttgtattggaagtgatgcccatcagtgttcagcattctctgctagtccttcatcagagaaaacatggaccatgcgtactacctttccagaatatgttgttgcacttgctactattgttggatctgtgctttttgctatatttggtggtgttggtattgcctgtcttccattaggacttatattttcatttattcggcgtccaaaggctgttatcactcgctcgcagtatatcaaggaagccactgaactgggtaaaaaagcaagagaactaaaaaaagcagctgaggcactacatcaggaagaaagaagtggttcaaagggtagaaagtttcgtaaaaatgtgaaggaagttgagaaggagttgtttcaattagaagaagatgtaaagcttcttgaagagatgtatccacaaggggaaaaggctgagacaacatgggctctaacagttcttggttacctggcaaaatttgttttgggaattttagggttgattgtttcagtggcgtgggtcactcatataattatctacctattaattgatcctccactttctcctttcttgaatgaagttttcattaagctagatgatgtctggggtcttcttggcactgctgcatttgcatttttctgcttctaccttctccttgctgtgattgctggtgccatgatgcttggactgagactactcaaagttctattgttttaccttttcagtgtgatccagttctgctccacagcatttgcctactatgctcaagcaactgcagcccaggaaatatttggccacactttggagtctcttcgaggaattaaatatttgtacaagtacaatgtattccaaattgcatttgttgttttggctggattgacctttgtgtattacgctgcctttagttgttttatgttgaaagctatagagcaagctgatcatcatctgagtagaataatctga

SEQ ID NO: 31289 - DNA, 276 bp, Glycine max
  Peptide Sequence Number=SeqID_122974
gtagtgggaaattatgaggcagaagcagacttacctactgggctggaagatgatagagctgacatcatcgaacctgaagctgttttagcttctaggagagtgatcaagcatggagaaagattgaaacagtggttgattcaatggaaagggaagacaagacaaattgctcaagggggaggtattgatacaaccattggtgaagagttacgtgagcctttagtacacgaaggcaaccaaggaaggtgggggcgtgtttacgtgaggaaaggacattag

SEQ ID NO: 31290 - DNA, 570 bp, Glycine max
  Peptide Sequence Number=SeqID_122975
atgggcgatttcaacctcgccctggtgatcgtggcggtggtggtgtgcgtgatcgtgttcctggtgaacgtgtacctcctcgtgaactaccagcaccccgatgacgccaaccaggcctacttccccaaattcgtcgtcgttttgggcctctccgtcgccgccatctccatcctcatgctccccgccgacgtcgcgaatcgccaggcctgccgccacgcgatctacaacggcgcatgcagcctcacgctccccatgaaggacctctggctcgccgtctacatcctcgacgctgtcctcgtctttttcgttatccccttcgccatgttcttctacgagggcgaccaggacaagagtgtggggaagaggattaagagtgcgttgatgtggatggtcaccacggctatagtgtgcgccctcgttctgggaattttgtatgggattgtggaaaattggaaatggggaccttgggtggttagattagatgatgggtgttttggttgtgcgggtgaaggtttccgagattttgtgaatgaagcagtattgggtgctgtggttcttgatgtaggatga

SEQ ID NO: 31291 - DNA, 378 bp, Glycine max
  Peptide Sequence Number=SeqID_122976
atgaagtgtttctatttctcaaatggagaagacgaggattttgtggggagaggagcggtggcgagtttgcgcggcggctccacctcgcgtgtgtcgtgggcttgttcgctgagcctaatggacacgcgcagcagcagccgctcccactccgactctgagtcgacggagttttccgacacggtggacttccaccacttcctggtgcagcgttacgccaacgatctctgtctcttctccttctccgacctgaaatccatcacgtgtgccttcagtcgagccctcctcgtgggtgagggaggcttcggctccgtctaccgcagcttcctcgaccaaaatgacatcgcgatcaagcagctgaaatctgggactgtcatttag

SEQ ID NO: 31292 - DNA, 1623 bp, Glycine max
  Peptide Sequence Number=SeqID_122977
atggctgaaagggattatgctttggaaatatggaggcttcttgaccctggggcacatcttataggtttaaagcaagtccttaatcgtgtgatttgtgtcaaatcaggctcccgaaaatctttactaaatgttttccaagatggtgtctgccatcccaagatggcaatggtgattgatgatcggtcaaaggtctgggtagacaaggaccagcctagggttcatgtggtgcctgcctttactccttattatgctcctcaagcagaggtgcagacagccaatgctgtcccagtcctatgtgtagcaagaaatgttgcatgcaatgtcagaggttgttttttcaaagagtttgatgagagtttattacaaagaattgctgaaatcttctttgaagatgatattggacttctacctcatcctccggatgtcagcaactatttgatgtctgaggatgtaccaaatggtaatgctaatgcccccttcagtgaaggaatgaatggtgcagaagttgaacggaggttaagccaacctgatgataagttttctgttgatttatccacccgacccatgacaaacagtgttgaattcagacatgaaacctctcagccaactgctgaacctggtttgcttggacctcctgtcaagcatgatggcaactctgttgatcgtgattatgacatgagaaaaggacttttaggcatgaggcatggtccagatataagaggtcaaatttcagctgaacctcctctgatattgaggccacctaatcaagcatcaccatctttgatgcagccatttggaggtgggttggtagaagatgatatagccagcagaagtcagaccaatagttggccttctgcatctgttaaagaatctaatgtaataaagtccgataagcatcaggctcaacagaaaccattttctaatagtgtcataggttcatcccccaatgttttactcccacaagcatcacaactaaaggctgaagaggcaacttctgtttctgatttgcagaggcagattgttccatctaagtctcagctatcatcagaggatgggatatctcagaatcatgcctcttctaacagcaaagattttcaacatgaagctggaaaaatgaacttcttatcccctctatctattcaagtgctgcaagaaattgggaggcggtgtaactctaaggttgaatttaagtctattttaagcaccagcaaagacttgcagttttcagtggaggtactattcactggtgagaaaataggtgttggtatgggtaggacaaggaaggatgctcaacaacaagctgcagagaatgctcttcgtagtttagcagagaagtatgtggcacatgtggagcctcaatgtagagctgtcgataaagattttgacaagctttctcttggatgtgacaatggtttcttgtgggatgtgatcaatccagaatccagtgaaccgcaaccagaagatggagtgtctagagaaaatgcttctgaggaaataggtgatgcttggataaggggtatgtggactagaaattccagatggaagtggttgtatagagaaatcacgttgtttatggaattgtgtagcatcaatgtgaaggctaaatcactgaatggggagtga

SEQ ID NO: 31293 - DNA, 585 bp, Glycine max
  Peptide Sequence Number=SeqID_122978
atgaaatctgatgatgagtggataacaaaaaagggagatgatatttttgatgaagacaatgttcaagttgagcaaaagcaacctctaggtgaaagtggtagtggaagcaatattgacttggttggaggaagtttaactgatctaactttggatgcatttgatattgacaatttgattttcaatgacaatgtgaaagatcatttctcaactgaggaagagattgaagatgatagagatgaagatgatggtagtggttgtgatattagggatgattttattagaggattgatgttgaatttacaaagtctccacgagtgtacgcagaatcgcgagtctgataaccttacccacggcgatgagcactccgctcacacattgcctgagcgcacccaagggaaatcacacccccgacgcacagtcaacactctagatgacttaagtctctcccatatgtaccgtctagcagggcagactactagtcgacaccctttcgtcgatcgaattatggaagctgtcatacccttggggtggaaaccactcaacctggagcaatatgatgagatcatcgattcaaatgagatctag

SEQ ID NO: 31294 - DNA, 312 bp, Glycine max
  Peptide Sequence Number=SeqID_122979
atggagtggttttttcggatatctcacccattcatgataccgacccaggcaggtgaccagcccagacatgcacctgccgcagaccctgaggagtacatgcagccgcccatcccacaggttccaatggcatttgacgcccctccacatgcagtggcgatcacggataggttggagcgtgtgctcaaccttaggatggtcactgcagatacaaagttacatgatattatgcaggattgcctcacggtcgctagagggggtgccagtgcagatggaagtgtcagggctcgacagagacggcgcacagagcattga

SEQ ID NO: 31295 - DNA, 516 bp, Glycine max
  Peptide Sequence Number=SeqID_122980
atgtatgataatttaaatgacgcgtccaagagcacgatgaggcaacttgcaggatatatcactctattacaatgttggatctacgagcatttcgcgtccgttggttccgctgttcctgccgaggattatgatgagaggagaccgagtgcatgccgatggacctctggcaaggcactgcccatttccacatggatgcagtttggtgaatacattgaacctgtagggcaattatgtgcagtgtctggccactgctcaccaaattacatgggttggttttacatgatctcgcatccattcataagaccagcgcaaccaggagatcctcctagagttcctctagatgactttgtatcaattggtgataagttggaaaggctactgaacctgaggatcctgaccaaaggaacagaaacctatactgttgttgaagaatgtgagggcatcgcaaaaagctacattggccacccaactgtaggtaacagatccaggcgtaggtggcgtatggacggtcattga

SEQ ID NO: 31296 - DNA, 209 bp, Glycine max
  Peptide Sequence Number=SeqID_122981
atggatgaagaccagtggatgtataatagtatgatgtctgaagaagttgatatgaatgttaaaaatgaggaagatgctggcgttaaagtagaacacgttgattgttctgatgcatttaatacttctcagttgtttgctagccgtgatgaagttttacaatggactcgatcattggctcatgacattggatttgttgtcgttataatgag

SEQ ID NO: 31297 - DNA, 1377 bp, Glycine max
  Peptide Sequence Number=SeqID_122982
atgccgatgcctgaggcgccagtcttaatcacgaatgacactgagaagtcaggtaagcccagaacaggggcttggcatagagcttccttcagtttggagaaagttgtggcagcttccgatccggagagccccaagaaaccacgtagctgccttactaattgcggaggtggccattgctgtacggcggcgactttctctagtactgctgttgtcggcaagggtctgaaaggtttgacgcaagtgttccaggtgatcggagaaggtcctgctataaaccagaatatcatcgaagaagaagataacgaatttccacagggccctgtagtcaacgcagaagcgccacgagccatcccttttcttgacaagaagaattggggaagagaaagggcttgtattgggacgaatgatgccattctgaagcatcgtgttgacttgggattcaatttcctgtttctggaagtggggatagcggtagggtcagacattaatgggggaggagttagggagaaggtgaatggaatgatcggtgggtctggaagggggaaggtgtgttggaggttgaaagagggtgggaaagaggttgatgatggagagcatagtggggtgggtgggttaggtggtcgtgggttgagggcacacccggatgtggaaaaattcattggcactgcgtgtttggaggagatgccagagctggggagtgcagatggccccattggactccgaagacgatgtaggcctcgcacaaagggaggacatgccaagagacttgacgaggtgttcttgcacaaagttgtgtgtgctgcctccgtcaatcaaaatgatgacacagtggtgagaaatccggccatgaaatgttgggtggtgtttcgggctggttcgggtcgctcattgggtcagaggggtctttataagggcttagggtgtggagcaacaatggcccctcgtgaatttttcgtcacaatgaaagcacaaccctcgctcgcgacggctggcaatttcctctggggtcaggcgatggatggggttagagttggtgcggtggagaaacgccttgagttgttcaaggatcttttcctcctgaagacgggccaagctggcggcatggaccaaaacccgttgggtcctcatatggtgattgcgcaaatcgggcctttatggcttgcaggaagccaaaccaggtcgacaattgatggttacgagccatccactagaaccacgcaagagtcgggccgtccatgtaaaaggatgcgatgggttgtgggtggctatggtttcaaggttcacgacacggttgatgaggtcatcgagcttctctgtgaggatgagatgactagaagcaagcttggcgatagcttcttctattcgatccatatttga

SEQ ID NO: 31298 - DNA, 1365 bp, Glycine max
  Peptide Sequence Number=SeqID_122983
atggaggcaccaactgctgtagagaacattcctatggacacaggcacaaaggctgctgaggatgagcatgaaggatttctgggtggtccgagcgagcaatccgtgttgaccctgtatgcggatcacattgcttgcagcgtatggatgagagagcagcgtcctgaattgaagctatcctctcattggaggaaggtccacagtttaggcaggcctgcccctgccattgagggacttgttgctggtacaggactaagtcctctgatcgcatgttcggtagacaccggcgatcggggacttttgtccgcgtttgtggagcggtggcaccgggagacgtctagtttccatctcctagtgggagagctcaccattacgttggacaacgtctcctcgcttctccatcttccagtgattggtgacttacacgcttttgagcccttgcacgtggatgatgcgagtctgctagggctgagacagcccagtgtcgcagaccgtacgtacgcctgcaatgggtacgtgatatatatgagcgccgatgccaggcagagtgcaaccaatgtccatgttgtctacttggaggcccttcgtgacctcagtatgacggagaggtacgctaggggagtggctgctttagtgcatatgtacgaccagctgaacaatgcatctatgagccacaaccgacagcttggcggttacatcacattgctgcagtgctggatttacgagcactttccgtcggtcgcggactccactgctgatcaggagtacgacgaggattctccacgttcgtgtaggtggattgcgaccaagaagaccgtgaagagcattcgtacgccggcatacagggatcgcctggaccgactccggattccagatgtctgttggatcccttatggggagcaccgggaggtccgggacttccacgtcagatcgtgctattccggtctcttgcgctgggggcctgttgctatttattaccgaccagagaggatcgtgtggcagtttggctacacgcagatcattcctgatccttctgtcgattcatgggtctcgtatgatgatatacatgataggtggatgcactacgaggatcatatcgtaccagcatgtgaggccccgcagacgggtatccctcacgtgccggagccaggagcatcgtctacatctgcggaggagcctagacatgcagtgaaagtttgtgatgacattgctgagaggttggagcaccatctgagtctaggggtggtcatgcctggctcatcgacacatgaggtgatcgaagaattcctcagattagccaggagtgtgacacaggaccatctagtatacgttaggtgtagacgcaggcggcgcactgatcaggcatag

SEQ ID NO: 31299 - DNA, 345 bp, Glycine max
  Peptide Sequence Number=SeqID_122984
atgatgatcgaaacagagaggaacatgatgcagtttcgcggcacagagaaaaggctcgagacggcgagacttgctgagagagtcttcctcggaccctttgcagcttcttcattcttcttcttcttctttgccgccatcgccgccattgttgccgtgtttaggaggaaggtgtgggtcttcgcgtttgtggttgttcttcgtgtttgtgcttcttttcgtgtttccgcttcttcttcaagaaaccgctgtcgggaagtttctgggtcgtttacggatcacttgatccgtaagcattttccggatcaagttgatctggaagatgtttacggatcaagtgatccgtaa

SEQ ID NO: 31300 - DNA, 219 bp, Glycine max
  Peptide Sequence Number=SeqID_122985
atggaagaagcaggcagatgtaaactcactgcttttgttgctggggttactgttccatttgcttccattgctattcaaatgttcattgaggaagtcattgaacttgtggaactgaacccactaaagcatgaaattgttggattgccaggtgttaacggactatcgacagagcaacgcaaaaggttgactatttctgttgagctagtggctaatccttaa

SEQ ID NO: 31301 - DNA, 129 bp, Glycine max
  Peptide Sequence Number=SeqID_122986
atgtttgtttatgatgcaccaacgtcagtttctctcagctcagtagcttcaatctccaaatccaatggagctaagtcccctgctaaagttttacctcgcatacaagaagcaagctactacagagtgtga

SEQ ID NO: 31302 - DNA, 300 bp, Glycine max
  Peptide Sequence Number=SeqID_122987
atggccttgatcatatccaccttaagtaactattctaaccgtctaagaatgatgcaaaaccaggaacttaaaaataggcattttctctcacaattaagttcacactctcatcggcaaggttatcgatatcgagagtctacgcagactccttttgatctagataatttaatctttgtggaacctaatgatgatgcacaatctgaggaagaccttgatgatgatgatggagatggagatgatgatgaaagtgatgatattcatgaagatgatcctattagaggattgaacatgcttctttga

SEQ ID NO: 31303 - DNA, 228 bp, Glycine max
  Peptide Sequence Number=SeqID_122988
atggaggcattcatggcccaggtggcctggccaggagtccagtattctcctttagggggaggtgaggctttcatagcccaggagcctcagccacagccggaggccactccagagaccactctgtggacttcaccggccactacaccagttttagaggtctcagaggaggaggatggtgttgcagatacagattatgcaacagatatggcagcagcgcaaagcacctag

SEQ ID NO: 31304 - DNA, 714 bp, Glycine max
  Peptide Sequence Number=SeqID_122989
atgtttgatgagttcctgcaggaactccagaggctcagatgggaccaggttctgacccgacttccagagaagtggattgatgttgctctggtgaaggagttttactccaacctatatgatccagaggaccacagtccgaagttttggagtgttcgaggacaggttgtgagatttgatgctgagacgattaatgatttcctcgacaccccggtcatcttggcagagggagaggattatccagcctactctcagtacctcagcactcctccagaccatgatgccatcctttccgctctgtgtactccagggggacgatttgttctgaatgttgatagtgccccctggaagctgctgcggaaggatctgatgacgctcgcgcagacatggagtgtgctctcttattttaaccttgcactgacttttcacacttctgatattaatatcagtcagatcgcccagtccatcacttccaggcttgggttcccagcgttgatcacaacactgtgtgagattcagggggttgtctctgataccctgatttttgagtcactcagtcctgtgatcaaccttgcctacattaagaagaactgctggaaccctgccgatccatctatcacatttcaggggacccgccgcacgcgcaccagagcttcggcgtcggcatctgaggctcctcttccatcccagcatccttctcagcctttttcccagtga

SEQ ID NO: 31305 - DNA, 579 bp, Glycine max
  Peptide Sequence Number=SeqID_122990
atggctccaaggtcatccgcgccctcaaagccctcactggctagcacctatgtcaagactatgtgtgtgcacttatgcttgcttcttggtgtgggtagccacatgcaggagcttcggagggtcaggtctgggatcatgggggagaaggataacatggtcaccatacatgatcatgggggagctgagtgggtttatgataattatagggatgggacttatttgaggagggttgttatgcccttggagattcttttgactaactataagaggttttttgtcaaggattctagtgtcgatgctatttgttatggtgctaaactttatgaggggttgacaatcgttcacaatatccctttgcgccataatcaagtcaaggttggtgttaaggaagttagagatgcagatgctttgatttctgtactcactcaagaggttcagttagtgggacagatacttaacacattcgttgtttggctgacacatcttgtcaagcgtttatcagaacaaggagttgtgggaccgaagaaacctgcacatgcactagatgtcaattgtaattttaggaagtttcaagaataa

SEQ ID NO: 31306 - DNA, 432 bp, Glycine max
  Peptide Sequence Number=SeqID_122991
atgcgcttagccaaaagacattggtggctaagcgagtgtgactcgctagccttatttcaaacagagaaggaattgtgcttagcgcgacagctcgctatgcccaatttttattacagatgggaaattgggcttaacgcgagtgtcgcgctaagccactattggaatgcagaaagcctcaaacagcactggcttagcgagttcatccccaaaatgcagaaaacaaagatcaacttcatgaactcccttagcgcacaaggcgtgcttagcgtgttcatcccaaaacccaaaaattcaaagaaacgtatgaactcgcttagcagcacaggctcgcttagcgagttcatcgcaatcccaaaaatggaggcttgcgagcctcaactccttaagccaccaaacaagcttagcagcttaaggctgagcctagaactctaa

SEQ ID NO: 31307 - DNA, 87 bp, Glycine max
  Peptide Sequence Number=SeqID_122992
atggttggattcttaaaagtcattgatggatatgaagaagcaatggttcaagtggcaaagtggcatggagagatgggtactcaatga

SEQ ID NO: 31308 - DNA, 642 bp, Glycine max
  Peptide Sequence Number=SeqID_122993
atgaagaaggtcgttggtggatggctatcgtataagggtgggcattcatggatgatggtagccaatggatggttacttagaggcaacatcgtgagggaggtagggaaggcgaagactagtatgggggatcttcacaagtcccccatgagaaacgttaagcaaggagaaatggggcacgatggaagcaattggatatctacatctagatctagacctaaatataaatccctcccgttcgttttattcatgcgtgtgttggaatcaatagagggttgttgcggtgaaggtacgatggagaagcaactagggcagccacacaagtcacaaactcaactcactcgacatgctgggcctcatctccacgcacttcaagagtggggtgatccatttaagggggcacatatgacttctttaatgacacagtcatcagactcgacattgaagcattctacagggttgtttctgaaccctgatttgccactattgcagaagttatggaatgttatcgcacgcaagtttgacggcagtgcaattggtatggcactgaagatcacaaggaaggaccccattggtgccttttggcaatgcattgggggagtcaatggtagaggtagaaaagttgcgacgaagaggagttggtaa

SEQ ID NO: 31309 - DNA, 195 bp, Glycine max
  Peptide Sequence Number=SeqID_122994
atggatgaaacagatgcaatagtgatgtcatggctgtggaattccatggtgctagaggtgagtgatgcttgcatgttcatgaagactgccaaggatgtgtgggataattgtaaacaaaactattccaaggttggtgatgctgttgaaatttatgaaataaagatgaagattgcgactaccaaacaaggagactga

SEQ ID NO: 31310 - DNA, 219 bp, Glycine max
  Peptide Sequence Number=SeqID_122995
atggccaggaaaggggatttcagtccttaccctactctaacatacccaatatcactagaagagggaatgatgcaatcctaccccctaagggcattggatagaagactccaagaagattgggccagagatgtaagagaaggccctaggattctcatgagtctccgggtagattttgggccatgggctaagtatgagtccacttatctttgtacatattag

SEQ ID NO: 31311 - DNA, 498 bp, Glycine max
  Peptide Sequence Number=SeqID_122996
atggcatcaagttttgatagccgggaaaaggatcatttctttaacactgatgaagaagttcaggaatctgcacaggattgcaaaaagtgtaaaaagggggtttgttctgggatgcaatctaactttgtttgcagtcatatcattggggcaaatccttgcaacttcctagaatgtttccaaatatctttccactggttacaagtcaggcacccatgtacttgctcgataataagttgtcagcccctctgccaaaccttcgacggaatgaaaaaacaagctgctataacctgttggcatgtgctcagttccttgagaaagcctggtgatcatgctatcatatgcaaacttgcttatgacaaaggcatcttcaaatggtttaattgtcaaggaaggaaagggagattatactcagttgcctgcagcccaacggatacaattgaagtttccatggacagtgaggattttcctaatgccgatgctgattctaaatccaaatga

SEQ ID NO: 31312 - DNA, 354 bp, Glycine max
  Peptide Sequence Number=SeqID_122997
atggctgttcctgctgctcttgacaaagtggagttatatgaaaagctaaatccacatcgattggatagactagaagtgaggaagctcaaacctctccaatggaaccgtatattagatttcatcttaaaaccaattggctttaagatgaaatctaatatggtatcagagcaggctttgaccctgggacctcgccttcgctttcgctgcgacaagcacccaccatttgtggttcacgcaccaagcccaataagtgttgggcgtgaagggggtgtattgggaaaatacccaagtcccacatcggctgcctcaatccttggagtgcagcttatatacctgttgggcaacttcacttaa

SEQ ID NO: 31313 - DNA, 297 bp, Glycine max
  Peptide Sequence Number=SeqID_122998
atgtatccacatgatgaaatgagcatcgttcttgatgacactaataacttcaataaaagggtaacatggatgttgtttatgacaatagtgaggaacaaggagaagaaccaacaagtggcgtcgtctgtggggacatcaagatcaagaaaaatgggaacaacaaagtatgatattgagaagttctcaggggaaaatgactttgggttatggaggatcaagatggaagcaatcttgattcaacatggttgtgcagaagctcttaaaggagaagaaaggatgtctgaatctttaggctaa

SEQ ID NO: 31314 - DNA, 2844 bp, Glycine max
  Peptide Sequence Number=SeqID_122999
atgggtgaacatattccaagacagcaaatactcttaattgcgtttgaggatggactgcttattctttgggatgtttctgaatctagaattgtgtttcttggtggtggaaaagatctccaattgaaggatgaagatggtaactcttcttccgaaacgggcaccaatcctccagctgatattgtagaacaaaatctaggtgacaaagagataactgctctttgctgggcatcttctactgggtccattcttgccgtgggatacttagatggagatatccttctctggaacttgtcatcagcaacagcttctaaaggccaacaaacttctaaaaatgttgttaagctacaactttcaactgcagaaagaagactcccagtcattgtcttacaatggtccaacagccataaatcccaaagtgatagttttgggcagttgtttgtctatggtggcgatgaaattggatctgaagaagttttgactgttttaactctcgaatggtcatccgggatggagtccgtaaaatgcaccaatcgtgcagaccttacacttagtggctcttttgcagacttgattttactgccaagtcctggaacgatggggttgagcagcaaagatgaactttttgtactggcaaaccctggacaactacatttgtatgataatgatagcctttccgcattaacatctcagctgacgagaacgccatccgtttctgctttggagtttccagtgctagtacctatttctgatccatgtttgactgttgcaatacttatcaggttgcccagtaactcaaattcatcaaaaaatttcactgaggtagcctcagctctgagaactggctcaaggcatggatcagctccttcaaattggcccttgactgggggtgttcccagtctgtcatccacagctaaaggtgctgtggttgagagagtttattttgtgggttattccaatggatctgtccttgtgtgtgatgccacacatgcagtcttatcttatatttgctacatagagggagaagtgaatggtataaaagtggctggttcagatgctcaagtgacaaaattggacttctgctctgtttctttactgttggctgtgggcaatgaatgtggtcttgttcgcatttatgacctcaaaagccactctggtggacgaaatttccattttttcacagaaacaaaaagtgaagttcttgacactccagaaggaaaaggatcttactgtagcgctgtcttttctgttctggattcccctgtgcaagcattatcatttgcaaattctggaactaaacttgctattggattttcaagtggtagtgtggttttgttcttgattgatggtgtacctagctctagttcaccaattacttcattggtttggaaacaagaagcatattttcaaagtgaagtgaatagtttaaagccatcagaaacagattcaggcaactctcttgaagaaatactatttgtgttatcccgggatggaaaaattaatatagttgatggtgatagtggaaaaattatctgcagtcggccattacaagcaagtacaagtttcaccaagaacacaaagcatattctccgtttgattgcagttagcatgtccttggaaattctaactgatttttgtaccccagagggtagcatctcagcatctgaagcatcaaatgacaagctgcaggaagaaactgtgaagaatactgctgatgctagccctgatgaggaggaagaacccttatcaactagggtaaattcatcagaagctggtctttcctcttcagaaagctcacactctggagatttgctgttggatccacttgttctgctatgctgcgagaattcattgcgtttgttctctgcaaaatctttgatacagggacataagagaccaattaaaaaagtgaaacattctaaatcttgttattggactacaatttttaagaaagatggcaaagtttatgggcttttatcattgcttcagactggaacatttgaaatcaggtctttaccagatttggaattggttgcagaaagctctttattgtcaattttaagatggaattataaagtgaatatggataaaaccatgtgttctgatgattatggagagatagtgctggctaacagttctgaattggccttcatgtcattactggctggcaaagatgaattcagtaatctggagcatctgccttgtcttcacgataaagttcttgcagccgctgctgatgctgcctttaaattctcttcaaatcagaagaaaaaacagcttaactgtttggcacagactgtggtgccggggattctaggtggtattgtcaaagggtttaaaggaggaaaaaccactccaacagatgtgactaaaattccaacctccaattttggtcatttggaagacattttctttaagccccccttgcctgattcccctacaacagtggcaatcccagataagaaagaagcggagcttgatatagatgacattgaaatagacgagccccatcagcccatacctaaggcttctacttcctctcctgatgttaaaaataaacagaaagataagttacaagatagggagaaactatttgaaggtgggaccaacaatgatgatttaaagccaagacttagaaaacctgaagaaattatggctacttatagaaaaactgaggatgctgcttcagttgctgcccaagcaagaaacaagcttatggagaggcatgaaaaattggagagaatcagccaacgtactgctgaactgcaaagtggagctgaaaattttgcgtcattagcaaatgagcttgttaagaccatggaaaggaggaaatggtggcaaatatag

SEQ ID NO: 31315 - DNA, 90 bp, Glycine max
  Peptide Sequence Number=SeqID_123000
atgtatctaccagcaggtgctgggatcaaattccctgtccctaaattgaaggctgcagcaaacacaattgacaatgtctataataactaa

SEQ ID NO: 31316 - DNA, 258 bp, Glycine max
  Peptide Sequence Number=SeqID_123001
atggcagcgcagttaatccatgatcgcgtggtgatggagtgcctagagggagcttgggagaccctcgaaggcaatgagagtacatccggaggaacccgcacgcatgcttcagcagcctgtggagtggatactacctacacctactccatatcaactagtggagctagttcaagtgatagaggtagagcagccctggagggacaacgaatagtgagcagccctggagggacaacgaatagtgacgactcttcatcgtag

SEQ ID NO: 31317 - DNA, 341 bp, Glycine max
  Peptide Sequence Number=SeqID_123002
ttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtcccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 31318 - DNA, 182 bp, Glycine max
  Peptide Sequence Number=SeqID_123003
cctccactgcccccattcatcttgggtctgtaaggcgtggaattatggtgttggatcttgaaatcctcacacatctccttcatgattttgttgttcagattggtggcattgtcagtgataatcttcctgggcaatgttggacaagtggcctcagatatcttaagaagggggggttgaattaa

SEQ ID NO: 31319 - DNA, 178 bp, Glycine max
  Peptide Sequence Number=SeqID_123004
gaagctgggtgtttcggtcttttcctctttgttcatgtggggtgggatatcactagtcgagaatggcaatctgaaaggaagagacaccaaaaatgggttttcctttgccggcagtcacttaccttgtcgtgggaaccccaatcttgatatctggggcaaaacaaatctgggtgtcaag

SEQ ID NO: 31320 - DNA, 228 bp, Glycine max
  Peptide Sequence Number=SeqID_123005
atggggtcctttaatggtgattttccaccatggagatgcagcggaagacaaaggaaaggaggtgagaggaggcgccatccattaaggaataagccatggaagaaggagcttcaccaccaagatgagccttggataagaagcttggagaggatgcttcaatggaggaaaagaaagagggagagaaagagagaggggggagcacgtagcttccttgagaagctttcttga

SEQ ID NO: 31321 - DNA, 129 bp, Glycine max
  Peptide Sequence Number=SeqID_123006
atggctgagtataaggcgtgcacccttgggatccaagcaacaattgacttcaaggtcaagttgctcaaggagaatgggagaccagggatcataagtggataccctaccaagcctacatccggaaactga

SEQ ID NO: 31322 - DNA, 177 bp, Glycine max
  Peptide Sequence Number=SeqID_123007
atgactaatgcaaactgtccgcaagagtcattgcattcagtctcaaatgggaatctaagttgggtttgtgacaaccaagaaggattaggttttgagtacaccagccaacccactgcttacgaaaccagtagacctggcctcttgagtggacctcatgtgccaacaaatgtgacttaa

SEQ ID NO: 31323 - DNA, 198 bp, Glycine max
  Peptide Sequence Number=SeqID_123008
atggctaccattgcagtatcaagtagatatgggagcaagtcagcattggacaccggaattgggtggtcttcgtcattggaagtgcgtaatgacattgttgggtttggtgggaaacttggccgtataggaatggcagtcacagcatggatccacttcgatcctttcactggcgaagaccaaatccgcaaagctttgagg

SEQ ID NO: 31324 - DNA, 307 bp, Glycine max
  misc_feature (280)..(280): n is a, c, g, or t
  Peptide Sequence Number=SeqID_123009
atggccacaatgatggaggccatgatgagcatgaagaagataatggaagccaatgcggttgcagttgccactaccagcactgttgctaaggtgaacccaatgcccccatctggcctcaacaaaatgaatcatccaacctcagctatggtaggcaaagatttgggaagtacgggcggcccccattatgcgcaaattcaaaacaagcatgccttcctaccatatggcatgcctcccaactatacgccacccaatgtggcgtacactcccaatgagaatgtcnataactccactcctatactcgttgaga

SEQ ID NO: 31325 - DNA, 144 bp, Glycine max
  Peptide Sequence Number=SeqID_123010
tggcatctccaatcatctttctaccttctccattctactgccatttatcttcaagaagcaaaggactccattgatgaagaagatccaaggcctacaagctccacatggagctacatcatgtggtaccaaagcatcttcatctag

SEQ ID NO: 31326 - DNA, 300 bp, Glycine max
  Peptide Sequence Number=SeqID_123011
atgaggcttcactgttatcaagcgagtcagagacctagcatgaccacagatcgacctcatctccctatgtctcacatagactcgggtatagggtctaatatctcaatgtgtgtgcaaaggtgtaggtgccatgtgtggatggaacaacaaatatttctaactacgaatgtaatagatagacaaacgcataccaaacacaataacatagcaaaggttatacacaaatatggacaaaacaaagataaaagagaaaaggggaacatgaatgaagaagaagtcacgataaacattgcacattga

SEQ ID NO: 31327 - DNA, 234 bp, Glycine max
  Peptide Sequence Number=SeqID_123012
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctgtactagagagcttgaccttgaaaggtctcacttgcattacggccattgactga

SEQ ID NO: 31328 - DNA, 900 bp, Glycine max
  Peptide Sequence Number=SeqID_123013
atggccaaattcgacccagacatagtcctcgaattttatgccaatgcttggcctacggaggagggcgtgcgagatatgagatcctgggtgaggggtcagtggatcccgttcgatgcggatgctatcagccagttcctaggatatcctttagtgctggaagagggccaggagtgcgagtatggccagaggaggaaccggtccgatggttttgatgaggaggccatcgcccagttgctgtgtataccggggcaggattttgcccggactgctgcagggaggcgagtgcgaattatgcgcaccaacatgaccaccctgacccagatatggatgacgttgctgctcagcaacatcctgcccagcgatcataattccgacctccctctgccgaagtgtcagctggtgtacgccatcctgacacggatgagtattcacgtggctcagttgatcgctgatgccatttatctatttgtaggtatggcgccgaccaggcaccctatggacccaaataagtccaaccgggccctgggatttcccgcactgatcataggactctcccagtcgttcggagtccccgtggcacctaccaagagacctgttcagggtgatgctccacaggccgcaggcgcaccaccaccacctcatcagggtggcccggctgggtcatttgacatggagcagtatttacggcatttggttcgccagcaggcggccaaccaccgggcacatgtacagacccatgattgtctgtaccagctgagcctcagcatgcagagccagggcttcacttctttttcatgccctactccagaccagttcagggcagaggtcgcatggcccggggattggcctgaggcccaagcaggagaggcacccccagaggctcccgacgatggagagtag

SEQ ID NO: 31329 - DNA, 990 bp, Glycine max
  Peptide Sequence Number=SeqID_123014
atggaccagctggcattcgtcgccggcgcgcgcgctctcagcgatgccatgcagccccacctgtccgtgcgcttcgagcacgtggtgcgcgccgatggcgatgagtacaccttgatcgaaggcgggcaggggagtgcgcctgccctgcacctgcagtggcgggccgctgcgggctgggaggatgaggcgtggcgggagggcatcggtggccgtcaggccctgctgcgcttcctgacctgccaggatgaggccattgcgcgcacctgtgacgggcgctgggccagcacctgcatcgcgctgccggtggatgtcgacagcctgcagccgtgcagctggaaggcgagcgtgcagcccgcctgcaggcgatggacgtggcgctgcacgaggggctggccttccggctgccaaggcatcacagatggccagagcaccacgcatctacggttagaaccgtgccaccggcgaaatacctcagaaggctacatcccgccgtacaggtggtggaccgcttcgctgccgagcaaggacggtacaccattcgctgtactgcgcggtgacaacaagccaagacccgcagcaagacagcgtcaacgacctgctggcgctgggctgacaggtggctgcgccggaggatctggcgaacagtccgcgatccataccggcatccgtccgacaccgttcagggcggatgctgccgcgcctgctgcacgccccgcgctggacccggctgcgccgcgcactgtcgcggcgctggccgatgccggcgatggtcagcgatgtgcgcgatgtggtctacgtgagctggtgggtcgatgtgcgccacgcaccatcgccaccgccgggccatcattacgtggtccatgccggacgtacgccttacaccatcctcagctaccgtcacggccacttcgggccggcgttggccggaccgctgcgctccctgatgccgtctccaaggcagagcaactggcgctggtacctgcgtcgtga

SEQ ID NO: 31330 - DNA, 339 bp, Glycine max
  Peptide Sequence Number=SeqID_123015
atggacaagtcctccacaacaacaacgcctgtccctccttttcagaatgctgctggtccaagcaagccatatgttcctcctccaatacaacaacagcagtcacaacaaagacaacaagcaactgaggcccttcctcaaccttccctagaagagttaaatccgaaaaatgtgagtgccatcaccctggggtctggcaaccaaattcaagtgcctccaccagtagcagcacctgcacctgaacctgtcaagcttcattctacacctgaaaaagaggatgagatagacatcggaaatggggtgaattctacaagctttttcgctggaaaactccctccttag

SEQ ID NO: 31331 - DNA, 453 bp, Glycine max
  Peptide Sequence Number=SeqID_123016
atggaatctattccaaacatatataccatggttccttacctcgacaggatatattatggcgatttcgtcaggtttccattgtgtcttccacaatggaatctgataagtgagatatggaatctgataagtgagattccgggtaattgtttacataatcttcttctgtccgaagaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagtttcgcttttggtggcaacatgctatggggtggtggtcccacttatggg

SEQ ID NO: 31332 - DNA, 306 bp, Glycine max
  Peptide Sequence Number=SeqID_123017
atgtatactggttcagccacaaactgggcctacatccagtccccaagcaacctgcggttcttgagatttctttcaatcgtggtaaaatcctttacaagccaaagatccacaagggatgtaccctcccgtattctctttgaaaaaaccaagtggatgtaccctccatatgaactgatccacaagagatgtaccctctcttgttctcagtataacaatccccaagtagatgtaccctttacttgtaccacaaaggatgtacccttcaatgtgttgggacaaagaattctcaggcggttagtcctttga

SEQ ID NO: 31333 - DNA, 1398 bp, Glycine max
  Peptide Sequence Number=SeqID_123018
atggaaattgatgtcttttttgtaagagagaagattctggccaagcagcttactattgtccatgttccagctctagatcagtgggctgatattctcaccaaatctctttctacatcacgatttgaagttcttcgaggcaaactcaataattcaacatcttcaagctctgacacagtatttgctgaaactggaaaatggcgggtgcaggaagagacatgccagctaactgaagaaaacaaacagaaattggaatcccagcctgcaatacagaatgaggagacaacattcataaagcatccatattcggatggagagactgcagaaataaaccccactaatgatacagaggaacaagaagactttccagtgtctcttgccaaggagaaactagggattgaggatgatggaaaattcaatcaagaggaagcaaaagcgattgtagaagcaacaaaagaagaagtccagccaaacttgcccacacctgcaattgtccaatgtgaccctgatcaaatcatacagcaacaaacactgcacaatgatgaatcagaagcaattgataatgccaaaagcttcataccgaaaaacaaacttgaaagaatgtccattgttgttgaggacactaatcaacctgaagccatggccaatgtcagcacagtaaaagaagaacaagctgacccccatgcaaaattatgttatgatgtagatgagcagaagacagtagactcacactcggtcgataatttagagagtaagggtgcaagtgtatctgaagataaggccctgcaaatattaccccgtacaacatctgtctgtatcgaagaagttgtcaaaaacattcaagagatacatacagaagcagaattagcagtgacagataccaaagagaggcagatatcagaaaatgagtctgaggcaaaaaaggaagtatctgagtatatgttaaaaagggcatttgatttgcacagagtggcatgccaaaccagtgcggaaaatgaaccgaaagctgaattcctatctgaagagcagagctacgagactattgttacaaagcatccaaattttgaaagacagaccaaagaaatgaacccaactaatgaaactaaagaacatgaaaaggttccggcatcacagactggagagaaattagagatcattgatgatcggaatttcatacaagagggagaaaacgagatggaaaagcaactgaaaggaagtgtactagaagatgaagtccagacaaccctgcccacatcaacaattgttaaaggtgagacgattgaaggaattgttcaggaacaaacacttgaggaagaggaatcagtggcaatagataacaatagtggtagaccagaaaatgaacttgagcaaatggctaatgttgttgaggttagccagtaa

SEQ ID NO: 31334 - DNA, 60 bp, Glycine max
  Peptide Sequence Number=SeqID_123019
atgacgaaagacaacgattggtacctcaaagccttacactggggcaatgaaaggcagcat

SEQ ID NO: 31335 - DNA, 354 bp, Glycine max
  Peptide Sequence Number=SeqID_123020
atggatacgtcagagccctacactagggcaatgaaaggcaccatgcagaaacctcatggtggacccttgggtactagtaccctcaccttcagagggctacacgcactgaccttcacagggctacacaccctcaccttcagaaggctccacgccctcaccttcagaggactacacgtcctcgccttcagagggatacacaccctcgcctttagaggactacacgtcctcgtctttagaaggctacccgccctcgcctttagaggactacacgtcctcgtcttcagagggctgctcaccctcgccttcagagggctgcacgccctcgccttagaggactacacgtcctcgccttga

SEQ ID NO: 31336 - DNA, 183 bp, Glycine max
  Peptide Sequence Number=SeqID_123021
atggcaacggaatatagatggaagaaagataattggagacgccacttcaaggagaagatgagtcaagaagaagctcaccaccagaggaagccatggataagagctttaagcccactaatccaagatcaagtccaagattctccactaagtgtgcttacgtgtcatgaggcatgtaaagcatga

SEQ ID NO: 31337 - DNA, 47 bp, Glycine max
  Peptide Sequence Number=SeqID_123022
atgataaaagcctcgagggtccgtcccatccctgaaaatgctatgag

SEQ ID NO: 31338 - DNA, 198 bp, Glycine max
  Peptide Sequence Number=SeqID_123023
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttttgactgctgtgatagaactgtag

SEQ ID NO: 31339 - DNA, 270 bp, Glycine max
  Peptide Sequence Number=SeqID_123024
atgttgtggaagcttgggagggttgatggggacccggtgttgagagaaacgaggataagggctacgtgggagtacgtgagctcagttgaaggtgggcaacaggggatggtgggtttatatgtgatttgtggatgtggagaattgttttgcaccatcgcccgaccaccacctagtaccacatgtgatggagtggtacctggagatatgtcgcgggggtcaggagaccttggggacgtcaggtggggtgttattgcccaaaaccaagcttga

SEQ ID NO: 31340 - DNA, 393 bp, Glycine max
  Peptide Sequence Number=SeqID_123025
atgggttcgtcgggctttgatcccattccgttccgaagcgttctgctcattgagttttgtaaaggttccggtctttcttcggtgaatctcgaggtctttctgatggctgcgctcagcctaatgttatctacgttgacccttctcagactagtttacaacggttttcaaagcaagaagcaagtggaaaaacggcttgttacagtgaatccgaaaggctttctggcgaaaaggaggaaagcattggtttatgcccacccggctgaaaggaggctttctggccggactcgcagacaacttccaatgccttccaggcagaatgaaaaagctatggaaggtccaaaagggactatcttcatagtaaagaagctatcctttcttgcgtcatcagcttga

SEQ ID NO: 31341 - DNA, 762 bp, Glycine max
  Peptide Sequence Number=SeqID_123026
cgcttgccgtcgaagtgctggccgagagcgcacgcaatccggccgtggccgaggcatttgcggccaatcgcaggcaattgcaggcgacgctggccgaagccctgcagcaggtggcgcaacgcgagcggcggcgccccgtgcttgcagcgccactgcaggcgcaggcaaggcctcggcgaccttcgtcacgctggccggccttggcctggtgctggccacgcagcggcaagggtggtggccggccagtgtgcagacctggcggcgcgcactgttcctgatggtgctgggcctactcaacctgaccctgttcccagccgatatcctgcactactacgcggtgtatttcgcgttggccgtgctgtggctgcgtgcctcgccgcaggtgttgctggccagcatcgtgggcctggcggcctgttcgttctgggcgttgctgcactgggactacagccagggatggaactggcaggcgctggaatacaccggtctgtggcaatggccgggcgcggcccgcaacctgctgttcaacggcttccatccgctgctgccgtggctgtgcttcttcctgctggggatgctgctggcacgcctgcaactgtcgcagccgcgggtccagcgcgcgctgctggtgctgggcctgctgctgatcgcggctggacatggcgtgcagcagcttgcgcagggaacgccctggcaggcgtggctgggaacgcagccgatgccgccgggaccggcctacgtactcacgggtgcgggcgcggc

SEQ ID NO: 31342 - DNA, 387 bp, Glycine max
  Peptide Sequence Number=SeqID_123027
atgttgtcttcaaacgcagaggattcggtgaggaagaagggcttctacaagtcttggtcctccaccacctccgccaccgccaccaataatgtttcagaaatcagtgttcatgaagccaagccagctgagaaagaaagccttcttgtggaatctaacgatgatgacgacgacgatgacacagaaatcgaggaccaagacgttgaaggaggaaggaccgttgctcagaacaatgacaggggaaagggtccacctgttattggtggagaaagttcaaaaatagatggtgatgaaggaccagatgtggataagaaggctgatgagttcattgctaagagaattgagtcaatcaagaggagtagaaggagtgcaagaaactcttcaaggtaa

SEQ ID NO: 31343 - DNA, 276 bp, Glycine max
  Peptide Sequence Number=SeqID_123028
atgttagctatcatcagcaagtaccaagaagaattaaatctagccacggcccacgagcacaaagtggcagacgagtatgcccgagtgtacatggaaaaagaggctagaggaagggtgatcgacttgttacatcaagaggcaacaatatggatggaccgatttgctcttactttgaacgggagtcaagaactttcctggttgctggccaaggccaaagcaatggcggacacctactccgcccccgaggagatccacagacttctcagctattattag

SEQ ID NO: 31344 - DNA, 321 bp, Glycine max
  misc_feature (292)..(292): n is a, c, g, or t
  Peptide Sequence Number=SeqID_123029
atggataatgaagagggcgtgcaggaacagatgaaggccgatctatcggccttaaaagatcaaatggcttccatctcggaggtcatgttaaaactccagaaaactatagaggataaagccacggcaaccgcctccagtacagttagggaagcggagccagtgctgcaacccaccttaaatccggcacccaggcccatttgggccctccagaaggttcctccagaaggcggttgcttctggaggaagcaaccctgctcgcctgggcgagctgagctcgcctgggcgagctggncggcaagcatctcccctattttgctataa

SEQ ID NO: 31345 - DNA, 519 bp, Glycine max
  Peptide Sequence Number=SeqID_123030
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttttcccagtcacgacgttgtaaaacgacggccagtgccaagcttgcatgcctgcaggtcgactctagaggatcccattgtttcattggcctctcgccgtcactactcacttttaggcttatatatttttataaaatggtctattctattattggttttccgggtaccgagctcgaattcgtaatcatggtcatagctgtttcctgtgtgaaattgttatccgctcacaattccacacaacatacgagccggaagcataaagtgtaa

SEQ ID NO: 31346 - DNA, 282 bp, Glycine max
  Peptide Sequence Number=SeqID_123031
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggatcctctccaagcttcttatccaaggctcatcttggtggtgaagctccttcttccatggcttattccctagtggatggcgcctcctctcacctcttctcctttgtcttccgctgcatctccatggtggaaaatcaccattaa

SEQ ID NO: 31347 - DNA, 243 bp, Glycine max
  Peptide Sequence Number=SeqID_123032
atgtcgcaacgtgcccttcgtgggcgagcgaggcgaggctcatgggtgtgctttccaaaggaggaaagatgcgcggagtcaccaccaacgtttatttgtggaaaacgtcggaaaaaccgaaggaaaccggtcgaaataaaaattctaagttcgggagttgtatttacgtttgagaaaggtcgacaaaagcggggctcttgctcctacgtaccctccatcaaagaggaaatcagacctacgtaa

SEQ ID NO: 31348 - DNA, 216 bp, Glycine max
  Peptide Sequence Number=SeqID_123033
atgtcagtgaaaaacctcgtcgggagcctaggagtacatgacaagacaaaccacagattagcaagtcaagtcactctcactagaatgctccaaccatatgggatcaacataggcttaaaggagcactcaaaccgtgtgacccccaaggcctacactccgaagagtccgtcagggcctctccctcctgattcaggtccaacccagaaaatattttag

SEQ ID NO: 31349 - DNA, 212 bp, Glycine max
  Peptide Sequence Number=SeqID_123034
gatcatgagcaactagacctagtacttcgcttacctttggctttggacttggtcgcctactggtcggccatgtggtggcggtgtgtctattgcccgctaccggccatcccaatgctgctgtggtgtttcgccctgcgcctgcctggggacgcagtacttcttgatgaaagctcgatcagtagggggcctgatgcccttgctggaggttacag

SEQ ID NO: 31350 - DNA, 476 bp, Glycine max
  Peptide Sequence Number=SeqID_123035
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaacatgtgactggtattgttttcggcaatgtcattgacttcacggagaatggtgctgccagtgtggtagttgtgcttgaaggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 31351 - DNA, 576 bp, Glycine max
  misc_feature (562)..(562): n is a, c, g, or t
  Peptide Sequence Number=SeqID_123036
atggagagaagtatgatagatgctgccagtggtggagcccttggagacatgactcctgctgaagccagaaatttaattgagaagatggcctcaaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtacctatcgcaagggtttgtggtttgtgctcctctgctaaccaccatacagacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgctgctggcccaagcagaccatacattcctccancaatccaacaatag

SEQ ID NO: 31352 - DNA, 1077 bp, Glycine max
  Peptide Sequence Number=SeqID_123037
gaacccaagctgaggccatacaactgccagcacgattgaggaaagaggtcgatcccttcaccttggaacaggcgaatctgatcattgccgagctgtacaagcaccctcattggccgggtcagatctatgcagcgttctccgaattcatgtatttcacaggcctacgcttgtccgaaggcctggcattgacatgggatgcggtcgatacgaccaagaagacagcccacggccttgcacgccttggagtttgccaagcagtacgcagagcgacgcaggccgggcaaagggcatttcaccgaatcgccgttcgtcttcccgcctggaaagaatggggagtacgtcaagcagacgtcggacctgcaccatcagtggcgcctgtcctcaaaggtttggggatcaaataccgcaccccgtataactgccgccacacctatgcgacaatatgcttaatgtctggtctcaaccccgcatttatcgcccaacagctcgggcatagcgtgcagatgctcttatcgacttatgcgcgctggattcactcgtccaacgactggcaggagctggaaaagctccagattggtccggaactgctccttgatctccaccgcaacatcaccatgcagttcggctccaagccgctgttcgaaaacgtttccgtcaaattcaacaacggcaaccgctacggcctgatcggcgccaacggttgcggcaagtcgaccttcatgaagatcctcggcggtgacctggagccgtccggcggccaggtcatgctcgagccgaacacgcgcctgggcaagctgcgccaggaccagttcgcctacgaggaattcaccgtgatcgacacggtgatcatgggccacggccagctgtggaaggtcaaggccgagcgcgatcgcatctactcgctgccggaaatgaccgaggaagacggcatggccgtcgccgaactggaaaccgaattcgccgagatggacggctacaccgccgaatcacgcgccgcacttcggcccgatgagcgaggtggctccgggctggaagctgcgtgtcctgctggcccaggcgctgttctcggacccggac

SEQ ID NO: 31353 - DNA, 651 bp, Glycine max
  Peptide Sequence Number=SeqID_123038
atgcttcttagagaaaccattcgcaagaccagggttttatttcacaagaccctccgaagcttcaagtctgtcatctttggagggtaccaaaaacttcccagatctctctccttcaatcctttcgtcggtcgaagtggaaatgcaagaacttacacaagcgagcaattctacaatgagttttatgacatgctgcagtctgatctgaacagaataaagaggagtgatagcaatagcatgagcaggtcgagagagcatgcaattggagatgctgtgaacactgaaattcttaggaagcaaagttcacaaaaaagcattgctgaagagggagtagtagtggaagagaagaaaaacaaagggagctgtgaaatgggaaagaaggaatgcttgaataattcaaaaagcatgaatgagggagttcatgatttggcggaaaagatgaaggaattggagatgatggatacgggtgatgttgagcacgagctagacattgaagaggcactccactactattcacgtcttaaaagtcctgtttatttagacatcgtggacaagttcttcatggacatgcactctgaattctctgttcaagagtcctctatcagtgtcaaacgctctaagtcaaagggaaggcctgactcaatcaggttgtag

SEQ ID NO: 31354 - DNA, 302 bp, Glycine max
  Peptide Sequence Number=SeqID_123039
gccaactaagcggaccatgtctcgctaagccacctatcgcttctaggaaacgtaaaagtattggttcaagacccacagcgcaatatgacacaaggagattctcttccttagatgcttggaccagatacacagataatttcttggggagaaacattttaccagagaggaaagtagagatatatcactctgagctagatgagtttaaggctgaattggagaggcgtaatttccataaacgcctcaccaatttagtcgatgggagcatagacctggctttggtgaaagagttctatgcaaattaa

SEQ ID NO: 31355 - DNA, 420 bp, Glycine max
  Peptide Sequence Number=SeqID_123040
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaagccggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 31356 - DNA, 511 bp, Glycine max
  Peptide Sequence Number=SeqID_123041
caacaaacccctattgaattattcggtcctactcgttatcaatgggatcagggatactttcagcaagaaatatatcgaagagttggtgctggactagccgaaaatcaaagttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattggtccgaggggttggtttacttttggacatagcttcttttgctctgctatttcttttcgggcacatttggcatggtgctagaactttattcagagatgtttttgctg

SEQ ID NO: 31357 - DNA, 543 bp, Glycine max
  Peptide Sequence Number=SeqID_123042
atgggtgaagcagaggaggtgcaagagaagatgaaggccgaaaatggaggccataaaagagcaaatggccacaatgatgaaggccatgatgagcatgaagaagataatggaagccaatgcggcaaagatttgggaagtacggatgaccccatgatgtgcaaattcaaaacgagcacgccttcccatcatatggcttgcctcccaactatacaccacccaatgtggcatacactctcaatgaaaatctcaataactcccctccgatactcattgagaaccaatccccctcatcaggcacatatctctcaaaccatgggaaagacacatgaaattccccaccacaatctagctgacttcgagccttggctcgaatatgccactgaagggcaagcagttggtggtataccctttgaaaacactttggagagccctcagtttcgcccacaaccacaaccattgcatttttgcggtgggaagagcccctcctgctatggccgaaaagggaaagacggatcatctaaaggaaaggctcagggccattga

SEQ ID NO: 31358 - DNA, 888 bp, Glycine max
  Peptide Sequence Number=SeqID_123043
atgaattcggttataacagtgttgtatttcaatggaatggtatatgaagataatgatggtgtaatatttgaaggcagtaaaaacgtgattcagattaaacgtggaattagtttcaatgctttgaagaaaaaaattggagataaggtaaatttacaaaataatgaaattatttctgctatcagctgtagatttttagtgtcaggaaaatatattgccttgcaaatttgtgatgacgaagacgttgaaacgatgctggaaagttttaaacaacaagaccaaatgtcagttctggaattgtacatagaaaaggatgtggctggtggttcaatgtttcattctgccaattcgcttacatcatgtggaaattatttatctaatgatgagacacaaccgacaacaaatatgagcaatttacatattgacgaagacgatgatgatgatgacgatgattatgttgtgtctaactcatacgttgaagagtctttagacgaagatgatagtcttgacggtatatctgatacagacgatgaagtcaccgacattcctcaaccagtaagaattgttcacccagcagaaggtgcacaacgaattgaaaatccattttggaatgatgctttacattataacaatatcaactggagttatcctgatgaggaggacatttgcggtttggagatgccgtcgacttttaatgttggccaagaattatatgttggcatggaatttgatagtaaagatgcggtcaaaaatgcagtcaaacaatatgttatgaaggtgcatcaaagcttcaaagttgttgaaagcaaaacgaacaagtatgtggtttgttgtgtgaataaaaatgcagagtgtccttgccctttctatatgagggccaattatatctaa

SEQ ID NO: 31359 - DNA, 294 bp, Glycine max
  Peptide Sequence Number=SeqID_123044
atggttgaggagacatccattgaatctgatgtaagctccattggagcttcggaatggagaaggaagagagagaggagatgccacttcaaggagaagatgagtctagaagaagctcaccaccataggaggtcatggataagagcttggaggaagaaggagatgaatgaagggagagggagagaagagcacgaaattttgtgctctaaaagagctctgaaatctgaatttaatattcaaatgatcaaacccactaatccaagatcaattccaagattctccactaagtgtgcttag

SEQ ID NO: 31360 - DNA, 234 bp, Glycine max
  Peptide Sequence Number=SeqID_123045
atgaacaaagatggtgtcaactccaaagctaatgcagtaaaaagggttgaagatgaagatgacttgtttttggcaacaaacgatgaggttgctaaaacaaaatggagatcagagatgtttgacactttgaaaactgatggagaattcgcctatttcaagttagggaatggtggaaaaatgaaggttgaaggtataaggagcgtgaggattaagcttcatgatggtgctatttga

SEQ ID NO: 31361 - DNA, 315 bp, Glycine max
  Peptide Sequence Number=SeqID_123046
atgaccggccctctcgatgagtcgatctcttgctttctcataagggtggacccttgggtacttgtacctatcaccttgagaggactacacgtcctcgccatcagagggctgcacgccttcgcctccagaggactacctgtcctcgccttgagagggctacacgccctcaccttggggctgcacgccctcaccttcagaggactacacgtcctcgccttgagagggctgcacgccctcaccttcagaggactacacgtcctcgccttgagagggctacacgccctcaccttgggtactagttaccctcaccagtga

SEQ ID NO: 31362 - DNA, 168 bp, Glycine max
  Peptide Sequence Number=SeqID_123047
atggcagcggaatggagaatgaagagagagaggagacgccacttcaaggagaagatgagtctagaagaagctcaccaccataggaggccatggagtatggtaaggactgaaaacccctttcctggccatcttcccatgagagaatatagttcctcaccaactcaatga

SEQ ID NO: 31363 - DNA, 618 bp, Glycine max
  Peptide Sequence Number=SeqID_123048
atggttctgaaagaggagttaattgcttgttcaatgtccaaaagaagcttgtctcagcatttatgcgagacggagaccaacatgctagctatcatcgccaagtaccaagaagagttaggtctagccacggcccacgagcatagaatcgcggacgagtatgctcaagtatacgcggaaaaggaggctagaggaagggtgatcgactctttacaccaagaggcaaccatgtggatggatcggtttgctcttaccttgaacgggagtcaagaacttccccgcttgttagccaaggccaaggcgatggcagacacctactccgcccccgaagagattcatgggcttctcggctattggaaaaacaccataactaaacgcgctgcaaggtatccctatcgcaccagatccaaatctagaacgatgggtgatcaagaggagatgcaggaacagatgaaagccgacatgtcagctctgaaagaacaaatggcctccatgatggaggccatgttaggtatgaaacagctcgtagagaagaacgcggccactgccgccgctgtcagttcggctgccgaagcagacccgactccttggcaactacgcaccatcctccctcaaacatag

SEQ ID NO: 31364 - DNA, 513 bp, Glycine max
  Peptide Sequence Number=SeqID_123049
atgggggatcccatcagcagactctccttccctgaaaacaccgagactttttcaagtctcacaagttatccagaactacgtaggtctgaattcctcattggaggatacgtaggagcaagagcctcgcttttgtcgaccacaccgccttttgttgtcatgactcaagagctggtagcccgcggagataccttacggttatccgcacccttttgtcatccagagccggcgggcccgatgacaagcagagaccaagcggcgggcccgatgacaagcagagaccaagtttggtcattctgcacccatgatacgcagagataccttatggttattcgcacccttttgtcatccagaggcggcgggcccgatgacaagcagagaccaagcggcgggcccgatgacaagcagagaccaagtttggtcattctgcaccccgactacgcggagataccttatggttattcgcaccccttttgtcatccagaggcggcgggcccgatgacaagcagagaccaa

SEQ ID NO: 31365 - DNA, 48 bp, Glycine max
  Peptide Sequence Number=SeqID_123050
atggtcgggataagctcagttggtagagcagagggactgaaaatcctc

SEQ ID NO: 31366 - DNA, 474 bp, Glycine max
  Peptide Sequence Number=SeqID_123051
atgtgcagtcatctgaaggcggggacgtgtatctctcttaaggtgaggacgtcaagccctctgaaggtgaagacgtgcagtcccctgaaggcgagcatgtgcaatcctctaaaggcaaggacgcaaagccctcttaaggcgaggacgtgtagtcctctgaagacgagggcatgtcaccctctgaaggcgagggtgcgtagccctctgaaggcgaggacgtgcagtcctctgaaggcgagggcgtgcagccctctaaaggcaaggacgtgtaaccctctaaaggcgaggacgtgtagccctctgaaggcgagggcgtgtagccctctgaaggcgagggcgtgcagccctctgaaggcaagggcgtgcagccctctaaagggaaggacgtgtagccctctaaaggcgaggacgtgtagccctctgaaggtgaggacgtgcagtcctctcaaggtgagggcgtgtagccctctgtag

SEQ ID NO: 31367 - DNA, 822 bp, Glycine max
  Peptide Sequence Number=SeqID_123052
atgtcttcactgcttgccaaatgtcagacgccgaacgccgaggggcgtattcagcacgtgacgccggaaaatgccgggtggcgctatgtcggtttcgacgtttatcgcctggccgccgggcagtcgctgcagctggagtgcggtgacaaggagctgtgcctggtgctggtggccggtatcgcctccgtcgccacgctgcgcgccgaatacccgcatatcggcaaacgcatgagcccgttcgagcgcacgccgccttacgcggtgtatgtgccgcaccacgatcgcatcgacgtgcgggcagaaaccgatctggagctggcggtgtgcagcgcgcccggcagcggccacctgccttcacggctgattacgccggcggatatcggcgtggagcggcgcggcaaggggcgcaaccagcggttggtgcacaacattctgccggacagcgagccggccgacagcctgctggtggtggaggtttacaccgacgagggcaacaccagttcctacccgagccacaagcacgatcgggaagactcgccggacgaaacctatctggaagagacgtattatcaccgcattcagccggagcagggattctgcatgcagcgcgtctataccgacgatcgcacgctcgacgaatgcatgccggtctacaatcgggacgtggtgaaagtgccacgcggttatcacccggtggcgaccctggcgggctacgacaactattatctcaacgtgatggccgggccggtgcggcaatggaaattcacctgggaaaaagaccacgcctggattaacggcgacggctaccccgccgcgcaatag

SEQ ID NO: 31368 - DNA, 240 bp, Glycine max
  Peptide Sequence Number=SeqID_123053
atggaatctctaccactgattgtttttggcagccccaaaacaaaatccatggataaatcaatccaaggatactccggaattggtaatggaggaattgctctaggaattccacccacttcgcatgcctttttgatgcaatcctaccccccaaggatattggatagaagactccaagaggcttgggctagagctactaaagaaggccctagggttctcatgaaccttagggtagatttttga

SEQ ID NO: 31369 - DNA, 84 bp, Glycine max
  Peptide Sequence Number=SeqID_123054
atgcatattgttgtggtacttaggaacggatgcaactggggatggggtcacgaccgactgatcgtcgccccttctctacgctaa

SEQ ID NO: 31370 - DNA, 279 bp, Glycine max
  Peptide Sequence Number=SeqID_123055
atgtggagccatttgaaggagaggaagtgcagccctctgaaggcaaggacgttgtcacaacttacccttcggcgggagggcgacgcgagggctcacaggagcgtcttccaagaaaggaaaatgcgcggagtcgccaccaacgtttattcgaggaaaacgtcggaaaaactggaaagttgtggtctacgaactttaagtgtgaaaggtccgggagttgtatttacgcatggggaaggtattagcaccccacgcgtccgtcacaaaggacggcaaccttga

SEQ ID NO: 31371 - DNA, 456 bp, Glycine max
  Peptide Sequence Number=SeqID_123056
atgacccaagagctggtagcccgcggagacaccttacggttatccgcacctcgtcattcagtgaccccaagtgtgattgatgagcagaggccaatgtggtcatctgcgccctttccggagatgtcagcatcttccagtggagactttttcaagtctcacaagttatctagaactacacacagtcgtgtccgatggcacgcagagacaaattatggtcattctgcacccttttgtcatccagaggcggcgggcccgatgacatgcggagacaaattatggtcattccgcacaccttttgccattcagacacagtcgtgttccgatggcacgcagagacaaattatggtcattctgcacccttcgtcaatcgcggccgacatgcccgttgacacgcggagatttacatcatcttccgcacttacaagatctgtcatactgaattttgagtcacgctga

SEQ ID NO: 31372 - DNA, 345 bp, Glycine max
  Peptide Sequence Number=SeqID_123057
atggtttatggcataaacttgaaaatcctgatgagtcataataacagcttccagaattgccccatgtatggtgttgcttgtcaatgttatgattcaacaagcgattctcctcccctttcagccagcccgtatcaattagccctcacactttatgcttcggggtcatacaatgctcaatggaatgcccctgggctcctccacgataagcacacgttgcgttcgagtcgtatcctcagaaaaatggaggttgaggaaccttggttggggctttttgctgcaaaattcctttttgttggtgtttttttggtttgtgctaaaggtggtcttcgtcgtgggatcctctag

SEQ ID NO: 31373 - DNA, 222 bp, Glycine max
  Peptide Sequence Number=SeqID_123058
atggatccatttatggtcacttcaaagggcaacgaggtcttagacaaggggatcctttctccccttatctgtttgaagtacttttccagagatatgagcagtctcaaggatgatgccaattttaaatttcatcccaactgtgcagggctttccatcagctctgataaatctgtcatatactcagctggtattaggcctcatgagctttctcatattcagtag

SEQ ID NO: 31374 - DNA, 436 bp, Glycine max
  Peptide Sequence Number=SeqID_123059
gaccaagcccatggaattttgggggttgcaccttcaagacccaaggaagataagggtaagaccatagagaaatacacccctaagactagttcccaagaaaggactagcaacattaaatgcttcaaatctcttgggagaggtcacattgcctctaaatgccccacaaagaaaaccatgatcatgaggggtcaagacatttatagtagtcaagaggagactacttcttgcccttcctctagtggaagtgaagatgaagtaaggggtgaagagtctagtgaggaagtatacccccatgaagaaggtgacctcttaatggttagaaggctccttgaagcgaaggcgaggctcacgggtgcgctttccaaaggaggaaagatgcgcggagtcaccaccaacgtttatttgtggaaaacgtcgggaaaaccgaaggaaaccg

SEQ ID NO: 31375 - DNA, 315 bp, Glycine max
  Peptide Sequence Number=SeqID_123060
atggggagcttcacagattcagcatgggaatggaacctctcttggagaaggcccctatttgacaatgaggtagcctcgactgtaggttttttggaagatatatctcacactgcactccaacaacatgcagcagacagctgggtatggaaacctgaatccaatggatactattcttctaggagtgcctacattctgctgcaaaggaactcagaggagggaaacatggatgatatattcaaggacttatggaagccaatgatcccagctaaagcatcaatttttgcagggagggtaacaccagctgcggttttgtaa

SEQ ID NO: 31376 - DNA, 456 bp, Glycine max
  Peptide Sequence Number=SeqID_123061
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggccaaggttcaaaaaagtctaaggttgtgtctcaatggggtcttttatcgtgggagcccgatcttgatatctggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 31377 - DNA, 372 bp, Glycine max
  Peptide Sequence Number=SeqID_123062
atgtgtatcagtacgaaatccataaagtttcgaaaaggaatcagcataaaggacacaaaagggatgtatttagattctctcgaaagtagtgaggaaaattttttccgtggaaaacatccatgccgaggtgcttccgtaacgctttcgagacttttccgtgagcgatttcgtgaagattcttcaccgttcttcatcgttcttcgtcattcttcgttgttcttcggtcttcaaccgaccacaccttttcgggttttccaacattttcctcgaataaacgttggtggcgactccgcgcatttttgtttcttggatgacacacccgtgagccccgcgtcgccttcccgccgaagggtaggttgcgacaattggtaa

SEQ ID NO: 31378 - DNA, 264 bp, Glycine max
  Peptide Sequence Number=SeqID_123063
atgccgggagcagacaagcccgtcagggcgcgtcagcgggtgtttgacgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 31379 - DNA, 186 bp, Glycine max
  Peptide Sequence Number=SeqID_123064
atgaggaagagtggaggaaaaggtcaaacaacccatactcctcaaggcatgataatctggttccttcttaaacagaatgttgaagggaaaattgatgaagagtgcctatggaagccaaaaaacttagtgagaacaagctctttagcattatcagatttgaggcacttgatggaaacaccaagctga

SEQ ID NO: 31380 - DNA, 521 bp, Glycine max
  Peptide Sequence Number=SeqID_123065
ctgctagcaaacaatcaaaccaccgctaccagcggtggtttgttcgccggatcaagagctaccaactctgcttccgaaggccaccacttcaagaactctgtagcacggcctacatacctcgctctgctaatcctgttaccagtggctgctgccagtggcgataagtcgtgtcttaccggcgccacgcttcccgaagggagaaagacgtataggtatccggtaagcgccagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 31381 - DNA, 360 bp, Glycine max
  Peptide Sequence Number=SeqID_123066
atgacccctgctgaagccagaaatttaattgagaagatagcttcaaactcccagcaatttagtgccagaagtgatgctattgtcattagaggagtgcatgaagtagccacgaattcatcaggtgagactaagaagcttgaaggtaaactagatgccttggttaacctggtaacccaactggctatgaataaaatatctgcacctgtcgccaaaatctgtggtttatgctcctctgccgaccaccacacaaacctctacccttctgtgcaacaatatgaagcaattaaacagcctgaagcttatgctgcaaacatctacaacagacctcctcaacctcagcagcaaaatcagccacaatag

SEQ ID NO: 31382 - DNA, 204 bp, Glycine max
  Peptide Sequence Number=SeqID_123067
atggctcgcacccatattccagtggaagcagagatatttacacgcgattctcctcaaatttcagccagcccgcatcaattggaccttgcaccttacgctttgaggtcatacagtgctcaatggaatgccccggggcttctccatgacaagcacgcgttgcgttcgagtcgtatcctcggaaaaatggaggttgaggaaacctag

SEQ ID NO: 31383 - DNA, 326 bp, Glycine max
  Peptide Sequence Number=SeqID_123068
ctgtctctagaacatttccattggatttaatgatgaaatttgtgcaatttcagttgagcttagctcatcagtgggctaagcgcgcatccaccgataagcgcagcttcagtgcacttagcgcgacagaagaatctggcagagcatcaatatcaagaccgcacgctaagtgcgagatcagtgcgctaagcgcaggagttgtcttcagccaggctcagcgcacgactggcgctaagctcaaatccacttatgcggctaagcacaagggtggcgctaagtgcaacgtcgcgaattcaagcctatttaaagcctgtcttgtgcaaaattag

SEQ ID NO: 31384 - DNA, 336 bp, Glycine max
  Peptide Sequence Number=SeqID_123069
atggtggaaccatcgaagaagcgcaagggttctttgagtagaagccaacggcactccgaggttcaggatactccatttcctcctcctcattattgtcatcagaagaacaacgtacatgccttttattccaaccttgaaattcaagaaagtaccttgatttctgaggtctatgggataaagatggtcattggccaatcccacttctatgatttgacccaattgtctagtgatggtgtaccatttgaaggtgcactggatgatgattggaagtttgatttttctgtgcatgatgcccgccaattggtttgcaccaaccaaagcggatatgaccggaag

SEQ ID NO: 31385 - DNA, 432 bp, Glycine max
  Peptide Sequence Number=SeqID_123070
atggataacgaagagggagtgcaagaacagatgaaggccgacctatcggccttaaaagatcaaatggcttctatcatggaggccatgctaaaacttcaaaaaactatagaagataatgctacggcggccgcttccaatacagctagggaagcggaaccgggaagagatgaaggagatgcccatttaggccctcctacttccctcaaggaaccattcccccatgagttgccccaaccaaacatagtccgccacgtctcgtctccatccgcacttgttaaggaacttgttccctttgcaaaagacatgggaaagattgatctacttgaagagaggctgagagcggtagaaggcctcggcaactatccgttctcggatttagcggatctgtgtctggtacctgacatcatcattcccccaagtttaaagtactag

SEQ ID NO: 31386 - DNA, 297 bp, Glycine max
  Peptide Sequence Number=SeqID_123071
atgctttatagggaagaaaaaaaaaatttgaacgaagcaaatcgccaccttcactggcgatttaccctgtgcctgcaacctgcaccatcacagctacatagctgcactgctaggctatgtctgagcaccctgcaaaggcaacccgctagtcaaactagcggtttccaaaaccaagcacagactcgtcagcatgggtggcgagttcaggcttctatggattcgccagtgacattgacgttttccttgccacgtgggagatgttcagcaaactcgccattgccaatggcggtttgctaa

SEQ ID NO: 31387 - DNA, 858 bp, Glycine max
  Peptide Sequence Number=SeqID_123072
atggctaagtttgaccctgaggtagtcctggagttttatgataatgcttggcccacagaggagggagtgcgagacatgcgttcatggctgaggggtcagtggattccctttgacgcaaatgccctcagccagttcctgggtgacccgctagtgttggaggaaggccaggagtgcgagtttagccagaggaggaacagggccgatgggttcgacgaggaggccattgcccagatgttatgcacaccggggcaagatttcgcctggatcactgcagggaggcgggtgcggatcatgcgcaccagcatgaccaccttgacccagacgtggatgacattgctgctcagcaatgtcttgcctagtgatcacaactccgatctccctctgccgaagtgtcagttggtgtatgccatcctgacaaggatgagcgtccatgtggcccaggtgattgctgacgccatctatttatttgcaggtatgccacccaccaggcactctctagactcggataagtctaacagggccctagggtttccggcattgatcacgggcctctgccagtcattcggggttcccgtcacccctagtaaggtgatcagaccgccgatcacccgggccttcatcgagaagtattgcatgcctaggcaggcgcagggtgatgcacctcaggccgcagacgcaccgccaccacctcatcaggccgatcctgctagatcactaggcatagagcgttatctacagcacttggttcgccaacaggcggtcaaccaccggggcaggtgcaaatacatgagtgtctctaccagttcagcctcagtcagcaagggcagggtttcgctccttttgcatgccctactctag

SEQ ID NO: 31388 - DNA, 132 bp, Glycine max
  Peptide Sequence Number=SeqID_123073
atggaggctcaatcccttctccgtctctttggcgtttgggaattctatcggagcagtcagagaaaaaactggaggagtcttaaggaatctctagagacgctgctatcgctgtcagaagatacggatccttag

SEQ ID NO: 31389 - DNA, 208 bp, Glycine max
  Peptide Sequence Number=SeqID_123074
gttaaagtcattttgtatggaaggtgaacgagaacggatgagtgaacaaatcatggtattggaaaacaagttgttggaagcactagattggaaatttatgcatgaaacagatctgaaaaaaaattctgatttgatgatcgaagatgtacataatgatggtaatctcatctccaaacaggttttcagattagcagtcacttttcagtga

SEQ ID NO: 31390 - DNA, 207 bp, Glycine max
  Peptide Sequence Number=SeqID_123075
atggtggtgagcttcttcttgactcatcttctccttgaagtggcgtctcctctctctcttccgttctccattccgctgccattaatcttccaagaagcaaaggaatccattgatgaagaagatcctaggcctacaagctccaatggagcttacatcatgtggtatcaagagcatcttcatctaggttctatcatttttcattcataa

SEQ ID NO: 31391 - DNA, 772 bp, Glycine max
  Peptide Sequence Number=SeqID_123076
ggcagagattaatataaagccatggcatattttgttgggagaattgaaagaaggcactacgaggataccatggctgaacagagagccttatgctcacaataaagccacatatatagcttccttcttgacaaatgaaaattttgtttcaggattggtttcgagaattacaagaggggttcaacaaatcagacttgccaaatataaggtgtacattgaaggttctgcttggtcagtcagtcaaaaatacattctgtcatgtgactctaccactctacttgtaaaacctaaatactatgattttttcacaagaggactgattccagtacaccaccattggcccataaaggacgatgagaagtgcagatccattaagtttgctgtggattggggcaataatcacaaacaaagggcacatcaaattggcaaggtggcgagtgatttcattcaagaagaggtaaagatggactacgtgtacgactacatgtttcatctcctgaattcatatgctaaactcttcagatacaaaccctccataagtgttaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacatcacagagaaaggaaagctcaattcaacaagttgaatcatgggagaaaagttactgggataatcaaaccataacatcttaa

SEQ ID NO: 31392 - DNA, 261 bp, Glycine max
  Peptide Sequence Number=SeqID_123077
atgaagaaggagattacatcatggcaattggcaaatgctaagcttgcaggggtcggtggcagactcaagaataatggaatgtgtagtggcttagtcccatacctccattgcagttcagttgtgcctgagcttgcttccctatttttattaattttgttcatgtatatgtgtgagttgaaactttctgctgaggaccaaaagggactaaaaagaaaaattatcacaactatcaagactaaaagggtagttaaaccaaaataa

SEQ ID NO: 31393 - DNA, 518 bp, Glycine max
  Peptide Sequence Number=SeqID_123078
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaacgctgcgccttatccggtaactatcgtcttgagtccaacccg

SEQ ID NO: 31394 - DNA, 567 bp, Glycine max
  Peptide Sequence Number=SeqID_123079
atgaatcaacaggcggagcaggaatggtctgggtgtatccaaattgccgcacgaccctctctagtcggtaatacacagcaacaggcccccaacgcaagagaccagaataacatgaaatcaaatggaagtctcagaccggtcggtgctccccatatgggatccaacagacatctggaatccggagttggtccaggcgctccttgtacgccggtgcacgcggtgaatcctcgtcgtagtcctgatcagcagttgactccgcgactgagggaaagtgcttgtatatccagtactacagagcagtgtgatgtactcgctaggctgtcagctactgttgatagaggcatcgttcagctggtcgtacatatgcaccaacgcagctactacctaggcgtacctcccggtctgactgagcaaatagagtgcaacccagaagatgaagaagatatgcacgagccgcagctgtccaataacctgcctgacatcggtgctcgtagatatcacatacccattgcaggcgtacgtacggtccacgacactgccctgtctcagccctggcagcctctctag

SEQ ID NO: 31395 - DNA, 532 bp, Glycine max
  Peptide Sequence Number=SeqID_123080
gtttatgaatgattggagtacaagcattggtttttctccagtgtacggtttccttgagccccagtctatacgctgcataaaggacacgcgtgaagaatgtcaaaagtacatagaaacgtgggtcaaggagtcacatcgagaaatctacttaggaccttacttcaatcaggcacattggcaacttcttgtgttgtgtccacgagagaacattatagtatggttatgttctatacgaagaaagcctgatgttcacattaagtttgcagtgaacaaaaaatatgcagtaatctccaaggcaaggacaatgcacctccacctccaccttaatggattgaggctaagccatgtacaacaaggaggatatgagtgtggatattatgtgatgcattggatgtggtgcatcgttagtgccggtttgaaaaatgaactccacaattatttttcagatggaacagcattagacactgacaccatgacgacaatacacaagaaatgggcagcctattttctagaagttggaaaatggatgtaa

SEQ ID NO: 31396 - DNA, 697 bp, Glycine max
  Peptide Sequence Number=SeqID_123081
ggccttggcaggtcaaaacaagtggcttctattcattgatatcctggcacggttaatcttcggagtggtcctctttccaaacgtggatggtttggtggacctagcagaaatcgatgctttcctcgccttccaccacaacaaggaaagcccggtcgtcgccattttgaccgacatatatgacacattcgaccaaaggggggcgccgtcggtggagagcctcacacctttcatcacacggggtttcagtgaccccaacgcaagggtgcttcaaagagtccgcaaggcgtgggaagtggtggagagaaaagacagagaacttaggggaagtagcaacaggaccatcggcggctatcataggtggttaagagcctacacacaaggtctggattggctcccgaagctaagagccgctaaagaggaggaggttgaagccccgaaagaaagagaggaggtgcaagccctcaaagcggagctcgagaaagcccaagcgatcaaggaaaaattcaagacaacagccgtcaaaatccgaagggagaatgacgaattgagggacatcaacacagccactgctaaagccttggagcaagaacccaagagggcctggaaggaagaacacagccgaaataagttccgaggagctttgtggggcagcaacaacgagcttaaactccagagagaagaaagaaaccagtcatga

SEQ ID NO: 31397 - DNA, 1017 bp, Glycine max
  Peptide Sequence Number=SeqID_123082
gtcttcgataatgcaggagccacagcgcggtttgcgcgcgatgcaggtgtagcgcccgtgcaggatcagccagtggtggcaatcgaccttgaattcagcgggcaccaccttcaacagcttctcttccacctgatcgacgttcttgcctggcgcgaagtgagtgcggttgcacacccggaagatgtgggtgtccacggcgatggtcgcccagccgaaggcggtattgagcaccacgttggcggtcttgcggccgacgcccggcagcgcttccagcgcggcgcgatcttccggcacttcgccgccgtgcagctccagcagcatgcggcaggttttgatcacgttttcggccttgctgttgaacaggccaatggtcttgatgtactccttgacgccatcgacccccagcgccagcatggcggcgggggtgttggcgaccggataaagcttggcggtcgccttgttgacgctgacgtcggtggcctgtgcggacagcaataccgcgatcagcagttcaaacggcgtggtgtacaccagctcggtggtcgggtgcgggttgttgtcgcgcagccgggtcagaatttccagtcgcttctgcttgttcatcaggccttctcagcacgtccttgttccagcagcggttccaccgccacggcgcgggctttgcgcgccttcattttttcgtcgatcagatacttgaccgccagcagcagccccaggccgataaaggcgcccggcggcaacatggccagcaggaatgggctgtcgaaatgcaccacttcgatgcgcagcgacttggcccagccgcccagcagctggtcggcgccgtcgaacagcgtgccgttgcccaacagttctcgcatcgagcccagcgtcaccatcacgccggtggcgccgaggccgatcgccagaccgtccagcgccgagaggccgaccggttttcgcgccgccaccgcttcggcacggccgaccacgatgcagttggtcacgatcaacggaataaagatcccgagcgactga

SEQ ID NO: 31398 - DNA, 228 bp, Glycine max
  Peptide Sequence Number=SeqID_123083
atgcagaacagcagggtcaccctaagggctgaatctcaacactttgcaagtgtcaatgacgccaatccctatgtagcttcgatcccttactttgggttcattgatgaaatttgggagcttaactatgtgaaatttacgaacaagctagacaagtattttacgtgcaagacccttgtgatgacaggtggtgcgtggttctgcagggcaaaacaattggtgtcactgtag

SEQ ID NO: 31399 - DNA, 147 bp, Glycine max
  Peptide Sequence Number=SeqID_123084
atgaagaaatccaagccaaagcgcttccgtaacgtttccgtgggtgatttcgcgaagattgtcaatcgttcttcgacgttcgtcgttcgttcttcgtcgttcttcggtcttcaaccgatttctaaaaagcctaaaatcaatatgtaa

SEQ ID NO: 31400 - DNA, 651 bp, Glycine max
  Peptide Sequence Number=SeqID_123085
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtcctttgacttggcaaccatgaagcctaatgaagtggatttcactgcaactgctactttggaattgaaaccaagttattcaggaacatgctgctggtgttatggggttgtcctatggtttgatactggatttacaagcagattttgccaagaaacaccagctgtgttatccacatccccttacatgccaagaacacattggtcacagacaatcttaacctttcgagaacctattgcaatgggatttggaaaaggaaacggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 31401 - DNA, 275 bp, Glycine max
  Peptide Sequence Number=SeqID_123086
gtacacgatgaattcggttataacagtgttgtatttcaatgaaaaggaaaatatattgccttgcaaatttgtgatgacgaagacgttgaaacgatgctggaaagttttaaacaacaagaacaaatatgatggtgatgatgatgatgattatcttgtgtctaactcatacgttgaagagtctttagacgaagatgacagtgttgacgatatatttgatatagacgatgaagtcaccgacatgattcaaccagtaagaattgttcacgcagcagaag

SEQ ID NO: 31402 - DNA, 420 bp, Glycine max
  Peptide Sequence Number=SeqID_123087
atggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaaagtgcgtcggtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 31403 - DNA, 82 bp, Glycine max
  misc_feature (11)..(11): n is a, c, g, or t
  Peptide Sequence Number=SeqID_123088
tcttcaagctnagcagacggaacaaaatactttcaaagagaatcttatccatctagaggagatattcgtttatgcagtatag

SEQ ID NO: 31404 - DNA, 222 bp, Glycine max
  Peptide Sequence Number=SeqID_123089
atgagctatcaagctaggcatagtggggaaggatgcgctaagcgccaacatcattcagttttaaagtcattggaagtgcgcttagtgcaggtagtggcgttaagcctgaatcactcactaaagatttttggtgtagcagaaagcgctaagcgccactaccgcactaagccccaaatgcttactggaagttacaacttcaagttgggcttagcgcgaggctag

SEQ ID NO: 31405 - DNA, 183 bp, Glycine max
  Peptide Sequence Number=SeqID_123090
atgagtgaactaccatcaaagagagaaacacgaactggtgacgatggtggtgaatatcatcaactcaatggatctcagcgattgttactagacgtgatgactacaaaaatgcaacttttgctgaaccgtaacaatgaagaactctatggacgaataaaaggattagagcgccaaatgaattag

SEQ ID NO: 31406 - DNA, 250 bp, Glycine max
  Peptide Sequence Number=SeqID_123091
tatcggttggtctgtgccatcccgacatagggatcgcgcccgcaagacacctagtggacccgaagaagtccaacagggtcttggggtttccagctctgattacgagcctctatcagttctacagagtgcttgtcgcccccaacaaggtcatcaggcccctattaatagggctttcatcgagaagtactgcgcccccagcgttgcctacgacacatggccgaccaataggcgaccaagtccaaagccaaag

SEQ ID NO: 31407 - DNA, 1425 bp, Glycine max
  Peptide Sequence Number=SeqID_123092
atggcgagtcaagaagagtgggtcccgtttgcagatatactagctttgctgatctttagggttgtcctctttccaaacgtggacggtttggtggacctaaccgcaattgatgctttccttgcatatcaccatagaaaggagagcccggtggtagctatcttggcggacttatttgatacatttgaccgaaggtgtgagaagaacagcgcacggattgtctgctgcttacccgctctttgtgtgtggttggtttcgcacctattccaacaagacataagacactcgtggccgcttcaaagttatcgcttgtgtgtcgaaaagaaaagactcgattgggaccaatacttggttgggataggaggcagcacaatcaactggtttccacgagggaaggaaggaaatgagggagttcttttctcatgtggggactacccaaatgttccgttgatagggacgaggggttgtattaactataatcctgcacttgccataagacagctagggtaccccatgaggggagcaccaacggaagagagcctctcgcctttccttgtgagagatttcggcacgcaaagtctcaaggttgtacaaagagtccacaaggcgtggaaaagtccgttgaggaaagataaagaacttaggggcatccgtaatggcatcatcggtggttatcatgaatggctaagagttcatacacgagggttagattggctctccaagttgaaaattatcaacgaggagaacttcgaagctccggaagagaatgaagaagtccaagctctaaaagcagagctaggaaaggcaagactcgccaaagaaaaattcaagttagtcgctacagacatccggaaagagtgtgtcgagttacgagaggaaaatgcggctaccgcaagagcccttgaacaagaaaccaagagggctcacaaggaagagcatggccgagataaattccgaggggctttgtggggcagcaacagtgagctcaagctccgaagagaggaaagagaccagtcacgagtacatggcatggtcttaaaggaggagttagctgcttgctcaagatccaagaggagtttggcccaacacttagaagccatggagcaaagcatgctagctataacagggcagtacaaagaagagttaaaccagtctatgacccatgaacaaaaactagtagaggacttcgcacaagcgtacaccgagaaggaagcaagagggagggtgattgatgcattgcatcaagaagcgaccatgtggatggataggttcgcctcttccttaaatggaagtcaagacctcccgcgactactagccaaagcaaaggccatcgccgaagtgtgctcagccccagaggaaattcacgggctaatcaattactgtcaacacatgatagatttaatggcccatataattagaaaccgttag

SEQ ID NO: 31408 - DNA, 237 bp, Glycine max
  misc_feature (224)..(224): n is a, c, g, or t
  Peptide Sequence Number=SeqID_123093
atggctgcatctgacttcccaagagtcttctcaccattcgctatcatgttgcatagcttcctcctcgagctcttcttccacctcttcttcttcactgatttcatattcactggatttagactgtcagaccctaatttcgtttggggactgtcataccctaatttcgtccgggaacctttgctcgatgacgtgcgaccattctttggtcctcgtgaagtgcttgngacccatcattag

SEQ ID NO: 31409 - DNA, 1359 bp, Glycine max
  Peptide Sequence Number=SeqID_123094
atgaaggttcacattaaacagaagcctatgggggcaaagacaggcaaggacggaccgccatgtacgaacgaagcttctcgcaaaggtgtagtggggacatcaaccacaaaatcatatgcagaggcagtgatggcgctgggaaggaagtcaaattcttcgacaaaggaagtcaaccagttcggtaacaacactagcacctgctccacgttttcgttagccatatctgtggaagataaggctcgataccaaaacgcctgggtcggaaggctgaagaacatagcaatttttgaaagattggaagaggaaatggtgtggaatgtgggttcaggcatttcggctagttacatgggcgatgatatggccattctctttggtctatcagagaaaaaagcggcggatattattcgacaggagaaagaacagtcctcctctctgttttactccttgacgaagtggtctcctcaactgagggccgaaaccagacttgtctggcttcgagtttggggtatccctctcctcgcgtggaagacggacttcatgcgtaggatggtggccgcagtgggtgactttgttgacgtcgatgacgacgtggaacacatgcagcgcctagaccgtgccaggatcctggtaaggacgccgcgaccgccgctcatccagcacgttgcgcatgtcctcattgacggagtcagacatcgcattgatatagttgaagaaaacggcggaggggagttaggcgatacccgccatgggaggaacctatggagttcgtctgaagaagtgccttccgatgtagcagacgacgacatggattcagtcatctcgtggccgtcgggaacatttccgcccagggacgctgggatatctgccggcgacactaccgcggactgccgggatgcgcgatcatcacctttgcccgttgggtgttcgcgcgacgtggaccctgcggttaatgacctacctgacagggttttgaccactttatctccatcgggttctgttgttagcccaagtaggaagctttttgaattggccatagctccccagccaacacatcctgcaaccattcacgaatatgtagcggacccagtactcgaatgtcaaaaccttcctcatttatccaatacagtttccacatcttcccccaaagcattttcagatggcccttttgaggagggagatatccccagccctggccgaattttaaaaaataattcccacatcaacggttctcacaccccaccttttgaatcttttgataaacagacccaccaccttaatgggccttgcactcctgtggcccaacaaacggtttctcatagcccccaccagaaacagcagatgttatctagtggcttgcag

SEQ ID NO: 31410 - DNA, 207 bp, Glycine max
  Peptide Sequence Number=SeqID_123095
atgcagttcccgggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 31411 - DNA, 340 bp, Glycine max
  Peptide Sequence Number=SeqID_123096
tgggattgactgggatagcacaaagtacatgattatcgttgaaaatgaaattgcatggaatgaatatgttaagtcacatgaagaggtcaaacgatttcgattcaaagtcattcctaattgggatgatattgttgacctatgtgcaaaggatagagctactggactcggagcagaaaatgcattagatgcagatgatatcatgagcaaagaaacaaatgaagaggaaaaagaagggatgatttcctcaatgaaagaagtagccgagtcattgaaagaatttgttgaagtgacaaagaagaagatggagataaaagaagctcaagaagtggtacatgaagtg

SEQ ID NO: 31412 - DNA, 447 bp, Glycine max
  Peptide Sequence Number=SeqID_123097
atgatatctttaaaggctggtgatgcattgtcgttggtagtccctatcgccgcattgttgttacctaagcggatgatatctttagaggctggaacaaatgaaaacaatgatggaagcgatgatgaacataaggaagatgaggtcaacattgctacaactgttgctgccagtattgctactaagagggactcgactcacccacttggtttcaatcaagagggtcatctagtctcagatgtagtaggtcaaggagacgaggcaacatcaaatgcatatgggccttattatgtccaggtccaaaacaagtcttcctttccattgtatggtttgcctcccaattgtacaccactcactgttgtgtacgctcttagtgaaaatatcggatataccactgaagggcctgcgttttctaatgtccttgtgccaaatgctcccagggacccttag

SEQ ID NO: 31413 - DNA, 243 bp, Glycine max
  Peptide Sequence Number=SeqID_123098
atgtcgagcacactgaaaatgaggacacgtagccctctaaaggtgagggcgtgtagccctctcaaggcgaggagttgtagtcctctggaggtgagggcgtgcagccctctgctggcaaggacgtgtagtcctttcaaggtgagggcgtgtagccctctgacggtgaggtcctctggcaaggtgagggcgtgcaaccctctgatggtgaggacgtgtagtcctctcaaggccgaggacgtgtag

SEQ ID NO: 31414 - DNA, 375 bp, Glycine max
  Peptide Sequence Number=SeqID_123099
atgcatgagaacaaatggcacggagcgtgtttgctctttgctcctattcgggaacctataggacaatatctaggggtctctaataactactccccaacaattcataactcacacggctgttttctagagcggagtcgccaactgttgcaacgtgcccttcgcgggcgagcgaaggcgaggctcacgggtgcgctttccaaaggaggaaagatgcgcggagtcgccaccaacatttatttgtggaaaacgtcggaaaaaccgaaggtcgacaaaagcggggcatttgctcctacgtaccctccatcgaagaggaattcggatccactagttctagagcgatgcgtgaatcaagtgattcttttacttgaggggtga

SEQ ID NO: 31415 - DNA, 576 bp, Glycine max
  Peptide Sequence Number=SeqID_123100
atgggcagtagttcctttaacggttcctgggccacccctgatattggaggagggccaactgtgcgagcacaaccagagagggaggctatcacacagctactatgcataccggggcaagatttcacccgtgcctgcaaagagacgaatatagatgacattgctacttcgcaacatttgcccagcgaccgcaatgccaatctccccctgcaaaagtatcagttggtctgtgtcgtcccaacatggggatcgcacccaagagacacccagtggacccggaaaagtccaacagggccctggggtttccagctttggttacgggcctctatcagtcctacagggtgctcatacccccccgacaagggatcgcgcctgcaagacacccagtggacccgaagaagtccaacagggtcttggagttgtcaagctctaattacgggtctctgtcagttctacagagtacctgtcacctccagcaagggcatcatgccccctactaatcgagctttcatcaagaagtactgcgcccccaggcaggcgcagggcgaaacaccacagcagcattgggatggtcggtag

SEQ ID NO: 31416 - DNA, 669 bp, Glycine max
  Peptide Sequence Number=SeqID_123101
gatggtattctttactctgaggtgcaaaatattcccattgttattgatcagtctttattcttttccttgactaaattgtccagtcaaggtgttccttttgagggcacccttgttgatggctggaaatttgattattctagtcattatgctcgccgcatggtctgcaatgaccaggctgacatgatcggcagattacttgctgggtcattaacttttgattgtcgtatcatgcattatatcattgcattacgggccaatgcacctctgccttatcctcaccttgttactctttttcttcatcatttcaatattcctttgggtgatgaaccatttttcaaggtcaaaaggtctttctctattagtgctggtgcggttacctcctttggttaccgaaagaatgttgatggtcagtgggttcacaaacatgacttacctccgcctattcttgacgagcgtaccccatatcctccaccacaacgagatgattccacttctcttatgactaaagtcctcacagaactcagcggtcttcgagcttttgtgggtgaacgctttaatgtgatggatactcgccttgatgcaatggatactcgctttgatgggatggatacgaggatcactcgactcaaagatgatatgagcttcattaggcgttgcttcaatcccctg

SEQ ID NO: 31417 - DNA, 141 bp, Glycine max
  Peptide Sequence Number=SeqID_123102
atggagctggaacgcttgatcaaaagactctcagacagtggcattgatgatgctgaggaagaagaagatgcagctgaggaagaggaagatgcagcagaagatactgaatcagatgatgatgattctgaagccaccccatga

SEQ ID NO: 31418 - DNA, 189 bp, Glycine max
  Peptide Sequence Number=SeqID_123103
atgactcgggcatactttaagctatgcatggaaaatgtaattatgaaattgagatgcccgaagaaacatcctttcttagttaaacatgcattagaggaaaatacaaggatcatgtatgagcaaacaaaaagtatgttgaacgcatatgatgatgcaatgactcatgcaaaatgtgaggctggaatatga

SEQ ID NO: 31419 - DNA, 249 bp, Glycine max
  Peptide Sequence Number=SeqID_123104
atgtattttcatggtgctcgtttttccaattatgaggcatggttaagtgatcctactcacattaggcctagtgctcaggtggtttggccaatagtgggccaagaaatattgaatggtgatgtagggggagttggtttccgaatggaatacaagctacctaacccctggtgctccccatcaatcaaagggttgggaaaaactctctttctatgggcaggacatcaccaatcacatattaagtacccataa

SEQ ID NO: 31420 - DNA, 453 bp, Glycine max
  Peptide Sequence Number=SeqID_123105
atggcttccagaaagagaaagagtattgctacaaggcccacatctcagtatgacacaaggagattctcttccttagatgtttggaccagatgcacagataatgttctggggagaaacattttacctaagaggaaggtagagctctatcacactgagctagatgactttaaggctaaattggagaggtgtaatttccataaacgcctcaccaatttagtcgatgggagcatagacctggctttggtgaaagagttttatgcaaatttatatagttctgaggatcgtccatcgaagcagtccaaagtcagaggtcatttggtgaagattgatgctgacagtctcaacacattcttggagacacctatggtattagctgaggcagagactctacccgcatactctagatactgtatgttagtgcttagcactactgagtttaaaaaggttggctaa

SEQ ID NO: 31421 - DNA, 292 bp, Glycine max
  Peptide Sequence Number=SeqID_123106
acgatttaaaaaaacatttaatggaagtcaagaccatgaaacagcgccgataccattaactggtgaccaggtcttccagcgggttcaacacctgaatgtgaaaaatctatttgatagtgtcattgagacgttccttaacattcaaggcaagacgaaagatggattgaatactcgtcaagatctagttgagttgggtatacgatcacagttgttgatgagaatcttgaaacatgccaaatacaggctaaaggcccaagtggagaaggacgaaggcccaagtggagaaggataa

SEQ ID NO: 31422 - DNA, 366 bp, Glycine max
  Peptide Sequence Number=SeqID_123107
cttctcgctaagccaatctgtcggcttagcgagccatccgctgagcgcaccactcttgtggctgagcgcgaggaagaatctggaagaaggataagctggacacccatgctaaactggcaaagaactgagagtgaagaggaagtcatcctgagagcattagatgagtctgtgagtgattgtgaggttctaaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31423 - DNA, 222 bp, Glycine max
  Peptide Sequence Number=SeqID_123108
atggtgagtgtggacgaggttgaagatgcagatgctccagttcctgtacccactgatgagttttccttagtggggcaggcacttcacaccttccttgcttggccgacacatctgggaaaactgccagggaaccacattataaacgaaacctcaatgagagttggacttcatcctcaaaaggaaacaacaccagaatatttagccttccatagatttaaatag

SEQ ID NO: 31424 - DNA, 180 bp, Glycine max
  Peptide Sequence Number=SeqID_123109
atgattatgatgactcaagacatttatagtagtcaagcgaagattacttcttccccttcctctagtggaagtgaagatgaagtaagggttggagagtctagtgaggaagtctacccccatgaagaaggttacctcctaatagtaagaaggctccttgaagttgttgtagcacaagattag

SEQ ID NO: 31425 - DNA, 398 bp, Glycine max
  Peptide Sequence Number=SeqID_123110
ggggcggagcctatggaaaaacgccagcaacgcggccttttagcggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctgccacctgacttcacgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31426 - DNA, 279 bp, Glycine max
  Peptide Sequence Number=SeqID_123111
atgggacctctccaaaggcaagccttccgaaaagtgtacggaaagattctagatttgaccgcagcggaggtatttacggaagctgttgtatccctcgcccaatactatgaccagtcgttgagatgcttcacgtttggggacttgcaaatggtaccaactgttgaagagtttgaggagatattaggatgccctcttgggggaagaaaaccgtaccttttcttcggctgtggtcggagattcggcaaaagagttggatcgcatgaagcaaactcgaaatga

SEQ ID NO: 31427 - DNA, 675 bp, Glycine max
  Peptide Sequence Number=SeqID_123112
atggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatttgtacctgtcgcaagggtttgtggtttgtgctcctctgctgaccaccatacagacctttgcccttccatgcagcaacctggagcaattgaacctcctcaacctcagcagcaaaatcaaccacagcagaacaattatgacctttccagcaacagatacaaccctggatggaggaattaccctaacctcagatggtccagccctcagcaacaacagcagcctgctccttccttccaaaatgctgctggcccaagcagaccatacattcctccaccaatccaacaacagcaacaaccccagaaacagccaacagttgaggcccctccacaagcttccctcgaagaacttgtgaggcaaatgactatgcagaacatgcagtttcagcaagagaccagagcctccattcagagcttaaccaatcagataggacaattagctacccaattgaatcaacaacagtcccagaattctgacaagctgccttctcaagctgtccaaaatcccagaaat

SEQ ID NO: 31428 - DNA, 813 bp, Glycine max
  Peptide Sequence Number=SeqID_123113
atgggatcaagtcaaaagccttcgcttaaaaagaggttctatcaagtcaaaatcaagagcttagaggtcactagtttaggagagttggggcaattaatgggtcaacttcaacgggtagaagtctccatggaaccaattgcatccctttcccagtattatgaccagcccctaaggtgcttcacatttgaggactttcagctagtgccgactgtgaaagagttagaagaaatcctgggatgccaactgggaggaaggaagccatatcttttctttgggttctatccctccacgataagagttgcaaggccttggaaaatcaaggcaaatgggctttcttttattgacatcttggcacttttgatctttggagttgtcctctttccgaatatggaagggttagtggacctagcagtgattgacgctttcctcgcctttcatcatggcgaggaaagcccggtcgtcgccattttggccatggatgtgaaaagagcggcgcaagaattgtttgttgtgcactggctctctatgtgtggctggtttcacacccttttctccaagaaggtaggcccgtctatccgctacaaggaaggaagaatcaggattctatcttcacgcgaaggatgtccaaatgttcccttgatggaaacaaggggttgtattaattataatcccgtcctcgccataagacagcttggctaccccatgagaggagtgccatcagatgaaagcatcacgcctttcatcgcacggggtttcagtgaccacaacgcgagggtactccaaggagttcgcaaggcatgggatgcggcatga

SEQ ID NO: 31429 - DNA, 516 bp, Glycine max
  Peptide Sequence Number=SeqID_123114
atgggtgaactagaggaggtgcaagagaagatgaaggccgaaatggaggccatgaaagagcaaatggccacaatgatggaggccataatgagcatgaagaagataatggaagccaatgcggttatagttgccgctactagcgctgtcgctaaggtgaacccgatgctcccatctggcctcaagcaaatgaatcatccaacctcaaatatgcacgacttcctgccatatggcttgcctcccaactatacaccacccaatgtgcgtacattcccaatgaggatgtcaataactccactcccatactcgttgagagccgacaaacccaaactaatcatgcacatgtctctcaaaccgtggaggagacacatgaaattccccaccataatccagccgactccaagccttgcctcggatatgccactgaagggcaagcagttggtgatatacccctgcaaaacactttggaggccctcagtatcacccataaccacaccccttgcattccatagcgattaa

SEQ ID NO: 31430 - DNA, 225 bp, Glycine max
  Peptide Sequence Number=SeqID_123115
atggaagctccaatatctcgtgtgaagaagataagcagaagaagaagaaagcatgcatacgaagaagaagaagaaagcatgcatagctcgcgttttataaaaaaaatttcgaatccctgcacctgcaaatcgcctgcaccaatggcgatttcctctctgcaaatcgcctgcaccaatggcgatttccttctgttgcactgccatggcaggaatggcaggaactag

SEQ ID NO: 31431 - DNA, 636 bp, Glycine max
  Peptide Sequence Number=SeqID_123116
gcgttctcggaagaactcgctaagcgcacctaccacactaagcgagttcatcctttgaggatgaacactcatcctcctgttaagatacttgtggctaacttggctccagctaagccgatatgttatgattctgaggatgcgttgtgcgagttgcatcctgctaagcgcctaatggaatcaagaaagagagcgagaactgaggacatcccttcatcatccaacccatttccttcgacagcatccatggaaccagatgcccaacaagcacattctttaattcctatctcaaattccattgtgagacccaacgaggctgctccacttgagcccacacctgtgcaggttgatccagagccagctgacccacaatctccagtggtgaatccactgtcttctcccgagcgtgaagtggtgcccccatctccacctctaattatcatctccgatgcatcatcagatgaagcggttgccccttctgattcaccagcaggagaaacagctgaccttcctacttccccagttggaggaatctccgatctttccgatccgtcatctggagaagttattgctctcattgattccccagtttggacattgttgacattgttgattcctgatgacacttttcgctttttg

SEQ ID NO: 31432 - DNA, 246 bp, Glycine max
  Peptide Sequence Number=SeqID_123117
atgaagaacgaacgaagaacgatgaagaacggtggaaaacctttgcgaaatcgcccacggaaacgtctcggaagcgttacggaagcgcctcggcttgaattttcttcacggaaacaatttttctcactaattttaagagaaaagagagaggtggttgctgcccagctcacccagacgagctgggttgcttccatcagaaggcactgccttctgttggaacatcctggaaggcccaagtgggcctga

SEQ ID NO: 31433 - DNA, 563 bp, Glycine max
  Peptide Sequence Number=SeqID_123118
agcacttagacgtgtccgtgctgctggagccggtgtcaccatcaaacaatactttggatcggttccacaggcgtcccgcagctcttcctccctgcctcttgaagaattgcagcagctgacccagcaaatcagggaccagctagaggagtccatcacagaaaatgtgatgcgacagctcatggcatcgttcagccagattcctcgagtaagaacaaaggggagttgtgttgatccctcaggaaacaatcctgagacgggtgactcagataggtgcgacttgtacatcgaaacagatcctgcctgcttggttgccctgggcagagtttatgagggatccacttttgttcataacactcctttgtttcctggccaagtaaaggtgggtgtggaggaggttacagatatagatgctccagttcctgtacccactgatgatgcagctgtgtctccggcaaaaccacctcaaaagcccgatccggaggtcgatgatctgctttatctgatgacattgaccatcccagtgcttttcttgaggccttaccagcttacatgggatgccacca

SEQ ID NO: 31434 - DNA, 1009 bp, Glycine max
  Peptide Sequence Number=SeqID_123119
cgcagcgcctgcagaatgctctggcgcttatgcacttcgttcaccgtttctgcacgatgctgacgataaaggttcatcgcagccggcagagaggcaatcagcgcggtctgcgcgctatccccattgccaggcgggcatctttagcctgcgcaaactgatcgttaatgcctttcaactggctgagtttttccgcacgttccgcgatgtcgtgcaggtttttgatgccacaggaagctacagcaatgctgaggataagcagcacaccaaacccgagcatgagttttctgctgactctgatatcttccaaaaaaacacgcgtggagctcgggttttctgttttagaatggtactgattttggcggatagcggtgcgggggaaagtattgacgcaacctgccggtttgtcaaagcgccgggatttcaggcgaagggcccgatagccctcaggccaggcgttgcgcctgaggacattccgctacgcctgaaattctcaggactccgctggctggttcgtcagccactgagcggcgctggtggtggcaatgtgttcgcggtaattaaacgtctcctgtttaggccatgccacaccgtccggacgggcaaaggccagccggtcagccagctctgcgtaagtcagcgtatcgccagcgatataaacaatgtcgttctgaaaagcgggctgatgaaagaagatatcggctgtcagctgcccgatgtcgtcgggcgtggtgagtgtcagggcatagttccagtcgccgagggcataaaccgttttattcccggcatcgatcacgccaaaatcgggttcaaacagatagctggtaaaaataccggtcgaaacaattacccagtcagtgttgctttgggcgcgcagcaggtggcgcacttcaagctgctcatcccacaccggttgcccactctctttgccgataacgtcataatccacgccaaactgccagggaaaatagcgggcgacacccgccttcagcacggcctgagtgattcttag

SEQ ID NO: 31435 - DNA, 636 bp, Glycine max
  Peptide Sequence Number=SeqID_123120
atgcgaagtcatcttaaagacaatgccgagtggggcgatgtttataaatatcttcatcagaaaattgaccttcactgggcatgggataagcagaatctgggtaagtccctgtacgacaattttggttatgaaggggtgtttgttatctcagcggaagggaccacgcgttacagcgtgcttgacgggaaactgaaacgtgaagaactggaaagctggttagataaacccacgaaagcgcgtttactccatgagcttagcctgaaaaatggattaccgatctccatgctcacgcttatccattccgtccccgccattgtttcagccgaatggataacaacgggcgatgatccgagtgtacaaccctcaccgggtaagccgtcagtcatggtctttattgataaattaacggctaaaaaactgctgacgattgggcaggatgccggaataaataatgtacgcgcttcccttaataaagagaatgctcaggcaaataaccagacggcatttactctgcgcacccaaaatggtgatgtggacattatctgggacagtgaaaaccccggtcaggctacttttgacaatttcgatgatggtcatcctcatgcgccatattatgcacaaggcgagaatgcatga

SEQ ID NO: 31436 - DNA, 1116 bp, Glycine max
  misc_feature (950)..(950): n is a, c, g, or t
  Peptide Sequence Number=SeqID_123121
atgaagagtccgagctctaaaattagagctagggaaggcgagactcgccaaggagaagttcaaatcagctgctacacacatccgaaaggagtgcaaccaagttacaagaaggaaacgcggccactgcaaaagcccttgaacaagaaaccaaaagggcccgcaaggaggaatatggctgagagaaattccgaggagcattgtggggtagtaacaatgagctcaagctccgaagagaggagagagatcggtcacgggtccaaaaggagtttggctcaacacttggaagccacggaacaaagcatgctagctatcatagggcaatacaaggaagaattgaaccagtccatggcccatgaacaaaagctagtggaggattttgcacaagtgtatgccgaaaaagaagcaagagggagggtgattgatgcgttgcatcaagaagcgactatgtggatggataggttcgccttgaccttgaatggaagtcaagacctcccgcgtctgttagccaaagcaaaagccatggccgaagaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcaacccgccttgaatccgggcctagggagaaacacggccgtgttcggtcgaacgtatagtccgcaagcttatccttatggcctgcctccagacttcaacccctgtgccaccccggaagatttaagccaagcccttacttttgaggggcaactcccaccttatgaagactatcccgggcaagacgatggggaaggagatacccatcttggccccctgctccacctcaaagatccatccccgcatgaactaccccagccaaacatagtccgccatatcccggnctcacccacacccgtaaaagaatctgttcccttcgcggaagataagggaaagattgaggtgcttgaagagaggttaagagcagtcgaaggcctcggcaatcacccattcgcggatttagtggatttatatctcgtgcccaacatcgtcatccctcccaagttcaac

SEQ ID NO: 31437 - DNA, 235 bp, Glycine max
  Peptide Sequence Number=SeqID_123122
atggcttctcgtaaaaggaaggcatcagcttcagtggcccaggcacgatatgacagatcaaaattcacatctcaagatgcctgggacagatatgcagacaatattcttggccggaaaatccttccggaaaggaatggaagcattgatgtttctattgttaaagaattttatgctaccctctataaccctgaagacaaatcgcctaagcaggggaaagcttaccagcctactccag

SEQ ID NO: 31438 - DNA, 314 bp, Glycine max
  Peptide Sequence Number=SeqID_123123
atgggtgtcaagtacctcgaagtgggaagtaaagataagacactaatttcgttcgagcggaacaccattcggccggtcaatctcctcgccagcgctacctgcaaaaatcttgaaaatgatcagcaccgaacgaccaacatcatcctgatactgccgaattcgttcctctcggttgacacaagggcgcagaatgaccataatttgtctctacgtgccatcggacacgattgtctccgaatggcgaaaagggcgcagaatgaccataatttgtctctgcgtgccatcggacacgattgtctccgaatggcgaaaag

SEQ ID NO: 31439 - DNA, 909 bp, Glycine max
  Peptide Sequence Number=SeqID_123124
atgagcagccacgacgcgctgatggtggccaacggcatcaccacggtgctggacgcggtggcgatcggcgacgtgcgcgacggcggccaccggctggaaaacctgcagaagatgatcgacgcggtgatccacagccagcgcgccggggtgaaccgcgccgagcaccgtctgcacctgcgctgcgagctgccgcacgagagcacgctgccactgttcgaacagctgatggacaagccgggcgtgtcgctggtgtcgctgatggaccactcgccgggccagcgccagttcgcctcgcgcgaaaaataccgcgaatactatcagggcaaataccacctcaacgaccagcagatgagcgagtacgaggagcagcaggtcgccctgtccgcccgctgggccgcgccgaaccgcgaggcgatcgccgcccactgccgcgcgcgccgcatctcgttggccagccatgacgatgccaccgccgcgcacgtggccgaatcctgcgcgctgggcagcgccatcgccgagttccccaccaccgaggcggccgcccgcgcctcgcaccagcaaggcctgcaggtgctgatgggcgcgccgaacatcgtgcgaggcggttcccactccggcaacgtggcggcgcaccacctggcggcgctgggggtactggatattctctcttccgattattacccggccagcctgctggacgcggcgtttcgcctcgcggcggacgagcgcaatgcctacgatctgccccaggcggtgcgcatgatcacccgcaacccggcgcgggcgctggatctgcaggatcgcggcaccatcgccgaaggattgcgggcggatctggtgctggcgcggccgcacggcgagcacgtttacgtgcagaacgtgtggcgccagggcaggcaggtgttctga

SEQ ID NO: 31440 - DNA, 690 bp, Glycine max
  Peptide Sequence Number=SeqID_123125
atgaagtttgtgagaattccaaaatccacttccgcagttctggaaggtgaaagcttactgaacgatgcctcatcgcttattattgtccgctttgctttagtagctataggaacgggacaatttattttccagacggcgattacggatttcttctggatggttataggaggaataggaatcggacttttaggagggtggctttttattcaggctcataaaaggctgcctatggatgcaccttcagatattgtgtttacactggtggaatcctatctgctgtattgggtagctgaacaggcacatagttcaggtgtgctggcggtagtcgccggtggattgtttttatccacccggaggctcacttttctcagtagcgccagcaggatcaaagggctcagtttttgggaagcgctgatctttattttaaatggtatcgtatttatgatcatcggattagctcttccggaaattgtgaaggggcttagggcagatggaattcctttaagaacagcaattttttatggagcccttgttacggcccagtgttgctcccggaagaggtttgagccgccggagaatacttggcttaccgctgttattaggttggacaggaatgcggggggtggtgtcattagccgctgctttatctattccattgaccttaccgaccggagaagcttttccacatag

SEQ ID NO: 31441 - DNA, 267 bp, Glycine max
  Peptide Sequence Number=SeqID_123126
atgggtttagctttttccaggatccacaaaattcagaagaagctcaatgaagtggaggatttagcatctaatagaagcctatctgatgatgagataaaggctaagagagaattacaacaagaattgtgggaggcctcaatagcttatgaatctttattaaggcagaaatctagagggagacaagtggagacatcaactcagatcaagaacaggagacaagtgcaggctctattcagacccaggaagctcttaaaatgtggaaaatga

SEQ ID NO: 31442 - DNA, 378 bp, Glycine max
  Peptide Sequence Number=SeqID_123127
atggttgtgctgggtaatgaggatatcactagtgcatcttcttctagctcttctagttcttctagtgagagtgaaagtgattgtgatgtacaacccctttgcactaatgtagctagccaaagattgattgaaaaacttgctttgaaaacttcccctcaccctaggcctaacaaactacaatggttgagtgagaatggggagctagttgtagatagacagtccctatggaggctagccatctcttacttggaaggccttggcagtatgatagggatgttgtccgcaatggtgtcacagacaaattttcatttgtacataaagggaaaaaggttacccttaaacctttgtctccaagtgcagtttgtgaggatcaaataa

SEQ ID NO: 31443 - DNA, 159 bp, Glycine max
  misc_feature (25)..(25): n is a, c, g, or t
  Peptide Sequence Number=SeqID_123128
atgatgataacaaaagatgatgacnaaggagatgaccaaaagttcaaagatcaatcaaagaacaactcaagtgaatcaagaacaattcaagagttcaagataagaatcaagaagaattcaagactcaagaagaaaattgttgtaatcgattaccagtag

SEQ ID NO: 31444 - DNA, 177 bp, Glycine max
  misc_feature (41)..(41): n is a, c, g, or t
  Peptide Sequence Number=SeqID_123129
atgatgtaccctccaatgtgtttagacaaagaattcttagncgggaagaggaagaatcaaaagaattctcaggcagttagtcctttgaatattttggcaagaggaagaaggaagaatcaaaagaattctcaagcggttagtcctttgaattcttctggcaagaggaagaaggaatga

SEQ ID NO: 31445 - DNA, 225 bp, Glycine max
  Peptide Sequence Number=SeqID_123130
atggcagaaataggaaaattggatcatctaaaggaaaggctcagggccattgaaggaggcggagattatgcctttgctaacctaaaagagttgttcctagtacccaatatcgtcaccgctcccaagttcaaggtgctcgactttgacaagtacaaggggactacttgtccgaaagaactatctaaagatgtattgtcggaagatgagggcatacgcaaaagatga

SEQ ID NO: 31446 - DNA, 409 bp, Glycine max
  Peptide Sequence Number=SeqID_123131
gctttggaacaagagaccaagagggctcgtagggaagagcacggccggaacaagttccgaggggctctgtggggtagtaacaacgagcttaaactccggagggaggaaagggaccaatcgcgagtagacaagaccaacatgttagccatcatcagcaagtatcaagaagaactaagcctagccacaacccacaagcatagggtggcggatgagcatgcccaagtgtacacagaaaaggaagcaagggaaagggtaattgattcattgcaccaagaggcaacaatgaggatggaccgatttgttcttactttgaacaggagtcaagaacttccccgattgctagccaaggccaaagcaatggcggacacctactccgcccccaaggagatccacggacttcttagctatt

SEQ ID NO: 31447 - DNA, 252 bp, Glycine max
  Peptide Sequence Number=SeqID_123132
atggagtgcatgtcgcccctagcaaggttattaggccccctactaaccgagctttcatcaagaagtattgcgtccctaggcaggcataaggcgagacaccataacagcctggggatggccgacagcgggcaacagatgcaccgctgccacctccagagccccttagctcatctagaaaggctggagcattgcctacgacccgtggtcgaccagcaggcgaccaagtccaatgccaaagtaggatacacctag

SEQ ID NO: 31448 - DNA, 312 bp, Glycine max
  Peptide Sequence Number=SeqID_123133
gtggtagctcctctaggatccatcctatcagtggagcagtttttagagagggtagcctggcctggggcccaaccttctcttgatagggaaagtgaaggtcccacagcccaagtaccccaacaggcaggggaagaacaggcgagaccagagactgctgctactcctgagagatcccttgagggcacatcagagcctcatactccagtggcaaacttcttgttccccaattgcaattactttttgttcatttatgtctcaaggaaatttcaatgggggtttatcggaaagcgcaccggatcgtcaagtatttaa

SEQ ID NO: 31449 - DNA, 303 bp, Glycine max
  Peptide Sequence Number=SeqID_123134
atgaatcaaaagaagaagttcaacaagaaagaaggtgttgataacattgatgaaagatattataggagtttaatgggatgtctaatgtatctcactacaacaaggccaaacattctatttgctcaaaagaacaaaactggaatttttgttgacaatcaagtagtcattgctattgcaaacaatccagtgtgtcatgggaagactaaacatttcaatatcaaggtctattatttgataaagatgcaacaaagtggagaagtaaacttaatttgctgcaagtctaaagatgaactccagttttaa

SEQ ID NO: 31450 - DNA, 257 bp, Glycine max
  Peptide Sequence Number=SeqID_123135
atggataaagacactggacttgaagatgaaaccaaagttgaagagcttgaacaaagcaaagcaatcactaccacacttcctaaggaccttccaacagaatggagaactcaaaaagacctctccttggacaacattattggtgaaatatcaaagggagtttctactcgctctagactcaggattttatgcaataacatggcttttgtttctcagattgaaccaagaaacatagatgaagccttgtatgatgatcattg

SEQ ID NO: 31451 - DNA, 711 bp, Glycine max
  Peptide Sequence Number=SeqID_123136
atggagaggagtatgattgatgctgccagtggtggagcccttggtgatatgactcctgctgaggctaggaatttgattgagaagatggcttccaactcccaacaatttagtgcaagaaatgatgttatttttcttagaggagtccatgaggtggccacggattcatcttcatctactgaaaataaaaagcttgaaggaaaacttgatgccttgatcaccatacagatctttgtccttctttgtagcaatctggagtcaatgagcaacctgaagcttatgttgcaaacatttataatagaccccctcaatagcaaaaccaacaacaacagaataattatgatctttcaagcaacagatacaatccagaatgttgctggcccaagcaagccatatgttccttccccaatgcagcagcaacaacaacaacaaagacaacaagcaactgaggctcctcctcaaccttccttagaagagttagtgaggcaaatgaccatccagaatatgcaatttcagcaagagacaagagccttcattcagagtctgacaaatcagatggggcaaatggctactcagatgaatcaagctcagtcccaaaattctgacaaattgtcttcacaaactgtgcacaatccgaaaaaatgtgagtgccatcaccttgaggtctggcaaccaaattcaagtgcctccacaagtagcagcacctgcacctga

SEQ ID NO: 31452 - DNA, 306 bp, Glycine max
  Peptide Sequence Number=SeqID_123137
atgaggcaccgaatccctatgataggtggtatgatgaatgtgttgagtggtgcaaccctcttttgtaaaatcacctatgcatccaacatcttcatgattcacatacatagggactcgttaggtagtgatcaaagggttctcacgaaccctaagagaataaaggtcattcctgagtgtcccactccgccaagtgttgagggaagaagcccagagtttcaagaacctctggatttgaggtcaaatccttttcaagggggatggaatgatgcaatcttaccccctcccccccccaagggcattggatag

SEQ ID NO: 31453 - DNA, 417 bp, Glycine max
  Peptide Sequence Number=SeqID_123138
atgacaagcagagaccaagtttggtcattctgcacccaagatacgcggagataccttacggttatccgcacccttttgtcatccagaggcggcgggcccgatgacaagcagagaccaagtttggtcattctgcaccccagatacgcggagataccttacggttatccgcacccctttgcattctccagaggcggcgttgtgtccgatggcaagcagagaccaagtttggtcattctgcaccacatgatacgcggagataccttacggttatccgcaccccttttgtctatttcagacacaggtgtccgatggcaagcagagaccaagtttggtcattctgcacccaatgatacgcggagataccttacggttatccgcacccctttgctattctccagaggcggcgtggcccgatga

SEQ ID NO: 31454 - DNA, 473 bp, Glycine max
  Peptide Sequence Number=SeqID_123139
atggcttctccacctgcctcccctcctcctcctcctccttctcttccttctcctccttctcctccttctcctcctcctcctgctccttcggacacatcggcttcgccgtctgccgttaagcggacacgcaaagcctcatgtctacaatcgttgtctactagaccacctggtgctaagagaccagtggtccatgttgatcctgctactggcaaggccgacagtcctcacaggaagaaattaagaacatatttggggattgtggcgcgtgataaggtggatgtcagttacgagaattggaaggaggtccttactgctcagaaggacctgatttgggaggatattcaggcggaatttgatatcccagaggcttctgatagtaggacgaataggaagttacttcagaccgtgggggaagatggaggcagtttgaatcagaactcacgaggaaatgggccttgcagccgatcaggacg

SEQ ID NO: 31455 - DNA, 252 bp, Glycine max
  Peptide Sequence Number=SeqID_123140
atgttaggattcacaagcgattctcctcatgtttcagccagcccgcatcaattaaactttgcaccttacgcttcgaggtcatacagtgctcaatggaatgccccggggcttctccatgacaagcacatgttgcatttgagtcgtattctcggaaaaatggaggttgaggaaccttggttggggttatggctaccattgaattatcgagtggatatgggagcaagtcatcataggacaccggaattagtgtga

SEQ ID NO: 31456 - DNA, 267 bp, Glycine max
  Peptide Sequence Number=SeqID_123141
atggatgaagagcaacctcgacgagtgaccttggaagattactcaagtgtacctaaagatgctattaggctcagcctgttttcattttctttatctggggaggccaagagatggttgcattcattcaaaggcaacaatttaaagacccgggataaggttgttgagaagtttctaaaaaaatatttcccagagtctaaaactgcagaggggaaagctgcaatttcttcattccatcagtttccaccagtgatgatcatggaaggctaa

SEQ ID NO: 31457 - DNA, 408 bp, Glycine max
  Peptide Sequence Number=SeqID_123142
atgaagtgcccgtctcccccaacaaggtcatcaggccccctattaatagggcctttgttaagaagtattgcgcccccaagcaagcgcagggcgaggcaccacaacagcctggggatggccagtagcgagaacagacgcattgtcactacctccagagtccacctcagctcatctacaaaggtagaagcattgcctacaatagatggtttaccagcaggcagccaaccaccggggcaagtacgagcagacgttaaagaagcgctactaggaagcaacctagaattggctacgaagaagctccgcgcgaagtggtccaggaaaggcatcattgaagagggttccagtgtggccccacaagccgacacaggcttagacaaacatcgattccagagtgtggaacatcagtag

SEQ ID NO: 31458 - DNA, 189 bp, Glycine max
  Peptide Sequence Number=SeqID_123143
atggagccctttgaaggtgagggcgtgcagccctctaaaggcgagaacgtgcagccctctaaaggcgagggcgtgcagccctctaaagtcgaggacataggtgataattcatgcaacctcttcctatcttttgaaaatctcttcgggaactccctcaaagtgtatgtcttgtttgatttactcacttga

SEQ ID NO: 31459 - DNA, 492 bp, Glycine max
  Peptide Sequence Number=SeqID_123144
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcagaaagcatcagagcagattagtactgagagtgcaccatattttttgcggtgtgaaataccgcacagatgcgtaaggagaaaatacctcaggcgccattcgggccattcaggctgcgcaactgttggaagggcgatcggtgcgggctatccttcttcgctattacgccagctggcagaaagttttatgtgctgcaaggcgattaagttgggtaacgcagggttttcccagtcacgacgttgtaaaacgacgcagttcaagcttgcatgcctgcaggtcttgactctagaatcttcccaagttgagatacttctagagctgaagggtttacaccatcatctagcttttctcgactga

SEQ ID NO: 31460 - DNA, 348 bp, Glycine max
  Peptide Sequence Number=SeqID_123145
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgccttcgcaggaaatggccccaaggaagcttgcctcaaagaggtccaggaaggacaaggcagccgaaggaactagttcctgcgaaggaaaacatttggaaagttagttttaccaaggggatcctctag

SEQ ID NO: 31461 - DNA, 264 bp, Glycine max
  Peptide Sequence Number=SeqID_123146
atggtcttggctgtcctttggcttattccccgatcggaatggacaactggtgacctcggaagaattacgggaatggaattcaggctgaaaagcgcgagacacagagtaaggggtttacagaaagtggaatgtggaatggataaagagaagaagaggtcgactagggcgccaactaagggccaaagagacaaagaaccaccagcggctccaccgagtttccccggtagcctaccagtgagaactactaggcgggaagggatctag

SEQ ID NO: 31462 - DNA, 626 bp, Glycine max
  Peptide Sequence Number=SeqID_123147
gttctggtaaatctaccttgctcggtttgctggcggggctggatattgccagcagtggcaaggtgttgattgatggcagcgatattggcccgttggatgaagatggtcgcgccgccattcgtgccaagcatatgggctttgtgtttcagtcgtttcaattattgggctcactgaccgcgtttgaaaatgtgatgttgcctttgcagttggcgggtcgcagtgatgcgtctgctatcgccatgtcggcgcttgaaagtgtcgggctggtggcacgttcaacgcattatccaaaacaattatccggcggtgagcaacaacgggtggcgattgcccgggcgtttgcggccaagccttcgattttatttgccgatgagccgaccggtaacctggatgccgcgactggtgaaatccgtgtattgctgtttgcgttgattctagcagtcacggcgactacctcagtcagttttttcactgaccgcatccaatccggcatgcaaacacagggcaatgtattgcttggcggtgatttggtggtgatgtcagaccatgccatgccggcaagctatttggcagaagcgcaacggcggcaattccagaccacacaaacgttggagtttccaagcatg

SEQ ID NO: 31463 - DNA, 225 bp, Glycine max
  Peptide Sequence Number=SeqID_123148
atgggggaactgtcgtcccttgtgacggacgtgtggggtgctaagcatcttcccctatttgcggtaaataggggaggaagctcccgagatttcacttggaaaaggcgacttccgacgcgtttcctttcgtggaacattcgcagttcccgcgagtcacgcgtcgccctcccgccgaagggtaggttgcgacagttggcgactatccactggggactgtttttgtga

SEQ ID NO: 31464 - DNA, 204 bp, Glycine max
  Peptide Sequence Number=SeqID_123149
atgatgaaggtggagaagaaattgatacatagaacaggacaacaacaatctccaaggacaaatacaaatggtaatgatgttgatgttgcacctgaattttctcctttgaaaactgttcattttggaaatccttctcaagacactgttgacccaagagatggaggctttggaggaagactatcgagatggaaatgggaaaaatga

SEQ ID NO: 31465 - DNA, 1434 bp, Glycine max
  Peptide Sequence Number=SeqID_123150
gttactgttcctgatgctgagaaagatgttccgacatcttccaccccaaatactgaagtcctctcttcacccagcaaagaggaatcaacagaggaagaggatcaagccacacaggagacccctgcaccacgggcaccagaacctgcgccaggtgacctcattgacctggaagaagtagaatctgatgaggaacccattgccaacaagttggcacctggtattgcagaaagattacaaagccgaaagggtaaaacccccattaagaggtctggacgaatcaagactatggcacagaagaagagcacaccaatcactcctacctcatccagacgaagcaaagtcgcaattccttccaagaagaggaaagaaatttcctcatctgattctgatgatgatgtcgaactagatgtctcgacatctaagagggccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcaaggctgctggactgctgaaaactgtcaccaaattgggagactgctatgagagtctagtcagggaatttattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccaccaatcatacttccactgttgccacagaatcctttgctgtcaaattacccattgccttcccaactgtattgtgtagcattatgttgagtcaacatcccaatattttaaactacactgactctgtgatgaagagagaatctcctctatccctgcattacaaattgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaccacagagaagaagatggagctggaacggctggtcaaaaggctttcagaaagtggcattgatgatggagaagcagctgagcacgaagatgaagcagccgaggaagaagaagaagctgctgaggaagaggaagatgccgcagaggatactgaatcagatgatgatttcgaagccagcccatga

SEQ ID NO: 31466 - DNA, 300 bp, Glycine max
  Peptide Sequence Number=SeqID_123151
atggttacttctttacttcaacttgactcgatgaaccttttcgtaaaagcacgagcttggttcaacaccataacccagggaatggcaattttgatcaccaatacttcaacaacatttcatagggataaaagactcgggaatacgcatgctatgcatggaaaatttaagaagacgatatggatcttccgacttccctcgacaaaagacgagacccacatacaacgcatgtgtgatggcatgatgcagatgcgcaaaagcgcaacagggggatttacacagcatgacaatatcctcaaataa

SEQ ID NO: 31467 - DNA, 303 bp, Glycine max
  Peptide Sequence Number=SeqID_123152
atgtccaacacattaatgatgtttgtgactcattttttctatgggcaatgggttgaaggaatagtgacacatacaccagcgtacatggaatggtatagaaaaaacactactttgttcttgtttgttgaacaacaactacatgatccacgcacaacaattacacaaaatgttgcaaggtcaggtgttgaacaaacacattttgaaattccacatcctcagtcaatgtattctactccttcacctgttcatcaaacttttggccaactggcgagtcagtcaccgcaaccacccatgaatggatga

SEQ ID NO: 31468 - DNA, 515 bp, Glycine max
  Peptide Sequence Number=SeqID_123153
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaacccccgttcagcccgaccgctgcgccttatccgtactatcgtcttgagtccaacccg

SEQ ID NO: 31469 - DNA, 205 bp, Glycine max
  Peptide Sequence Number=SeqID_123154
atggcttcttcgtcgtcatgctcatcaagtatacaaactaggtctggtccaattgatagtgacgtgttgtggatgcaacccaagcatgtttcagaacatgtttggaatggggaaccagacagaaaactacacatcaggcgagcagtcccgacgtatcacggtgaagaacaaataccggaggaaattgttcctttgcttcggcaat

SEQ ID NO: 31470 - DNA, 723 bp, Glycine max
  Peptide Sequence Number=SeqID_123155
atgttgattagcatcatgaagaagttcacaaatggaagagacttgattaggcctggtatgactagatttgccacaacttatttaactttagcttgccttcatgaattgaaagcatcattaatgaacatgtttatctttgaagagtggaaaacaagcaagtttggaacttcacaagaggggagaaaagtacagaatgtggctttggatagtcaattttggaagaacataaccatctatgagcctgtttggaaaattatttatgagaggtgggatcatcagcttcacaggcctttgcatgcagctgcatattatcttaatcctcacctgcattatgaacctactttcagacatgatgaccctcagctgaaagaaggagggcttttctctatggaaaaggcaaaggacagtagaaaaatcatgcaacctggagaatggtgggagatgtttagtgatggaactccagagttgaggagatttgctattcgtgttttgagcttcacttgtagctcttctgggtgtgagcgtaattggagctcatttgaaatgttaaaaggtaaacaaaatagaaaaactattgctcttccatttgatgagattgaatctgacaatgaatggataactgaagagggatataatgatgaggatgagcaacctcaagctgaaggtcatggtgacaatgttgaattagtgggagatgttggaggaagttcaaatgatccagtt

SEQ ID NO: 31471 - DNA, 534 bp, Glycine max
  Peptide Sequence Number=SeqID_123156
atggcatcctttagccaccttcagtcgcagatgcaatctcagggacttgcaatgcctcctgagcctctggttggtcctggtcccttctgtcctcgagtgagcaaaaaggggagttgtgttgatccctcaggaaacgatcctgagaccggtgactctgacaggtgcggcttctacatagaagcagatcctacccgcctggttgccatcgggagagtttatgagggatccactgttgttcataacactcctttgttgcttggccaagtaaaggtgagtgtggaggaggttagagatgcagatgctccaattcctgtacccactgatgaggtttccttagtggggcaggcacttcacaccttccttgcttggccgacacatctggtcaagtctttatcacagcaggtagttgtgtctccgccaaaaccacctccgaagcccgatccggaggtcgatgatccgctttatctgatgacattaaccatcccagagcttttcttgaggccttatcaggttagatgggaggggatcctctag

SEQ ID NO: 31472 - DNA, 546 bp, Glycine max
  Peptide Sequence Number=SeqID_123157
atgggtgaagtagagaaggtgcaagagcagatgaaggccgacatggaggccatgaaagggcaaatggccacaatgatggaggccataataagcatgaagaagataatggaagccaatgcggttatagttgccgctactagcgctattgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacttccatactcattaagagccaacaacctcaatctgatcatgcacatgtctctcgacccatggaggagacacatggaatgccccaccacaatctagccgacttcgagccttgcctcggatatgccactgaagggcaagcagttggtggaaatgggaaagttggatcatctagaggaaaggctcagggccattga

SEQ ID NO: 31473 - DNA, 201 bp, Glycine max
  Peptide Sequence Number=SeqID_123158
atgcgagctttcgctaagcgtgacactcagtggctaagtacgaggaagaatccagaagaagatgagctgtcaggttcgctgagcgcaccgctccaggtcatcaagcgcaccgcttcagcttatccgctgagtgagagaagcgcgctaagccacaatccacttatgcgcactaagcgatccagatttgcgctaagcgcatga

SEQ ID NO: 31474 - DNA, 156 bp, Glycine max
  Peptide Sequence Number=SeqID_123159
atggaccgctcaacgtgcattagtggatttcggcttagcacgtgcttttcttgctcagcggatggactaaagcgattcttcctcgcgctcagccgaagagtgttgcgttcagcggttagctcactaagccagcagattggcttagcgagaagatga

SEQ ID NO: 31475 - DNA, 309 bp, Glycine max
  Peptide Sequence Number=SeqID_123160
atggcctcctcagattccctgtttcctgaaggaaattccattcacagaccacccattttcaatgaattaggaccacacatacccactatagtagatgtaagcgcaagcactacaacccaaaaacctagagttaagtggacagaagaagataggagaaaaatccagtacgatctcaaagccaaaaacatcatcacttcagccctaggaatagatgagtactttagagtgtcaaattgtactaatgccaaggatatgtgggatactctccagttaacccatgaaggaaccacagatgatgaacccaaatga

SEQ ID NO: 31476 - DNA, 522 bp, Glycine max
  Peptide Sequence Number=SeqID_123161
atgtcgaggacactgtctgtgagaaatacaacattagcaaggaaaagtgggcccagttttgccagacttgcagagacccttcttgggaggatgtgcgcaagaaggcacaggccatccagaagcagaatactgcccctcctcattttatctcgtgggggttatgactatttggagcagaagctcctggctgagaagacgaaaaagaagctggaggaagctgcacagtcaggaagcgttgatggcttcatcgaccctccatccccggtcagacgccacgtgaagtggaagatggcccgcacaaagaaaacaggggagatgacgactgaggccgcaaaggaaatcgctgagaagatcgattcctttgaggagcaagccacacagggatccttcgtcccccatggacagcaccctggacgtgtccgtactgctggagccggtgtcaccatcaagcatactttggatcagctccacggacgtcccgcagctcttcctccctgcctcccaaagaattgcagcagttga

SEQ ID NO: 31477 - DNA, 252 bp, Glycine max
  Peptide Sequence Number=SeqID_123162
atgaagtttaaaaataaagatggtaatgtttggcaccatcatagaatgatgtgtaccacgatatccatgacgtttttggaaaaaccgtcgtgcttcgcgacctcagttggtgctcaccccctacgcgctatcctcactccagtcaccttctctgtcactcacacttccgcgtcagcacgtcgttcaattactgtcgtcattgtccaagctggcaagttgcgtcaccgtcaacgaccaatgtgtgaaccataa

SEQ ID NO: 31478 - DNA, 267 bp, Glycine max
  Peptide Sequence Number=SeqID_123163
atggcttcttctccagtggcatccaggatttcttccaactctttcacagtcggcactagctggaagtcctcaaatgtgaagcactttaggggctgggtcataatactgggaaagggatgcaatcgatacaacgtggggcggagtagcaaagtgtccccaactgcttatggcctattggctagcaatcgggacagccttcttgacgtttgttcaaagtacagaggggatcaagatcagatccatccacattgtgccggatgcatatga

SEQ ID NO: 31479 - DNA, 165 bp, Glycine max
  Peptide Sequence Number=SeqID_123164
atggcgagtccgatgacatgcgggggtagcttatggttatccgcacctttcgtcaaccaaggcgaacgagcagggatgatcgagttcgatagcatgtggaaacgtcgtggttccgttggttgggatattgaccggtccaatgatgttccgctcgaacgaaattag

SEQ ID NO: 31480 - DNA, 651 bp, Glycine max
  Peptide Sequence Number=SeqID_123165
atggccccgaggaaactttcctcaaagagatccaggaaggataaagcggccgaaggaactagttcagcccccgagtatgatagtcaccgctttaggagcgctgaacaccagcagcgcttcgaggccatcaagggatggtcatttctccgggagcgacgcgtccagctcaaggacgacgagtataccgatttccaggaggagatagttcgccagcggtgggcatcactggttacccccatggccaagttcgatccagacatagtcctcgaattttatgccaatgcttggcctacagaggagggcgtgcgagatatgaggtcctgggtgaggggtcagtggatcccgtttaatgcagatgctatcagccagttcctgggatatcctttaatgctggaagagggtcaggagtgcgagtattgccagaggaggaaccggtccgatgggttcgatgagaaggccatcgcccatttgctacgtataccggggcatgattttgcccgggctgctgccgggagacgggtgcggatcatgcgcaccaacatgaccaccctgactcagatatggatgactttgctgctcagcacatccagcccagcgatcataattccgacctccccctgccgaagtatcagctggtgtatgccatcctga

SEQ ID NO: 31481 - DNA, 154 bp, Glycine max
  Peptide Sequence Number=SeqID_123166
gtcgactctagaggatcccctactggatgcacgccaatgggaccctccctccaataagtctatcggatttttgttcaagaatgaaatcttattggaactgtccagttcaccctttggaaccatatcacatcccggatatgatgaaataggatga

SEQ ID NO: 31482 - DNA, 699 bp, Glycine max
  Peptide Sequence Number=SeqID_123167
atgacggcaaagatactagaggatgaatccaatatgtctcgccttttacgttctttctctcgcatttcttttagattaaactcatcttcatcctcttcttcaatgaattcaaccaataatttactcaatgaacaagataaccagacccacgaggtcgtcccaaaacacaatcacttcgatgaggaagtccgattcgaagacaaaaatcaaaatatggatgattggaacattccagaaatccctcaggataagctgtacattcctgaaacaaataaagacaaacataattttgactatataatcaaaacagtagaaaataatattcctctaggacaagatataggggaagaattttatctgttttcaaaaaattcaatttatgaacatagccgtaaatacaagtatttacatatcgattgtgtacaagtagccatcaagcccttaattgatttaggcatagatgctgcagttttaatgtgctttagagatattaggcataacaagtttgaagattccttaattggaacagtagaaacaagtttaggacaaggtccaatatacttcaactgttatccaaaaaaaacggtgagtctaatggacagaaatattcttgactctctgtttttaaatatccactttcatggccttgacatgaaagaaggatcaatcccaacaactttaatctataggattcagtaa

SEQ ID NO: 31483 - DNA, 608 bp, Glycine max
  Peptide Sequence Number=SeqID_123168
atgtcttctaggaaaagaaatagtggcggttcaaggcccgccactcaatatgatacaagaagattccactcttttgaggcttggaccagatatactgacaatgtggttggaagacacatattagctgagaggaaagtggaaatctatcacatagagttggatgaattcaagggagagctggagaggtgtaactttcataagcgcctcacaaacttagctgatagtagcattaacctcgtgttggtaaaggagttctatgccaacctctacagtcctgaggggccttcacctaaacaagtcagaattcggggccacttaataaggattgatgtagatagcctcaatgaatttctagaaacacttgtggtgcttgctgagggtgaatatttgcctgcctactcaagatactgtaggatgcctactgacactagagaaattgaggctgcactgtgcatacccaaccgagggtttattctaaatgctgaaggtcacccggggaagatcctcagaaaagacctaatcatccttgctcaggtctggagtgttctatcctactccaacttggctccgacctcccacacatcggatctgactatggatcgagctag

SEQ ID NO: 31484 - DNA, 57 bp, Glycine max
  Peptide Sequence Number=SeqID_123169
gggaggagcttgccacccagctcgcccaggcgagctcagctcgcccggacgagccag

SEQ ID NO: 31485 - DNA, 84 bp, Glycine max
  Peptide Sequence Number=SeqID_123170
atggaagctccaaccacaactcacttcaaggcggcaaagagaatccttcgatacatcaaagtgatagcgatgagtgagacttga

SEQ ID NO: 31486 - DNA, 345 bp, Glycine max
  Peptide Sequence Number=SeqID_123171
atgaacctgccaaacttcactctattccagaaaaaggtgatgacaaaaatttacctaacaatttctgtgcaggtgaatcttcttccacagaaaattccaagatatgccaaattcttgaaggagttgtgcactaataagcggaagcttaaaggaagtgaacggattagcatgggcagaaatgtctccgcattgattggtaaatctgttcctcaaattcctgaaaaatgcaaagatccaggccccttgcagtcaactgatgtggtaattcatttagctaatagaagtgttgcctaccctgttggtttcatagaagatctttctgtatgctatgaaatacccatctga

SEQ ID NO: 31487 - DNA, 288 bp, Glycine max
  Peptide Sequence Number=SeqID_123172
atgaagacgacgaagacgttcaagacggttgaaatctttgcgaaatcacccacgaaaaccttacggaaacgttacggaagcgcgtcggtttggattttcttcacggaaccaatttttttcactaatttcaacatgtcgcggaacttcacgaattgtgctacaatgctttcttttgacttctggcacgtcacagaacttcacgaattgcctaacgatgggtgccaagtacctcgaagtggtcaaacgagggtcgcaacccaacaaagaatggtccccggacgaaattag

SEQ ID NO: 31488 - DNA, 255 bp, Glycine max
  Peptide Sequence Number=SeqID_123173
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggtggtgtttggcttcggatgtgcagcaggcgggttttgtggctgatttaggggctgcctttgtggatgattgggtgttcttggctagtagggtggtgggtaatgagaaggattga

SEQ ID NO: 31489 - DNA, 546 bp, Glycine max
  Peptide Sequence Number=SeqID_123174
atgggtctgggcaaggacagccacaggaatgccaatgtggccgacattagggggaacccgtacaaatatgggttggggtatgaaccagggaaaccgggaagaaggaacgcaccgtcaagactccaggcagatagggcatggcccgaccatgttagccagtgtttcacaagtgtcgggataatgttcgaggaagaggtggcggcaataggagaggagtctccacaagatccgccaagtttcgtacgaccgtgccgtcccaattcccaagtggggaactggcgcgtgataagccagtcggaagtctataccgctgattcaatatgtaagggtcgattctttgaggatcctaacaacgagggtttgataatcgattttgaccgagaagtaagtcaaacaataaatgaagacgaggaagaggacgtcctttcaccagagttggagagggaagaagaagtgaaagtaggaaccggtatgactgcacctatcgccaaggttgccattgaaatcctgggtcttccccggttaagcaaaaattacgaaggatga

SEQ ID NO: 31490 - DNA, 384 bp, Glycine max
  Peptide Sequence Number=SeqID_123175
atggcaaatggcatgtggggcaatccaggtgatttacaaccctttgatcctaaaatagatagaacctttcatagattagctaggcatagtgtgcatcctggtcattctgtgcattttgagcatcttgatcattttgagcattttgttgctggtgattctaaatattctgattttgagcattcagctattaattttcatactgagaacatgactcaacctccacctcgtgagaagactcttagggagatggctgcacctgatttcacttatgaaagcttgtgcattcaatatcctgatgagggtgttccatatgttctcaagactagactaatacatttgctgcccaagtttcatggtcttgtaggtgaagatcctcataagcat

SEQ ID NO: 31491 - DNA, 492 bp, Glycine max
  Peptide Sequence Number=SeqID_123176
ggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtacccagacatctaaagaaaatattgtggtgtctgatgatggaaagatgtctaaagggaagcgccgaaagcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31492 - DNA, 348 bp, Glycine max
  Peptide Sequence Number=SeqID_123177
atgtctttaaagttgcctcattatcctaaactagttagagtcttttacagtaacttaagaattcaggatagtacactttactctgaggtgcatggtattcctcttgtcattgatcaatctctgtttttctcattgactaaattacctagtcaagatgttccttttgagggcactgttgttgatgactggaagtttgactattcgagtcatgatgctcacggtatggtctgtaatgaccaggctgatatgaccggcagattgcttgtcgggtcattaacctttgattgccgcatcatgcactacatcattgttagaattttgttaccccgttcgtctaatcttgcttaa

SEQ ID NO: 31493 - DNA, 438 bp, Glycine max
  Peptide Sequence Number=SeqID_123178
atggctactccacctgcctcgcctcctcctcctacaggcgcatcagcgtctccatctacgttgaagcggacacgcaaggcgacacgactacgatcattggccactagaccacctggggcagaaagacctgtggtcaacgtcgatcctgctaccggcaaggccgacggttcccacaagaagaaattaagaacatatttggggattgtcgctcatgataaggcggaatttgaaatccctgaatcttctgacagtaggacaaagaagaaaattcgtcaaattttcggcgagcgctggaggcagtttaaatctgacatgactaggaaatgggcacttgcagccgacaaggatgagacgcctcatgagaggatgtgcgaaaaaaggcacaggcctctcagaagcaaaacactgcccccacatattgtctcgtgggagttatga

SEQ ID NO: 31494 - DNA, 381 bp, Glycine max
  Peptide Sequence Number=SeqID_123179
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcataaaataagagcacctggctctgcccattcacaaggactcgattctctgtccaaacatcacatgccagcagatgtggtcaccatcatagtggatgagatcggtcgagtggtctccgttggagatgggattgcacgtgtttatggattgaacaagattcaagctggggaaatggttgaaaaaagacataccaactaccaacctacctttagggaataa

SEQ ID NO: 31495 - DNA, 243 bp, Glycine max
  Peptide Sequence Number=SeqID_123180
atgacaattcaccatcatctttacttctggttagaggccattgaaaaatttcacacatttggacctctccccagcttctccctgataatgaggaaaataccttacgaggttctcaaatctcgctgcatactcttccaccgacatactcccctatttcagctcgaggaactctcattcctattcttcacatcttctggaaaatacatctccagaaaagtttgtctgaaggagaattataagtaa

SEQ ID NO: 31496 - DNA, 342 bp, Glycine max
  Peptide Sequence Number=SeqID_123181
atggtcatggagctcgtgatggcataccaaaatgacaatttcttggaagagaatgcggttcatgaagttgcatcgagaaactcatcaagttggtgtcgcatacccaacaataattttagacaacatctaattagagagctcgggcttgcagttccactggagggtgaatgggctctgggtttgggttttttgggatttagggttttcatggggaggagggaagaaagggagaaaagtaggaatgcggagttaggggcgatggtggtgcaaaggagaagatggagagagggcattgtgaaggggagagagggagagagaaaaggagagggagaaaaagaatga

SEQ ID NO: 31497 - DNA, 201 bp, Glycine max
  Peptide Sequence Number=SeqID_123182
atgtctcagcatctctgttatatagttgtggattctgcatatgacagagacaagtatgcgagcagggaattccgatgtgtatggattcctcgagccacagttccattcagagatctgggcaatcgcaatttgaattggaatgttacatcaagagttggatgcagagttcaaaacgcgatgtctaccttggagcctacctga

SEQ ID NO: 31498 - DNA, 260 bp, Glycine max
  misc_feature (249)..(249): n is a, c, g, or t
  Peptide Sequence Number=SeqID_123183
atgagtgaaatagaggaggtgcaagagcggatgaaggccgatatggaggccatgaaagagaaaatggccacaatgatggaagccatgatgagcatgaagaagataatagaggtcaacgcggctacagttgccactaccagcaccgttgctggggtggatccaactcccctatttggcctcaatcaagtaaatcatccagcctcatataaggtagcccagggaggcgaagcgttaggaagtacgggcggnccccattttat

SEQ ID NO: 31499 - DNA, 135 bp, Glycine max
  Peptide Sequence Number=SeqID_123184
atggagaagaagatgaagaacaaatcaatggcagcgaaatggagaaggaggaaaggtgattggagacgccacttcaaggagaagatgagtcaagaacaagctcatcaccataggaggtcatggataagagcttga

SEQ ID NO: 31500 - DNA, 138 bp, Glycine max
  Peptide Sequence Number=SeqID_123185
gggggacctgttagtgacattgggccattgattgaagtacatgcaatgcctataaactgcagtgtagaaaatatggttaaggctgttgctgaagagtgtactcagaatggtattgaagatatggatgtcgatggttga

SEQ ID NO: 31501 - DNA, 184 bp, Glycine max
  Peptide Sequence Number=SeqID_123186
tcctttcgctaagcgcaagcctcgcgctaagcgcatcttttgtcatgcgctaagcggagagtctctagcgcttagcgctcaaccattgtatctcaagctgatttggtccgctaagctggccaaggctaagctaagcccatttctattcgatctgaatttggctaagcgatggccttcttgctaa

SEQ ID NO: 31502 - DNA, 134 bp, Glycine max
  Peptide Sequence Number=SeqID_123187
gcgaagtaactcttcctgagaaatgggtcatggataagaccacaccgtctgttcgaatgggtcatggatatggtcacaccatctgttccttgacccactccaaccatagagcaaatcaaaacaagataacttcg

SEQ ID NO: 31503 - DNA, 594 bp, Glycine max
  Peptide Sequence Number=SeqID_123188
atgaaaagaaaaaaacatgcctcctatagtattcatgactcttgcaagagtttaagtgaagaacttagtgactattatagagggctccatagttcacatactaaacatcactcccaaagaagagaaaaggaaagaaagcctcaagaggctaagattaacctcccatacttctatgggaaggacaatgtagaggctaacttagattgggaaataagggtagagcaacaaattaaaaggaagtctacttcaaaatcttatggctctcactcttatccaaagaaagaccaaggtcaagtcatcttaggggtgactccttctaagtccaacgatgataaggggaagacaatagaaaagcaaccccttaaagctagtatgcaagagaagactagctccatgaagtgctttaaatgtcttggaagaggacacattacttctcaatgccccaccaagaaaaccatgattatgaggggccaagacatttatgtggaagcaatgtcttccaagattattttgatgatgccaaagaatcaagagttaagaaagttccaaagaattaggagtcaaaaagcttcaagaatcaagattcaagaataa

SEQ ID NO: 31504 - DNA, 805 bp, Glycine max
  Peptide Sequence Number=SeqID_123189
agtagattgggaccaacacctgactgggataggaggtagaacaatcaactggtttcctcgatggaaggaaggtaaggagggagttctcttctcatgtggggactacccaaacatcccgttgataggaacgaggggttgcattaactacaatcatgcacttgctataagacagttagggtaccccatgaggggagcaccaacggaagaaagcctgtctcctttccttgtgagagatttcggcgcgcaaagtttcaaggttatacaaagagtccataaggcgtgggaaagcccattaaggaaagataaagaacttaggggcattcgtaatggcatcatcggtggttatcatgaatggctaaaagtttgtacacgagggttaggttggctctccaagttaaagattatcaatgaagaaaacttcgaagctctgaaagaggatgaagaagtcgctacagacgtccaaaaagagtgtgtcgggttacgagaagaaaatgcagctaccgcaagagcccttgaaaaagaaaccagagggctcgcaaggaagagcatggctgtgacaaatttcgtggagctttgtggggcagcaactaccaacatgttagccatcgtctgcaagtaccaagaagaactaaatctagccacggcccacgagcataaagtggtggacgagtatgcccaagtgtacgcggaaaaggaagctaaaggaagggtgatcgactcattacatcaagaggcaacaatgtggatggaccgatttgctcttaccttgaacgggagtcaagaacttcctcgattgctagcctag

SEQ ID NO: 31505 - DNA, 315 bp, Glycine max
  Peptide Sequence Number=SeqID_123190
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacagggaaacagctatgaccatgattacgaattcgagctcg

SEQ ID NO: 31506 - DNA, 153 bp, Glycine max
  Peptide Sequence Number=SeqID_123191
atgaagtcgttgagaggaaaggagatcgcgttggtgaaggtgcagtggggaaccgatgagggtgattctacatgggagttggaggataggatgagagaattgtacccaaaagtaggaatagcgggggcaagatacgcgggtttgactaattaa

SEQ ID NO: 31507 - DNA, 279 bp, Glycine max
  Peptide Sequence Number=SeqID_123192
atgtctttgcttctacaatctctcccttttggaagaaatgccttccaaggttattttgatgatgccaaagaatcaagagttaagcaaagtttcaagcaaagattcaaaagaatcaagtctcaagtttcaagattcaagattcaagattcaagattcaagattcaagaatcaagtttcaagaatcaagagtcaagaataatcaagatcaagattcaagactcaagattcaagactcaagattcaagaatcaagagaagactcaatcaagataagtattaa

SEQ ID NO: 31508 - DNA, 330 bp, Glycine max
  Peptide Sequence Number=SeqID_123193
atggatatctctaaagatactaacatccctgtaatattgggaaggccattcatgttgatcgcaagctgcatagttaatatggggaagagaaagctggagctaggttttgaagataagaaaattgattttgatttgtttgttgaaaacaagcgtgctccagaacacaatgtctgcttacaggtaatggaaggaggtcaagaggttctgaaaggtttcaatttgttgagaaaaggactggaaaaaaacagtcttttcgctaagtgcaagcatcacactaagcacatctctgttcatgcgctaagccacgagtctcaagtgcttagcgcttaa

SEQ ID NO: 31509 - DNA, 1100 bp, Glycine max
  Peptide Sequence Number=SeqID_123194
atggcagcagcactggtaggtggtgcctttctctctgctttccttgatgtggttttcgacaggctggcttcacgtgagtttgttcacttgatccttggaaataagcttagcaagaagttgcttcaaaagttggagaccactctcagagtggttggagctgtgcttcatgatgccgagaagaaacagatcacaaacaccaatgtcaaacactggctcaatgatctcaaagatgctgtctatgaagccgatgacttactcgaccatgttttcaccaaagctgccacccaaaacaaggtaagagacttgatttctcgcttttccgataggaagatcgttagtaagttggaagacatagttgtcacacttgagtctcatttaaaactcaaggagagtcttgatttgaaagagagtgcagtggagaacttgtcatggaaagctccatcaacatctgtggaagatggatctcatatatatggtaggcagaaagataaggaggccataatcaagttgttgttggaggataacagtgacggtagtgaagtgtctgtggttcctattgtgggcatgggtggggttggaaaaactactttggcccaactggtgtacaatgatgagaatctggtagagatatttgactttaaggcatgggtttgtatttctaaagaatttgatgttctgaagatcacaaaaactatgatagaggcgattactggagagccttgtaaattgaatgatctgaatctacttcatcttgaattgatggacaagctgaaagataaaaaattcttaattgtcttggatgatgtttggacagaggattatgttgattggagtcttattaagaaaccatttaaccgtgggattaggagaagtaagattcttctaacaacccgcagtgaaaaaacagcatctatagtccaaactgttcacacctatcatctaaaccaattgtcgactgacgattgttggtcagtgtttgtgaaccatgcgtgtatttcctctgaatcgaacgagaacacaacaacactagaaaaaattggaaaggagattgttaaaaggtgcaacggactgcctttagcagcacagtcgcttggaggcat

SEQ ID NO: 31510 - DNA, 231 bp, Glycine max
  Peptide Sequence Number=SeqID_123195
atgggagctaagactgtcaaagaagtgtggaacacattgcaggaggagtttcaaggaagtgttaagcatatgagcaaagactgtataggcataaagaagatacacttgaaaatgcctcccagtcaaagtttaaattttagccccaaaacaaagaaaatggaggaaagaaaaattatggagaaacttccagaagaagagaaggttctaggaatttccttaagaacaaaatag

SEQ ID NO: 31511 - DNA, 528 bp, Glycine max
  Peptide Sequence Number=SeqID_123196
atggctaagttcgagaggtctgctccagagattgaaggccttgtggctaccagcggactaagtcttttgatcacatgttcactagatacgagcgatcgaggactaatgtctacttttgtggaacgctggcataaggaaactagtactttccatttgcccatcggagagcagactattaccatggatgacgtcgtgtcgttgctacatttgcctatcgtaggggcgttccacagcttcgagcaacttcatgtcgatgacatcgtcgatatgttggtggaattactcgaggtcagcgctgtagagattgtagcagcacgagcgtatttgctgcatctgcttggatgcacactttttgctaacaagagtgtcacacacgtgcacgtggtattcttggatgcactgcatgacttgacgcagagtgggacttactcttggagcgttgctgcacttgtgcacatgtatgataatttaaatgaggcttcaaagagcacggcgaggcagcttgtaagatatatcactctattacag

SEQ ID NO: 31512 - DNA, 447 bp, Glycine max
  Peptide Sequence Number=SeqID_123197
atggagccccaaatacaagggccaaatataatgacatcctattctaatatgtataaagacaattggacccaatcttggcccatgggcttcgaaatctaccctgaggatcatgagaaccctagggccttcttcagcagctctagcccaatcctcttggagcctcttgctcatggctctaaaaagaatcccaagggggaatgcaaagctgtgatgataaggagtaagacgtttgtggaggcagaggatgaggatagtgtcgtgcccaagaagaaagttgctgaaaagaaaggtattgatgataagaaagatgatgtgagaggtgaaagcaatcaggaaaaagaaaagcaaataatggtcaagaaaaagaaagtaaatgaccaagaaaaagaaaaagaagcagaaaaagaaaaagaaaataaaaaaattgaaaaagatgaaaaaaaataa

SEQ ID NO: 31513 - DNA, 462 bp, Glycine max
  Peptide Sequence Number=SeqID_123198
atggcgacttaccttctcaatattcttcctcataagttattgaactataaatctcctcttagggttctttatcataaggatccaacctattctcatcttcagacttatgatttcttagatgatggcccaaacccatacgtggtccaccatttagtgtctcaatccactactcctaatgctcaaactcctggtctagttccattcgagcccaactcccctaatattgcaaccagcccaaccattgagccaaagaagaatattgttaattgtacgaattgtctagcgactacttcccctcctcctagtccagcccattcttcacatcccagcccacatcctcgggctgttacatgcagccaacatgggatagttaagccaaagaagatctttaatcttcataccactgttgctaaatcccctctgccacataaccccatgtcagcccttcgggacccgaattag

SEQ ID NO: 31514 - DNA, 156 bp, Glycine max
  Peptide Sequence Number=SeqID_123199
atggcagaaatcaaccaaggatggaagcgaatggaggataggatcgcaaccgaccaagcgccaccccttcccggcgctaaacaagcagagaacgtcgctgcagggcagcccagtatcctttgcgttcgcagtttcttttgctattgtttgttttaa

SEQ ID NO: 31515 - DNA, 696 bp, Glycine max
  Peptide Sequence Number=SeqID_123200
atgtcagttctagaattgtacgtagaaaaggatgttgctggtggttctatgtttcatgctgcaaattctgttacgtcatgtgaacgtaatgtatctcatcatgagtcggaactgccaagaaatataagcaatttacatgttgatgaacatgatgatgatgatgatgattatcttgcatctaactcatacgttgaagagtctttcgatgaagatgatagtgatgatggaatatctgatacagacaatgaagtcactgacatcgttgaaccattttcaattgttcacccaagcgaagaaattcaaaatccattttggaatgatgctatgcattataataatatcaattggagtcatccggacgaggaggacatttgtggtctggacatgccaacgacttttaatgttggacaagaattatatgttggcatggattttgacagtaaagatgcggtcaaaaatgcactgaaacaatatgtgatgaagatgcatcaaagttttaagggttgtgaaggagactctggaattggttgctgcatcccaaattgtctcaatactctgtccggttggtgccactcaataacttggaaacaaattagtggcaccaccgcgtaccacgcgagacttccgactaaacaaacgggaggcaacagtgatataacggttgatgggtacgactcccacacaaactgcatataa

SEQ ID NO: 31516 - DNA, 441 bp, Glycine max
  Peptide Sequence Number=SeqID_123201
atggatttttcattgaattctataaaaaggtttctcttgctcaagaactgtcgcaacgtgcccatcgcgggcgagcgagggcgaggctcacaggtgcgcttcccaaaggaggaaagatgcgcggagtcgccaccaacatttatttgtggaaaacgtcgggaaaaccgaaggaaaccggtcgacaaaagcggggcttttgctcctacgtaccctcctttggagaggaaatcagacctacgtagttctttcttatgcgtgaatcaagcgattcttttttacttgaaaggtgatcattttaaggcgttggaccttaaaaatgatccattttacttgcaaaataggggagaagcttgccacccagctcgcccaggcaagcaaggttgcttcctccagaagcaacaaccttctggaggaaggatctggaaggtccaagtgggctag

SEQ ID NO: 31517 - DNA, 1924 bp, Glycine max
  Peptide Sequence Number=SeqID_123202
ggtgtgagacattggtacaaagctttcagtgtagttgacaactacttgggaggagggaagaagaggaatctttcttccgctgttgtcgtgtgccgtggttgttgttctgttgatgtctcggaaactcgacagccctgtgcagactcagatggctgtggcagtgataaggagcagtccccttgggagagagtatcatgggaagcaaccagcggggcggaggcgcgtgttcgtgcagacggagaaaggcttgccctcaatgtcccggttgatgagagttatctcacttttggggatatggtcttcaagaatgaccttagtgctgttcggaacgataccccgcttttgctcactagggggaaaaataatctaatgcctaggagctcctccacgccgtgtctgtcgccgaaggggagggacattgataaaagtggacctatcgagatattgggacagtctaaccggcttgatgggatcaagcacatgatcaaggacattatgaaggcgattaagatggggattgaaccgattcctgtgcatagtgggcttggaggtgcttactatttcagaaacagtaagggggaaagtgttgcaattgtgaagccaaccgatgaggagccttttgccccaaataacccgaaaggttttgttggcaaggcgcttgggcagcctgggctgaagcgatctgttcgggtcggggagactgggtttagagaggttgctgcttatcttcttgactatgatcattttgccaacgtgcctcctactgcattggtgaagatcacacactctgtgttcaatgtgaatgatggtgtcaatgggaacaatttgtggcggaagaggctgtttagcaagattgcgtctttccagcagtttattcctcatgattttgatgccagtgatcatgggacatcgagtttcccggttgcttctgtgcatcgtatagggattttggacattaggattcttaacaccgataggcatgctgggaacttgttggttaggaaacttgatggcattgggagttttggtcaggtggagttgattcccattgatcatgggctctgcctgcctgaaactttggaggatccatattttgaatggattcattggccacaggcttccattccgttctcagaggatgagcttgcctacattgaagatcttgacccttatcgggattgtgagatgctgagaatggaactgccgatgatccgagaggcgtgtctcagagtcttggtgctgtgcactattttcctcaaggaggctgcggcttatggcctttgcctcgctgaaattggtgagatgatgactagggagttccgcaggggtgaggaggagcccagtgaacttgaagttgtttgtttggaggcaaggaagatagtggcggagagggacagggaggaactgtctcccggggctgagatgagagatgatgagtttctgtttgatatagattattatgatgaagttggatcagattttacgccaaagatggcaatagatgaccccttaaccagagcaacttttcagcctgctcttgggaatgggcatgctcgtaacccgctttccaaattggatgaatgcattgaggaggaagaggaggaagctgagggagaatctccaaagggatttgttacttcttccactgaagaaaaaatcccatctgtttcagaactttccgtgtcactgaaaaataccatgttagatgggaaaaaccagaatcagcagaaatatggaggaaaggtggataatggccattttgcaaatacatcatctggtcataagagtgccaatgagcagcttcctccaagcataagctttgtggatgtgacagaaatgaccgaggatgaatggtcaaattttctggagaagtttcaagagctgctgtatccggcatttgctaagaggaaatccataaccttag

SEQ ID NO: 31518 - DNA, 315 bp, Glycine max
  Peptide Sequence Number=SeqID_123203
atggcatataggaggccatacctgcatatgaggtgtttccagtggtcccagtatgtccattccccatatggaaaaggaacaaggggagttcagactatggaaattgtcagaaagggtgtgcaaaatgtctgcaaactcttggcatcacctacatttctttgtgaagtcaagggcgtcagccctgagcgttggccagtagtagccagcatgcactacctttgttgcaagggatcattcctatatatggagaccgcaaattccttcatggagttctcccatgacataattttcctattggtttttcaagcactttaa

SEQ ID NO: 31519 - DNA, 495 bp, Glycine max
  Peptide Sequence Number=SeqID_123204
atgaagcatacaaactacatgaattggatggcaaagaaattccaagacaatgaagcatacaaacaccacccacctgaactccacaagctcttcaaacccaaggaccgccctccttctagcaccatgtctccagtacctcacaagcttgcaactggtgtctcactaagagagacttatgcgcttagcgagaatcatacgctaggcgaggcactcagcccgcttagcgagttgggagaatctgcaaagcatctgcacgctcagcgggtcatttgctcgcttagtgaggcgtttgtctcttcccgtgctaagcgcgctcagctcgctcaatggattttcactaacttcgtagagagcagaacaaaggcgaaaaatagagcaaggaagccaaaaacctcagctttcaagaggatcttaggtttaggggcaatttctaggttcctagaggtggaggagacatccccaccattgtgtaatctgttagcaatggaaggctaa

SEQ ID NO: 31520 - DNA, 576 bp, Glycine max
  Peptide Sequence Number=SeqID_123205
atggatgggcacattgatgtggccctagtcaaagaattttacttgaacctgtacgaccttgaagacaaatcaccaaaacaggttcgagttaaagggaagttgataaagttctatgcgacatcgctaaatgcctttctagagacaccaccacttatccagccaggggaccagtacccctcatattccatcttctgtaggatgcgcactgatcctcaggagcttgcctccaagctttgtattccagggcacgaatttgttcttaatgctgaaggagcgccctgggagctcttgaggatggacttgaccaccctggcccagacttggagtgtattatcatactctaacctcgccaccacctctcacacgttcgaccttaatatggacagggcgaggttattccatgggctagttatgaagatggacatggatgcccgggctagaggatctgagggcccatattcagccgctccttctgatccttctccttctactctaactccctctactttagcaccgccacttccatcagttccagcactagctccctttgctccgccatcattagttccagcatag

SEQ ID NO: 31521 - DNA, 1464 bp, Glycine max
  Peptide Sequence Number=SeqID_123206
atggagagcagtgacaacatgcttagctgggaggatggtgtggaactagtagccaacaagtcaccgccggtgaaggaagccgacaagttggggcagtcaatagttacttccataacaaagagggtgaggcatgtaggacaaggtgtcattaatgctgatggatactctactttggggatacacacaaatggtatttatactttgacagaagaaggcaggtctactctacctgcccaccaaaacaggaaagaagtagagccctatggaggtgtttacatattagggacggaaaaggaaaaaggcatggggatggagcggggcatcaacaaggtgggagacttagtagtgtgttggtacaagaactttaggaaaccaactagatcactctctgctagttgcaagaatagaagatttaggaggaggctagatctattatgggtgaagaatgagttagaaaaggcagggaagttatgggatttcgcttgtaaacttggtgttggtgagaaagaagaagaagaattggggagatcaaacggaagccaatatagaggtaatgagattgaggagtttaacacttttattgataacatggaattatttgacacaccattgatgggaaggagatttacatgggtgagagctgaagggtttatggattttgtgaagaagaaatatgcatcttttgaggtccaagggtgcggtgcttttgcatttaaagaaaagctaaaaaagttgaatgtggagatagaaaaatggggcaaggagaagtttggtgacctaaaggaaaatatggggatgttggtgaattgtatcaacaatttggacatgaaggaggcgattaaaggtctttctttagaggtgaagaatgtcatcaaggatttctaccaagagaaattcaagaaagatggtgggatgcatgtgttgctagaaggtgtgcgatttaagactgtcaaggaaggagataatgggctacttacacaactgttcttggaagaagaaatcaagagagcaatatggcattgtgatgggagcaaaaatcttatcgaagttgttggaaaaaaggatgaggaaggtcatggaggggatcgtcgaagaaaactaggaaaggaaagagtcccggaaagggtgggaatcgattttggaagtccattgtggttggccttaagactcccagggtgttcttcttctttctccttctgcctgagtttgtctttttcgcaaactggcccgcgcttccgtgactgcaaccacattgtggagttcatctttgtggagtttgtctctgccacttatcgattgagctcgaagaaaagtaggaaaggaaagagtcctggaaagggtgggaatcgattttggaagtccattgtggttggctttaagactcccagggaagccatcgaagtcgctgtcaaggttcgttgttgcttgtgttctgtgtgctggttagtgatcagtgctgattag

SEQ ID NO: 31522 - DNA, 543 bp, Glycine max
  Peptide Sequence Number=SeqID_123207
atggggaagcataataactctggatgggagtggtattttaatttgagaagaccgttgttcgacagcaaaattggaatggctatcacttttctttctgaagttgaaggtaagcctgttcacaattatgggtctgatagctgggactgggcagcagacccgtcgggtatctactctacaaatagtgtttattcaatgttttgggaggaagcaacagtggacagtctcgaggaatgctttgaggagctatggaaaatcaagattcctagtaaaatagtggtcaccagaattgaagaaggtggtgtcagatttggattccaaaaccagcaaaagagaacccaactggctaatcgtgattgtcaccaaacaagtaattataaagaacctgtacctatgactcatgatccacaattgcctcctaattctcacgtgctctctaaatatcatgttagcatcagacccacacccttcaaaaagcttgcgaagcccttcaaacctcaatatctgaagctcacaggctcaacattatgggggcaaggattatga

SEQ ID NO: 31523 - DNA, 393 bp, Glycine max
  Peptide Sequence Number=SeqID_123208
atgggtgcagtaaaggaggtacaagaacaaatcaaggctgacatggaggccatgaaagagcaaatggccacagtgatgggggccatgatgagcatgaagaagataatggaggtcattgcggctgcagttgctgttatcagcgccattattgaggtggacccgactccccccatctggcctcaatcaaataagttatctgacctcggatgtgacttcaagccttgcctcggatatgccactgaagggcaagcagttggtggtatacccatgcaaaacactttggagggccctcaatttcacccccaaccacaacccttgcattccactgcgagtaaaatccctcctgctatggcagcagataaaatctctagaggaaaggctcagagccattga

SEQ ID NO: 31524 - DNA, 258 bp, Glycine max
  Peptide Sequence Number=SeqID_123209
atggtgggagcaacgaagaaaatcgactcaaaagattcaatgttctgttacaagaacatggaagggacaatgagtagaggaaaaagcgagattgaggggttcacaacttcaacgtcaatgatgacacaagagcacaagagtagtggcacattgtggtggcacaaaggttttgatgatgccaaaagaatttacttgatgaaagcacacattgtttcaagtcaaccaacaagatcaagaaaatcacagataaggacttag

SEQ ID NO: 31525 - DNA, 189 bp, Glycine max
  Peptide Sequence Number=SeqID_123210
atgtataaacagaatcagaaggactttctcaggcttatagtgaggtttggctacaaaaattcattggtttttctaggattcaaaggaattaatgaagcattgggattgaatccagaattgggcttgggcttgaatccaaaattgggcttggacttgaagagggcagacaattttattctgcaaaattag

SEQ ID NO: 31526 - DNA, 162 bp, Glycine max
  Peptide Sequence Number=SeqID_123211
atggacgaagatcaatggatgtatgataatataaggtctgaagaagttgatatgaatgaacaaaatgaagacaaagttggtgtgaatgaagaacatgttgattgttttgatatgttcaatacttctcaggtgtttgctacccatgattatattctgcattag

SEQ ID NO: 31527 - DNA, 618 bp, Glycine max
  Peptide Sequence Number=SeqID_123212
atggtagatgtcagagtattgattcatgcaggactttttcattctagcaaacatgggatcaaatcaaacacctttgttcaagaaaaggttctatcaagtcaaaatcaagagcttagaggtcaccagtttgtgagagttggggcagttgatgggtcaacttcaacggaaagccttttgcaaagcctatggtgcttcatttttgaggatttccagctaataccaattgtggaagagtttgaagaaatcctgggatgcctactgggaggaaggaagccataccttttctcagggttctatccctccatggtcagagttgccaaggtagtcaaaatctcggcacaagaattggattgggtaaagcaaaacagaaatggagtagttggagtaccaaagaagtgtttggaggaaaaggcaaaggccttggcaagtcaaggcgaatgggctcctttcattgacatcttgatgcttttgatcttcggagttgtcctctttccaaatggggaagggttagtggacctagcggtgattgacgctttcctcacttttcaccacatcaaggaaagcccggtcctcgctattttgggccgacatgtaacacacgttcgatcggagatgtga

SEQ ID NO: 31528 - DNA, 423 bp, Glycine max
  Peptide Sequence Number=SeqID_123213
atggtatcaagatatgcattaaaccaaatcgctgctgagttagagttaagtttttcagaccaaggtttatctgagcccaaagtccacataacccaagagatggaagccatatttaagcggtttgaagatcttgatatatgtggcaaagtgactctaaggagtaaactttgggaacttgcataccatgatctaactttgatgtgtgctcctcctaaaaaggtgaaaacaaaaggtggtcaaaagaaatggatgaccaaacaacaaagatcaacgaagtgtgatccgtcttactttgagtatctggttgcattaaattcagtgcaagatagctcctccacactaaaacggtctggatcatcatctgaacaaacaaaacaaaagaggaacattccaatgttggatcaatttcatccatgcttgtag

SEQ ID NO: 31529 - DNA, 261 bp, Glycine max
  Peptide Sequence Number=SeqID_123214
atggtagaaagggaaatgatcgcaatgatagtggacacactgccagtgttctactatgaaaagctggtgggttacatgccttctagctttgcagatttagtgttcgcaggcgagaggattgaggtgggcttgaagcgagggaagtttgattatgtgtcacctaccgacaccaacaatagaaaggttggagtggctggggcaaaaaggaaggaaggtgacgcccatgccatcacctcgacattggcttggccaaaaccttag

SEQ ID NO: 31530 - DNA, 228 bp, Glycine max
  Peptide Sequence Number=SeqID_123215
atgggttggaaccctggccctgccgacgatgcgtgcactagtagaaagtctcatgtagccgcacctgacccctgtggttggttgcctactgcttccactaagcgcaacactcataggctaagtgcgaggaagactctggaagaagatgagccatacagactagagcttgaagcaggagtcgatttgagagcttgggatgagttagtgagtgattgtgagatcctagag

SEQ ID NO: 31531 - DNA, 736 bp, Glycine max
  Peptide Sequence Number=SeqID_123216
gccacttgtccaacagttgattccctacagacaacgatttgtaaaagcatggacgaataaggtgatgcatctaggaaacacaacaacttacagggttgagtctatacattggacctcaaagagactactccgcaaggtgtctccgcatgtcatcggacactcgggtcactggatagcaaaaggcgatactaaatggtcccgaccggaagacgctgatatctccgggaagggtgcagatgaccattttggtctctacgtgtcatcagacttggggtctccgaatgaagatgcggataaccgtaaggtgagactaaatgctctcggcggaagatgtgacatcttcgggaagggtgcagatgaccacattggtgtctccgcatgccactggactctcgggtcgctggatagcaaaggtgagactaaatggtctcggtcggaagacgctgacatcttcggaaaggatggtgtagataaccgtaaggtttctgtatatgccaccggactctcgggtcgctggatagcaaaaggtgagactaaatggtctcagccggaagacggtgacatctccgagaaaggtgagactaaatggtcccggctggaagacgctgacatctccaagaagggtgcagatgaccacattggtctatgcgtgtcattggacttggtatctctgaattacgaggtgtggataactataaggtgtctccgcatgctaccggactttcgggtcgcttga

SEQ ID NO: 31532 - DNA, 819 bp, Glycine max
  Peptide Sequence Number=SeqID_123217
atggcagaatcgtcgaagaagcgaaagggaacatcctccaccaccgctgctgctggccatcgccgccacagaccatctgaagcactcacaacacctattcatccttccttatcatctccacgatcatctactctattttcttcagatgatcaacgtctacggtacaactctcaattttcttctaggatcatcttagaccctaagtacctagacacaaaattctttaatgatgagacatttggctgttatcaagctgaaatgactggtagattgctggccggatcattaacctttgattgtcgcatcatgcactatattatcgttagaattttgcttccccgttcttctaatttggctcaagcctctgaggaggacttgattttgatgtgggcttttcttaccggttgtcagatcgactgggctcacttggttaggtatcgaatgcataaggcattacgggccaatgaacctcttccatatcctcaattggtcaccctttttctccatcattttcaaattcctcttgatgatgaaccttttgttcaagtcaagcgatcctttgctataggtgctggtgcagtcacttcatttggttaccataaggatcgtaatggtcaatggctgaagaaggatgcgctacaagatgagcgtactctttctcctcctcctcagcgtgatgattcctcagcccttctaactgaagttctttcagagttacggggtctctgcacctatgttggcatggatacccgcattacccagcttgaagaggatgtgacttatcttcgtcagagcttcgttcttccaccaccgtcttag

SEQ ID NO: 31533 - DNA, 1020 bp, Glycine max
  Peptide Sequence Number=SeqID_123218
atgcagccacgacattatggctcaaacttaaaccaacccaaaaaaatttctgcagcttttgatcttgcaggatataattattgggactacattgacgcctggaccaatgtgttctggcatcaaaatagtaaatttaagaattcatggctaatttacttcaagaataacactgtgtataattttccaaattggttcctccaatggtggaactacttcggaccaattccgcagatatttccagaagaagtccaacagggattccaacaattcagcaagctcttcaatagcaaggaatcaagaattctggcagatttaaagtacttttccagttttgccttgtcatggatcttttcatggcaatacagatatggaaaaaccgaaaacagcaaacagtatccaccattgcagagacatgcctttgtaaagtggtggtcacaattcgatacctcaaaggctgctccagaacaagtcaagaactggtttcagagcaaccctgagtttctcaagcctactgatccagagacatctttgtttctgaatcaaaagtcacaacttgcagcattcttagcaagctcaaaatctaaagagagtcttgctcagaatcttaaggaagttctccaactacttcaacaggaagaagaagaagaatcccccaagaaggaagccgaatcatccgagaataatgatgaccaagaagatgatccattctaccagaatgaggatgactcttttggtggcataccagtcgagcttgttgaggcaactaagcatttccctccctacgaactcaccaatccagcaaaaaaacgaactcacgaagccgattttaacattctaaagggagaaaggtttgagcaagatgaaggtttaagcacccacgtttgccatttgcggcagtcacatgaactcgtggagcaatttgcggcacttaatggcaagttgagtggcacgaacaaagggagaaaaggttttggggttttacctgcaatggcagtgacgacggtggcgatgacggcctaa

SEQ ID NO: 31534 - DNA, 408 bp, Glycine max
  Peptide Sequence Number=SeqID_123219
atgaccctttcatcatggcaaaacaagctaaacaggcccatggctactccacctgcctcgcctcctcctctttctcctccttctccttctcctgcaacagcattagcgtctccgtctaccttaaagcggacacgcaaagccacacagctacgatccttggccactagaccacctggggcagagagaccaatggtccacgtcaatcctgcgaccgggaaggccgacggtccccacaagaagaaattaagaacatatttggggattgtcgctcatgataaggcaaaatttgatatcccggaagcttatgactgtaggacaaacaagaaagatgtgcgggaaaaggcacaggccatccagaagcaaaacaccgacccccatgtgttgtctcatgggggttatgaatattag

SEQ ID NO: 31535 - DNA, 1549 bp, Glycine max
  Peptide Sequence Number=SeqID_123220
agacccctcgtgggaggatgtgcgggaaaaggcacaggccatccagaagcaaaacaccgacccccatgtgttgtctcatgggggttatgaatatttagaacagaagctgatggctgagaagataaagaaaaaacttgaggagctgctcagtctggaagcattgagggcatgggacgacaccgagaaaattgggcagatgacgtctgaggcagcaaaggaaattgctgagaagattgcgtcacagggttcatttgtcccctatggacgtcaggatctcctgactgctgccattgggcaaccagaacaccctggtcgtgtgcgtgctgagccattcttcctccatggatcccaaagaactggagcagctgactcaacaaataaaggactagctagaggagttgatcacataaaaagtgactcggcagctgatgttatccttcaaccagatcctgaggttggtccctcagctgctcgtgtcagcacaaaggggagttatgttgatccctcactgaccgatccagacacgggtgactcagacaaatgcggattgtacatcaaagaaaatctttcctgcctggttgccctaggaagattttatgagggatccacagcggttcacaacatccctttgttgcatggccaagtgaaggttggtgttgaggaggttaaagatgcagaggctctcgttcctgtacccattgatgaggttattttagtgggacagacacttaacaccttccttgcttggctgacacatctcgtgaagcgtttatcagatcagcctttcgcctttgaaacacaaaaagcttacaacaccttgaccaccgctatgaccactgtcatggttgtcgttgcatccaccaaaatgtttggtagccccgccattgtcgtgaccaccacccgtgccacctccatgactatcgctgtggatagtatagaagagtatagaaggatctctttctatggcgatatagtactcgacagttcaaggggtggggtacctgcaaaaggcactccaacgctcaaagggctaagacaacctctaatggtggttatcaagacaatctttggtgataatgcaagaatgctcaactatccaactaggccaagtgaaggaagtattcaattattcggccaggtcgagtacccgagtacttctagtgggattacctttgatgtcaagttgagggaaatattcaggttttcgggagttcaagtatttggcaagggcaagtaccttggtacttttataaggatcacttatcgcgtcaagctagaatacttctctaatgatcacctacagtgtcaaggtgagggaagtaaccaggtcgagtatctgagtacttctataaggatcacctatggtgtcaaggtgagggaaatacttaggtattcggctaagccaagtacccgagtacttctaaatggttttccattggtgttaaggaaaaatgaagggtattacctggtattcgacctagccggatacccatactctatacaagccccacaagcctcgaggagtgtagtaaacaagaaagccttttag

SEQ ID NO: 31536 - DNA, 207 bp, Glycine max
  Peptide Sequence Number=SeqID_123221
atggtggtggaaagaaatatcgacaacaatgatgacaatgacaatagaatagtgacaacgatgatggtggtgaaatgtgatagtaacagcaacaacgatgatataaactacgaaatagtgatagtgacagtggtggtgataatggtgacggtggcaacaacgggatgtggtaatggtggaataggggtagtgattgtggtggaatag

SEQ ID NO: 31537 - DNA, 348 bp, Glycine max
  Peptide Sequence Number=SeqID_123222
atggtgcaagcttatagctctagcagccaggttgtaaagatgatatctcttcctcatgcattaattgtcactcaagatgctagccagtggatccctcctgagattggtcaagttgatgggggcaaaagggtattttccttggttttcctggaccctagctcgcccaggctagcctctggctcgcttgggccaccaaatagcttcatggtgaagaaaccagcttgcctgggcaagctctttgcttcagctcgcttgggcgagttgcaactgcctcaaagtgaccctttgcctataaataggcatcctaggggtgttttaaagggttccaaggttcataagtggagataa

SEQ ID NO: 31538 - DNA, 336 bp, Glycine max
  Peptide Sequence Number=SeqID_123223
atgattcaagataaaaaagatgaagaaaaaagtgaggagagaacacaacaacaatgggagaagtgctcacaagtagaaattcaacaagaaagtattctccaagtcaatatcccttctcatcaattgattgtcaaggaagaaaggcatggagaacatgacaaatctctaagtgtcattctctccttgatcactagcacttctcttgcaatgatatggaaggcattttcaggatacatgagtttcatggagtctctagctaagaggaaaaaaatgcaaggaagatgtgttctatgtgaccttcatgccaccttgaaggcattggactcgtcaagctaa

SEQ ID NO: 31539 - DNA, 444 bp, Glycine max
  Peptide Sequence Number=SeqID_123224
atgaagggaatcacaggagcaccttacagggcacgttgtgatgctttgaccatcacaaatgtgtcatggttgtcgtacactgagcatcggggggttagggcctttgagctgatttcatcattccagggtcagttgagatggggtcctaagatggtcacagctcgactggagagggtggtatctgcggattacatggagtggtttttccggatatctcacccattcatgataccgacccaggcaggtgaccagcccagagatgcaccagccgtagaccctgaggagtacatacagccgcctagccccccggatgattacgactgctatgaggcgattgcacagaggttggagcgtgtgctcaaccttaggatggtcactgcagacacagagttatatgatattagacggggagccagtgctgatggaagtgtcagggctcgatag

SEQ ID NO: 31540 - DNA, 372 bp, Glycine max
  Peptide Sequence Number=SeqID_123225
atggctagaacacgaggtttaggtcgtgctataggtagagttataggcagagatacacaggatgatcatgatgcagttgatgtttccgagaggcgtaggcctactgcatcagcccttaggcaacgggttcatcagatgactgcggatgcacctgatatggctgaggatgttcctgacatgactgaggatgtccctgatatggctgacgatgcacctaagatgactgacgacaaacgtcctgatttgaagttggtgtcacatgggaggaaggtgacattgattgggaggattaagtccactgatcgattgttcacacagcgagaccaacaccttccaccttccggtaggagagttgacgatcacattggatga

SEQ ID NO: 31541 - DNA, 591 bp, Glycine max
  Peptide Sequence Number=SeqID_123226
atgacattcttaggagaaacaagcagtcagacgattgtgaactcaaggttgggtttcatttttccaaatggatcaattatttacaatgatagtggggtttacttccaaagttccactccagtgcccattcgagtaccaaacagctatgacattgcaacgctgaaaaccagaatacacatcacccttaatctaacccacgaacaatttttggatgaaattcactaccaacagccagtcatagagacagcttcaatgaggtcctttaatggtaattttccaccatggagatgcagcggaagacaaaggagaagaggtgagaggaggcgccatccactagggaataagccatggaagaaggagcttcaccaccaagatgagccttggataagaagcttggaaggatgcttcaatggaggaaaagaaagagggagagaaagagagaggggggagcacgaaattgaaggaataaaagagggagagaagtggaactttgaagtatgtctcacaagactctcattcatcaaagttacaataagtgttacacatgcttctatttatagactaggtagcttccttgagaagctttcttaa

SEQ ID NO: 31542 - DNA, 351 bp, Glycine max
  Peptide Sequence Number=SeqID_123227
atggcacctcctctcacctcttctcctttgtcttctgctgcatctccatggtggaaatcaccattgaaggacctcattgaagctcaaagatccagccttcatagaagcttcacaagcaagcttccatcaattcaagaagattgttacctgctaactgagaaacaaagtggcagccctaaagcgcacaacacaacacaacatagcatgggttctcctttcagtttggaagcaagcttcatgatgatgaatcaagttgattcaagtagttttgatgatgacaaagattatgacaaaaagcccaagagaatgatttcaagattgagtcaacaagttcaagatcaagtttcatga

SEQ ID NO: 31543 - DNA, 288 bp, Glycine max
  Peptide Sequence Number=SeqID_123228
atgatgataacaaaagatgatgacaaaggtgatgacaaaaagctcaaagatcaatcaaagaacaactcaagtgaatcaaagatcaatcaaagaacaactcaagtaaatcaaagatcaatcaagaacaattcaagagttcaagataagaatcaagaagaattcaagactcaagaagaaagtctagagacaagaatcaagattcaaggttcaagatctcaagaatcaagatcaagattcaagactcaagattcaagaatgaagagaagactcaatcaagataagtattaa

SEQ ID NO: 31544 - DNA, 96 bp, Glycine max
  Peptide Sequence Number=SeqID_123229
atgacgacaataagcgactatgtggccacagttgtcagcaatttacccccacaacatcaaggattgcaacgaaacagcgaccatatagcaacttaa

SEQ ID NO: 31545 - DNA, 501 bp, Glycine max
  Peptide Sequence Number=SeqID_123230
atgtttcccaccaagagtttaaatttttcttctgcattcattcagacacgcagatgggatttggcggatgttttgataaataggggagtaaatttggatcctctaagcaaatggtcaacggttggacttgtggtgtatgattctcaagtgcctattggtgccactcctgagtatatggctggtttctacacgctacaaagtgcaagctcttttttgccctttatggctttggctcctcaagagaaggaacgagttgttgatatggccttctattttgctgaagaagtttatgccctttgcagagctgcacctggtggtaaaacaacttacattgctgctctaatgatgaatactggtgcttggcacccatcattaggcaatttgggaaattccgggacatgccggaaatcaaaagaaaatattgatgcacaatccgtaaggttccgtgacacaccggaaatcaaatggaagcatcgttgcacaattagtgaggttccgtaa

SEQ ID NO: 31546 - DNA, 144 bp, Glycine max
  Peptide Sequence Number=SeqID_123231
atgcagtatagttatgcggtcaaaattagttcacgcaaagaggaagatagatatgtggaggcaggagagattaaggacaagggcaatgaagagttcatgaatgttggcaaggcggaagctagtggacatgtaacacctagatga

SEQ ID NO: 31547 - DNA, 303 bp, Glycine max
  Peptide Sequence Number=SeqID_123232
atgggagtaagagaggatgcaagaatggttgggagtgagactatgactgttgagacggaggagaatgagacggagtgcgaaagcgacttgcaacgccatgaagagtggtcgggacttgagagtggccgggaggagctaagacggaggagaatacaccatggaagtcacaaggtgaggctctataattccttggtgtcgcaacctaccctacgacgggagtgcgggcaaaaagccaaaggagcgttttccaaaaaggaaaacacgtgggagtcgccaccaacgtttattcaagaaaaacgttag

SEQ ID NO: 31548 - DNA, 101 bp, Glycine max
  Peptide Sequence Number=SeqID_123233
atgacaatagataccttagagccctacattggggcaatgagagacaccatgcatgagcctcaagcgaacctagggccagatccgaagttcttacccgatag

SEQ ID NO: 31549 - DNA, 201 bp, Glycine max
  Peptide Sequence Number=SeqID_123234
atgatatgtccattacaatgccatgaagagatgcatgatgtgatcaaggaacaagccagaggactatcaacgacaatgcattaccaaaagaggaaaactctagatgaggcttcactattatcaagcgagtcagagacccagcatgaccacagatcgatctccactccttatggctcacatagacccaggtatagggcctaa

SEQ ID NO: 31550 - DNA, 156 bp, Glycine max
  Peptide Sequence Number=SeqID_123235
atggtgcttgagagggcttggtatgaaagggtcgcacttgaccaaattatgacaaggaagaaggagatgagggggagcgctgctgccgctaacggtgatgaagaagcaagaaaaaatgggaaagtgaggggaaaaagaatgatagaatggaaatag

SEQ ID NO: 31551 - DNA, 159 bp, Glycine max
  Peptide Sequence Number=SeqID_123236
aatagtgggaggtcttcttacggtcctcacatttattttgctccaccatcaatgcagaaaacccaaggcggacgctctaccgacaattggcatctttgttggtttggaccgagcattcgtattactcggtcctggtcggggaaaacatacaagttttga

SEQ ID NO: 31552 - DNA, 177 bp, Glycine max
  Peptide Sequence Number=SeqID_123237
atgagtctagaagaagctcaccaccataggagaccatggataagagcttggaggaagaaggagatgaatgaagggagagggagagaagagcacgaaattttgtgctctaaaaaagctcttaaatctaaacccactaatccaagatcaattccaagattctccactaagtgtgcttag

SEQ ID NO: 31553 - DNA, 1131 bp, Glycine max
  Peptide Sequence Number=SeqID_123238
atggctcctgtgccgagcagaaccgtggccacggcctctctcgcctcgctccttccttcttcccccttcgcgagggcttctcttctcagaagcgcttttctgccgccgcaaatagggcgcgacaggaagtgcttctcccccgccgcagggctgcggtggacgcagcggcgccaggggaggagggacgggctcgccgtgcggtgcgaggccgccgtggcggagaaggacgaggccaccggtgagaagtttgagtaccaggccgaggtgagtcgattgttggatttgattgttcacagtctgtatagccacaaggaagttttccttcgtgaacttgtcagtaatgctagtgatgctttggacaagttgagattcttaagtgtgactgagccttctttgcttggagatgctggagatctagagatacatatcaagtctgatccagacaatggaactattactataacagatactggtattggaatgactaaagaagagctcattgattgtcttggaactattgctcagagtggtacctcaaaatttttgaaggcacttaaggaaaacaaggatctaggagcagataatggtctgattggtcaatttggtgttggattctactctgcttttcttgttgctgggagggttgtcgtgtctacaaagagcccaagatcagataagcagtatatgtgggaagcagaagctgacagtagctcttatgtgataaaagaagaaactgatcctgaaaagtttctgcgtcgtgttaaagcacccaaattcttctttactggccaggaggatgacaagtatgaattctcagagccaagcaggattcagggtttggtgaagaattactctcagttcgtttccttccccatctacacatggcaagaaaagtcaagaactgtggagaaaaaagacagaaccagggtgttgccgtcgcagtttgtagccgttgccgccgccgtccgttgctcgcctgcgtggtgcgtggtgccgtcgttgacttcgggtgagacagtgagagaactcgcgctggtgcatggtgccgtcgtcgctggtgcgtgctgctcgtgctcgcgctggagttcgggagttcgcgtgctgtgtgctgctcatctcattttgatttga

SEQ ID NO: 31554 - DNA, 1206 bp, Glycine max
  Peptide Sequence Number=SeqID_123239
atggcatcagctgatgtagaggacactggggcagacattcctgcatacacaagcgcgcaggctgctgaggatgagcatgagggatttctgggtggtccgagcgacccatccgtgctgacccagtatgcggatcacgttgcttgcagcgagcgtcctgagttgaagttatcctctcatgggagaaaggtccatagtttaagcaggcttgtccctgccattgagggactagttgctgggacaggacaaagtcctctgatcgcgtgttcggtagacactggcgatcggagacttttgtcctcgtttgtcgagcggtggcaccgggagatgtctagttttcatctccctgtgggaaaggtgacgatcacgctggacgacatctcctcgcttctgcatctgcctgtggttggcaacttgcacgcctttcagcctttgcacgtggatgatgtagttcagatgttggtggacttattgatggtctctgcaaaggctgtcagggctgagacagggcagtgtcgtggaccatacatatgcctgcaatgggtacgtgatatctacgagcgccgatgtcaggcaggtcattggacagctgcggctcgcgcatatcttcttcatcttctgggttgcactctgtttgctaacaagagtgcaaccaatgctcatgttgtggattgcaacgaagaagactgtgaagagcatacgtacacaggcatacagggagcacctggactgacttcggattccggatgtcgtttggatcctatatggggagcaccgaccgggtcatgcggcaatttggatacacctagaccattcttgatccgcctatcgattcatgggtgtcgtatgatgatatacacgacaggtcagtgtgccaacgactacatggactggttcttccgcatctcgcatcctttcatgacaccaggccaggcatcagatcctctgccaaatggtcatgctccacagcctcgagtcgtccctcaggccctacagacagataaccctcacgtgtcggagtcaggagcaccgtcgacatctgcgaggtctgctgtggaggagcctagacatacagtgaaagtttgccatgggattgctgagaggttggagcgccatctgagcctaggggtggtcacgctaggctcatcaacacatgaggtgatcaaagaatgtctcaggatggccaggagtgtcacacaggaccaacta

SEQ ID NO: 31555 - DNA, 162 bp, Glycine max
  Peptide Sequence Number=SeqID_123240
atggtggtcatggtggcggtgattgacgatcatggtggtggttatggtgacaaccatgatagttgtggtggaaacgatcatgatagtggtggttgtggtgtcaaccatggtagttgtggtagaaatgaccatgatggtggtggtcatggtgatgatagttga

SEQ ID NO: 31556 - DNA, 2115 bp, Glycine max
  Peptide Sequence Number=SeqID_123241
atggcaagggcttttgaagatttgtgtcctttcttcaacattcagcctagtgtgctggtcttcttgtttttcttccaaataaaattatctggcaagattggatgggtctccttgaatagtgtgtcgaagaagctattcgagtttgactcaaacttacgccatttcaaggaccatttctttaaggtcctagctattgatgtcgtggttgatggaatgccactgatacttaatagggacgaggagccccacattttgttctacttgcagtctgatcccaccagggtcaacaaagcaattttggagcagctgctagcctcgttggatgcacatgacattttgtctcttccttcgacgagtgatcctttcactgccttggatggtattatgggtgacttcgcttggaggccactcgtgaagcaggtgggacctacaggtgcgatcgtgccaccatctattactgcttcgtctgctgaagatgtgggtcaacttgttggagaggttgaccttgttattgttgttggtgaggtcacccccaacgctcattcctctattttggtaaagaggaagatgaatgatgctgatatgcctccggctccaccgaccatcgaggctcctgctgctattagcacttctgctacacctactccttcacctcctcctgcagttgttgttcaggagattactcctgctgctattgaagttgtcgtgccagccattcaagctgattttgctgtggcgctgttgtccaccgttgcgacacctttgttaagtgtcggtgtagtgaccactgatgctcccacagtgttgcctcttttttcatcgattacaatggtcctccctactgctgttttggtggctatggcgtcaccttctttgtcctcatgcccttacgtccccctcgatcatttatacacctccagtgatgctgactcactatggggtgcaacttacaagccggggcagaagacctcggttggctttgtgttagccttcaacaagaaccttatttggtcgactggggacaatgaacttctacatcaaaaggctatgcaaaaggtggcatcctttgaggtggagtgccctaaggtggctaatgccattgttgcttttgctgaggtcgtaatggcgaaccaccaacaggcttccaaggttggtggtgcattgtccaagttgttacgtacccggttagatggtgatgacttgtttagatgctacaagaacttgcaggctgagaagatgggtggcaaagtggacagcatggcgattgagaaggatgggcttgccaagaggattgctgagttggaggcctggtttagggagtcagagtctagattggaggagtctgagctatgggctgccaaggaaaggaaggccaacaaggagctcgaggaagagctgattctatacaagaaggaggccatagagcaacatgagaaaggctttcaaaaggttgtcaggcagaccagtatctttgtgaaggaccttgacttgggtctcttagatcccttcaaggatgtgaaggagggtgtccttcttgatgaggaggagattgatgcagaggaggaggctgctgatgaagggcagggtgctgcggagcaaggcgatgatgcatgtcttgttatgaggagtgagtgtgagatgcacctgattgaaggtcttgtcttgcgaactagtggggtgatagtttgttgggtggaacttggacccttgatggtggtcgtcatagttgctgcaacctataatcctgcacagataaaagttaggaataggaaaaattatcaaggggatgtgtttttcctgggttttgtcaagcctacggagctgtgtcgaggcttaccaaggatagactttgggttttgtagccctataaggatcaacgtgagtgttgtgctcttgcatacatggcactcaccgtgggtggcatttactggaggcggactggcttgctcttgcatacgcacctcttacaaagtggccggtattggagacttggtggtgcaccgtgctcttgcatacttgccgctcgctataggtggcacacattggagatgtggtgatatgctcttgcatatatgccacttgtggaagcaaagcttcatgatgaatcaacaatga

SEQ ID NO: 31557 - DNA, 648 bp, Glycine max
  Peptide Sequence Number=SeqID_123242
atggccccaagcttgttgagtgtctttctactgattaaggcaaaggatgatgtgtctgcgtcaaccgctcttggagagcttaccttgactgaaggtggtcatcaagtccatgtagcctctggtctcgactctcttgcctgcaaagccgaggagcagaccgacgtgagggtggacaatgttggcgaaacttccctagtcgatgaggaccctgaacaccataaagtttgcattgatgatggagacaagcatggggtcatcttggttgacggggttgatgcccttgaagtttttgtccgtaaagggtgggttcctgttctggtggaggttgtcgctcacatcgctgtggctggtgcttttgtctggctcggctggcttgtaccttttgtccgacttgtgcaagtcggccttggtgtgggcttcgcgcttgttgcgcttctttgcagcttggcatactttatttcagaatatagacatttcttccatctggatgtagccctttgctcactgtctacgaacttatcgaggcgtaaggcagggagcatggaattcaacgctacctcgggattgagatttttggatctggactatccgagggacttgtcgtctgcttgtcgtagactggctaaggcagctgaggtcatgcgatga

SEQ ID NO: 31558 - DNA, 327 bp, Glycine max
  Peptide Sequence Number=SeqID_123243
atgcttccatttgatttccggtgtgtcacggaaacttacggattgtgcatcaatatttttttggttttccgacatgtcccggaatttcacaaattgcctaatgatgggtgccaaacaccttacaaggaccaaacaaaggtcgcatgtcatcaagcaaaggtccccggacgaaatttggcactaggagtaccaacattggagaatataaagatacaccacaacgtgctagctgttatccacacctcctattggaggatccacgtagggaactttgttgaagttatgtttggcctaagcaatggagatatccctagaatgattgattaa

SEQ ID NO: 31559 - DNA, 129 bp, Glycine max
  Peptide Sequence Number=SeqID_123244
atggtgctaatcaagaacactgcttgtgttgtgcttgtatttctttctgctgcctggctatccactgctcgcatgaaccctaaaagtgttgctgttagtgaaatttcatatataaagatgctcttatga

SEQ ID NO: 31560 - DNA, 624 bp, Glycine max
  Peptide Sequence Number=SeqID_123245
atggcccatgcattcacagtcataatcaagtatggttgtggtcaattgaccatggtcaaggcagttactgttagtgtcgataatgaccatggtcaagctaactgctacaaagggaaggagttgcaaattgaagatgatgatgaagttcttccaactaagtatgtaaaggctcgtcctgacagattgttcatacatgagcttgaggatcttaagcaaaaggagttctatcttgtgtttgattgcactttctcactccttgtgcatctgccccattccaaattcaatttcactccccaagtgcaacctatcattgaagaagtggattatgatgttgaagttgtacttgatcctgatgcaatggcggtttccatctatgatcctccatcttcaagggcatatgtcaaaatgatcgaggctgagcttcaaaggaggcaagaagcatttgctcaagctttgaaagatcatgctcataagatcactagatggaaacttgctagacctctaatgccttctgacactcctgccttttctattgatctctcatcagattttgattattttggtgataagtatttaaggaagcttgatgaagatattgccaaactaaatggggagaaaaagtaa

SEQ ID NO: 31561 - DNA, 219 bp, Glycine max
  Peptide Sequence Number=SeqID_123246
atgtgtgtgtggttgtgtgtgtgtgggagcgtgcttgtgtgtgtgagtctgtggcacaagctggatttcgaagttagctttagaggcaagagacaagtggtgctgaccgacacaatgtgcccattctgctgcatcatgaggaggacgttgtccacttgttctttaactgcagtaagaccctacctctatggtgggagtcattatcttggatcggagtag

SEQ ID NO: 31562 - DNA, 522 bp, Glycine max
  Peptide Sequence Number=SeqID_123247
atggaggctatgagggagaaccaacttcaaccattgatactaccaaaacaaacaattctctcatgtaaagagtgttggggtaaccaccatacctcttattgtatggaggaagtagctaaggaagctaaattcataagagaacacactacaaaattagaagaagtcgtaatcaaccttagcaccacatcctactccaaccttgagaacaccatggaggtaataaattcattaaaagatcaagtaaaagaagccagtaagaaaagacatgaggtagacgacggagtgaaggaagacatacaagaggaggacatggtagttgaagaaatagcacgagagacaactaagacaaagagccaactaacaagagaagctaaacaagcaattacacgtgagaagccgtatcctcgcaaaccaacaaagcaagacaaggagcggcgatatagaagccttatagacttgattaagcaactcgatgtcaccattcctttcaccgatttgataggcataacgttgaaatactaa

SEQ ID NO: 31563 - DNA, 615 bp, Glycine max
  Peptide Sequence Number=SeqID_123248
atgaatttgttgtctagcgctgttcatgtgtcctccgttatcaagagcggagtctctggtgactgggaaaaaaaaaaagaaggagtagagatgagagtcgtcatcacggaaagggcaggacggatgaaatcagtgtcttatctttgctttcctcttatctccgatgagagatacttggcaccctttgttgcgcaatatgtgaagtctcgagacgtgccgaaaatcaaaaggaagcaggcttacgcgatccgtgaaaattctgtaatattcttcctccagaaggctgttgcttctggaggaagcaaccttgctcgcctgggcgagctgggtggcaagatcctcccctattttgctataaataaggggaatgaagggagaaggggtttagccgtcttggcacttcttattctctcaaaattgctgaggaaaattgtttccgtgaagaaaatccaagccgagacgcttcctcttcaactgggtgtcatcataacaactaaacatggttcaacgtttttaagcggttcatcaaagatcgttcaacttgacaacagaatgtcatttgatgccttgaagcaggctattggaaacaacattagtataccaaatggtcatgtg

SEQ ID NO: 31564 - DNA, 156 bp, Glycine max
  Peptide Sequence Number=SeqID_123249
atagtctggtcaggagacttgctttctccctcggcaatcaagccttatctaggcataattgcttcagaggggatgctctgttggcctgaccgtggccattactgttcttttggacttcctctataccaggggcacgccatctatggtggggaataa

SEQ ID NO: 31565 - DNA, 579 bp, Glycine max
  Peptide Sequence Number=SeqID_123250
atggaaaaatctgataggaaaaccttcaatgataagaaagcaaagaaagcttacatcacttgggaaaataacaatatggattcatccggagactcagataataaagtcgtgaatctaagtctaaaggcaaaaaattatgaaagcgaagaagagcggatgctcttaacacatgatggagatgcatcaaagtttactcatatttctcccaagaatagtggacatgtgacttatggcgacaacaacaaaggtagaattcttggagtcggaaaaataggtacgaatccatctacctccattgaaaatgttctacttgttggtggtcttaagcctagtctactaagtatgatgattcttgatttctttcaaccttgtaaaaatccttttacaagcaaagatccacaagggatgtaccctcccttgttctctttgaacctagtggatgtaccctccactagaactgatccacaagagatgtaccctctcttgttctcagtcaacaacccaagtagatgtaccctttacttgtaccacaaaggatgtaccctccaatgtgttaagacaaagttctcaggcggttaa

SEQ ID NO: 31566 - DNA, 432 bp, Glycine max
  Peptide Sequence Number=SeqID_123251
atgcattaccttgctcttggtgacagagtaattgacattaatagcaggaaagagaagagtcccattctcttacatctgatagagccccttaactccagtggtggtttcctcagaaaccccaatgagatgctcttcatcttgcggtacctggtgggatcggtcttcaactcatctttgatgatggagttcattggtcttctcaaagagctcctcggccttgacgccttcatggatgaggagggtagtgtcaccatcgttgttgacgatgaggtcgggtcttccatcgaggccctagtcgaaggcatgctcgatgcaccactaggcaatagcagtggcggtgtggtcctaggtggagaagatgttggaggagcaccagtggacctcggtgtaggaaaggtactcgcgaccactcgtggttttctccaccaataa

SEQ ID NO: 31567 - DNA, 165 bp, Glycine max
  Peptide Sequence Number=SeqID_123252
atggctgggacgccacacacacaaagaatttccctccatgtcatctactgttgttcatctgttcccacaaatgaagggtcacgatcatcgcagggatatccaacttggtcactgcacccctcatgtgtaatgacccgcctcattgctatgatatcaccactctaa

SEQ ID NO: 31568 - DNA, 492 bp, Glycine max
  Peptide Sequence Number=SeqID_123253
atgaaattcaaatttaaatggtacatctacttgggtttgactgagaacaagagagggtacatctcttgtggatcagttctagtggagggtacatccactaggttcaaagagaacaagggaggatgggtcgcacaaagcacactgcctatgtctccaatgcagagagttagcttggagacaatagcaagcaacatagtagccagagaccacatagctgggcatgtgtggatcggtcaatctaaagataagctgaagctggctagccatggtggcaatgttatgccttaccctacccacccgacaagcatgcatgagtgtttaagagcctaccaaccattccttgaagtgaaaaggtgttggattgtgaccgcaagcaccacgagaagcttcttgcggctagagacatcataccttttaaggactaaacatactactctggctacaccggagttggaacagacatggcaccttatctatcggaaagggttttaa

SEQ ID NO: 31569 - DNA, 282 bp, Glycine max
  Peptide Sequence Number=SeqID_123254
atgataagcccaaagtatgcggggaagtttctctttccacaagcccttggacttgtcaactctcgtgcgcagggctttaaggataaccttatttgttgcttccacctagtcgtttgtctaagggtgctcgatagaagttacgaggaattctttgtaggcttaagccttgaattgggtgccgttgtcagtgacaatggcatagggaggatcgtatctgcatatgaggtgtttccagtcgatggtgaccagcaagaacttgacttgcccaagggctcttcgtaa

SEQ ID NO: 31570 - DNA, 273 bp, Glycine max
  Peptide Sequence Number=SeqID_123255
atggcatgcccgttagcgtgcgtaccaaaggagccctggtggacctcccccaacatgcgctctgcttccttagcattcacgcatcggagtaaaaccatgtcatggtttctcttgtatagtatgctttcgctcaagaagaaatcggccgccaatctccttaatgtcctcttttcgttttcggaagcctccgatgggtattccttactttcaatgtatcacttgatgtcgaaataccatgacttgtcgtcccgctcttcttctaccaaacagtaa

SEQ ID NO: 31571 - DNA, 513 bp, Glycine max
  Peptide Sequence Number=SeqID_123256
atggctccaaagaagctctccacaaagaggtccaggagggacacccatggagaaggctctagcgcccacgcagagtttgacagtcatcggttccggagtgccgagcaccagcagcgcttcgaggccatcaagggatggtcgttccacagggagaggcacgtacagctcagggaggatgagtacccagacttccaggaagagatagcttgcaggtattgggcaccgctagtgattcccacagccaagttcgaccctgagatagtaatagagttctacgccaacgcctggcccacggaggagggagttcgggacatgcgctcgtgggactttgcctggaccgctgcagggaggcgggtgcggatcatgcgcaccaacatgactactctgactcagatatggatgacgttgctactcagcaacgtcctgtctagtgaccataactctgacctccctctgcctaagtgtcagctggtgtatgccatcctgacacggatgaccgctcacgtggcccag

SEQ ID NO: 31572 - DNA, 459 bp, Glycine max
  Peptide Sequence Number=SeqID_123257
atgcttgttttgacctctggaatgttgcgaaactttacggattacgcaacaatgcttgttttgacttccagaatgttgcgaaactttacggattatgcaacaatgcttgttttgactttcagaatgttgcgaaactttacagattacacaaaaatgctcgttttgagggtcccgaagggagcaagcaagagacgagtcttgcgcgtcatcggacttgaatgtctctggatgacaaaggtgactatatattgtctccacgagtcatcggacttgtcgtctctggatgataaaggtgcaaataaccatgaggtatctccacatgctatcggaccctcgagtcatgatagcaaaattgagacttttttgcggtctcagtcggaagacgctgacatctccgggaagggtgcagatgaccacattggtctctacgtgtcaatgggctcacttgcctctacctga

SEQ ID NO: 31573 - DNA, 137 bp, Glycine max
  Peptide Sequence Number=SeqID_123258
ctgcagctgaatttggggatgaggacgataagctagacacccgaccaggaagtgaggatgaaggggtaaaaaaggagaaatttccaagatttaaaatgcctgaggatgatgcagatgttcgatttgatcggggatga

SEQ ID NO: 31574 - DNA, 264 bp, Glycine max
  Peptide Sequence Number=SeqID_123259
atgtcgtacctaaccctcacatgcaccgacaaccccattaatgtgtggagttccacatttttcactcacatgcgtatgtttacccccattaacgtggttctcaacaattcgcgtgacctcgacacgcgatgcaaaacaccgcggtcaacactcatgatgcaacggacagtctgtcataaaattaacaaccgtctccctactcgagcaactgaaaaagttgctcaattgttatttcgtgtccctatttcatttcatcaaggatag

SEQ ID NO: 31575 - DNA, 621 bp, Glycine max
  Peptide Sequence Number=SeqID_123260
atggcatgcaacggactttgcattctcagccttattgctttagttcttgtgattagcaaatcaagtgttaattgcatagagactgatgcagttgaacccattattgatattgcttcgctgaatcggaatagtttcccaccagacttcatctttggggctggatcctcatcataccagtttgaaggtgcagcaacggaaggtggtaggggaccttcccaagatatatatatatatatatatatatatacgagcagtgaaagagattggaaaagggaagatgttaagactgtgaaggatatgaacttggattcatatagattctcgatttcttggtccagaatactaccaaaaggaaagctaagtggaggtataaatcaagaaggaatcgactattacaacaacctcatcaatgaacttgtggctaatggtatacaaccattggtaacactcttccattgggatcttcctcaatctttagaaaatgaatatggtggcttcttaagtcctcgcatagttaaagattttcaagattacgcggaactttgcttcaaggaatttggagatagagttaagtattgggttactttgaacgagccatggagttatagtcagtatggttag

SEQ ID NO: 31576 - DNA, 423 bp, Glycine max
  Peptide Sequence Number=SeqID_123261
atgatgaaggatatgaatttggattcatacagattctcaatttcttggcctagaatactcccaagtttagagccatatgtgactctttttcattgggatcttccccaagctttggaagatgagtatggtggtttcttaagctcccatatagtagatgattttcgagactacgaggatctttgctttaaggaatttggagatagggtgaaattttgggttactttgaaccagccatggttgttcagccaaggtggctatgcaaccggaccaggaagatgtaccggtccacaatgcctcggtggtgatgctggtaatgaaccttacatagttacacacaatcaaattcttgctcatgcagcagctgttcatgtgtacaagactaagtatcaggcatatcagaaagtcaagataggcataacgttg

SEQ ID NO: 31577 - DNA, 324 bp, Glycine max
  Peptide Sequence Number=SeqID_123262
atgaagcttggattgattcagtccaagttgggatcgagttaccgtacattcattattcttttggactggataattgttgtctgttttcttgtatgcaaagaagaactactacaggatttagaagcagcagcaacaactccaaaagaagaacctcgatcttctgaggcatcttctagttttcctattgcaaggcattctcttatagaacctattgaagatacaatcatggttgaagagccaagaagagtaaccctggaggattattcaagttctaatgtgccacaaattttcactagcattgctcaaccaaaagttcaagcataa

SEQ ID NO: 31578 - DNA, 491 bp, Glycine max
  Peptide Sequence Number=SeqID_123263
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttggacaatgactacgctaatgaagagttgctatggaggcacttcaaaaagtggggtgacgtacgtgatgtatacatcgctaaaaggctcaacaaggatggcaggagatacaggttcatgcggttcaagggagtctcggatgcaaaaggattggaggtgagactgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 31579 - DNA, 246 bp, Glycine max
  Peptide Sequence Number=SeqID_123264
atgaagaacggtggaaaacctttgcgaaatcgcccacggaaacgtctcgggagagttacggaagcgcctcggcttgaattttcttcacggaaacaatttttctcactaattttaagtgattctcagataccaagagggttgaacatgggaaaagagggaggagcttgccacccagctcgcccaggcgagctaggttgcttcctccagaaggcactgccttctggtggaacttcctggaaggcccaa

SEQ ID NO: 31580 - DNA, 708 bp, Glycine max
  Peptide Sequence Number=SeqID_123265
atggctccgaaaaagctttccgcgaagagatctaggagggacgccacggctgaaaagaccaacgccgcccccgaatttgatagccaccatttcatgagcgccgagcatcagcagcgcttcgaggccatcaaaggatggtcattccacacagagagacgcgtccagctcagggatgatgagtacacggattttcaggaagagataactcgccgacattggacgtcgctggtgaatcccatggctaagtttgaccatgagatagtcctggagttttatgctaatgcttggcccacagaagagggagtgcgtgacatgcggtcatgggtgaagggtcagtggattccctttgacgcagatgccctcagccagttcctaggtgacccgctagtgttggaggaaggccaggagtgcgagtttagtcagaggaggaacagggccgatgggttcgatgaggaggtcattgcccagctactatgcacaacggggcaggatttcgcccggaccgctgcaaggaggcgggtgcggatcatgcgcaccagcatgaccaccttgacccaaatgttgatgacattgttgctcagcaatgtcttgccaagtgatcataactccgatctccctctgccgaagtgtcaactagtgtatgccatcctgacacggatgagcgttcacgtggctcagttgattgctgacgccatctatttatttgca

SEQ ID NO: 31581 - DNA, 132 bp, Glycine max
  Peptide Sequence Number=SeqID_123266
atggcagaagtcaaccaaggtaagacgatgaccggtcacgattggtcgcgtattgtttgtctcctacttgcaggttcaagtaggcaaacgctaaaccataaggggggaggcatgattaatgtttccccttaa

SEQ ID NO: 31582 - DNA, 690 bp, Glycine max
  Peptide Sequence Number=SeqID_123267
atggatgatgcggtacagatgttggtggacttattgatggtttatgcagaggctgccagggctgagatagggcaatgtcgtggatcgtacatatgtctggaatgggtatgtgatatctatgagtgtcgatgtcgggcaggtcattggacagctgcggcttgcgcgtatcttcttcatcttctgtgttgcactctttttgctaacaagagtgcaaccaatgttcatcttgtgtttttggaggcccattgtgacctcagtcagaccgggaggtacgcctggggagtagctgcactggtccatatgtacgaccacctcaacgatgcttctatcagcaccaaccgacagcttggcggttacatcacgctgctgcagtgctggatatacgagcactttccctcggtcgcggagtccactgctgatccggaatacgacgagaattcaccgcgtgcttggctccttgctgtgtattacctaccagagagggtcatgcggcagtttggatacacccagaccattctagctctgcctgtcgattcatgggtgtcgtatgatgatatacacgataggtggatgcactatttgaatcatatggttgcaccaggtgaggtgtgcactgtgccaggtcagtgtgccagcgactacatagactggttcttccgtatttcacatcctttcatgacaccaggttag

SEQ ID NO: 31583 - DNA, 588 bp, Glycine max
  Peptide Sequence Number=SeqID_123268
atgaaagagtcgctctcgcccaaagcccaggagatcttggcgcatgcccgatcgctgctggaacccggtggatacaacggtttcagctatgccgacgtgtcggcgcgggtgaacatcagcaaggccagcatccatcaccatttccccagcaaggcggacctcgtgcgcacggtagtggaaatttaccgagccgaggcgcgcgaaggcctggcgctgctggaccggcagctgggcgacccgttgcaggagctcaatgcctatgtggattactggtccagctgcattgcgggtggcacgtcgtcgttctgcatctgcgcgatgctggccgccgaagcgccgatgattccggcagagatcgccgaggaagtgcgcggccatttcgaggacctgagcggctggctggcggtgaccctggagaagggcgctgccatgggccaactgcagttgcagggctcggcggccgatgaggccaaggcgttcatgtcatcggtgcacggtgcgatgctggcggcacgtggtttgggtgatgcggccacgttcgcgacgctcgcccggctggccatcgcgcgggtgagcgcggccgcctga

SEQ ID NO: 31584 - DNA, 621 bp, Glycine max
  Peptide Sequence Number=SeqID_123269
atggatacgctggtgcgctgggccactcagatggacattcccgtcgagcaggtagagctggcggcgcatattgtgaccatgactgaaaaaagcctgcgtgaactgggggtgaagtgggcgctcgccgatgccaccgacgcgggaaaggtgggacagctcacgacgcttggcagcgatctgtccgttgccagcgccaccagccacgtagggtttaatatcgggcggatcaacggtcggctgctggatctggaactgtctgcgctggagcaaaaacagcaggtcgatattattgccagcccgcgactgctggcctcgcatatgcagccggccagtatcaaacaggggagcgagatcccctatcaggtctccagcggggaaagcggcgccacctccgttgagttcaaagaggccgtactggggatggaagtgacgccggtggtattgccggggggacgcgtgcgcctgaaattgcacatcagcgaaaatatgccgggacaggtcctgcagcaggctgacggcgaaacgctggctatcgacaaacaagagatagagacgcaggttgagatgtttgacgtggggcatgaattagcatacaaggagtaccgatttgagttggactga

SEQ ID NO: 31585 - DNA, 851 bp, Glycine max
  Peptide Sequence Number=SeqID_123270
atggagaggattacagttactctcggggaacgtagttaccctatcaccatcgcggctggtttgtttaacgacccagcttcctttttaccactgaaagcgggtgatcaggcgatgctggtcaccaatgagacgctggctccgctttatctcgaccgtgtacgccacctgcttgagctggcgggcgttaaagtcgacagtgtgattctccccgatggcgagcagtataaaagcctgacggtactggataccgtctttaccgccttgctgcaaaaaccgcacggtcgcgatacaacactgcttgccctgggcggtggtgttgtgggcgatctgaccggctttgcggccgcaagctatcagcgtggtgttcgctttattcaaatcccgaccacgttgctgtctcaggtcgactcctctgttggcggcaaaacggccgttaaccatccgctcggcaaaaacatgattggcgcgttctaccagccagcctcggtggtggtggatctcgactgtctgaaaaccctgccggcgcgcgagctggcttctggtctggcggaagtgatcaaatacggcattattctggatggcgagttctttaactggcttgaagagaatatggatgcgctgctgcgcctggatgaggctgcgcttgcatactgcattcgtcgttgttgtgagctgaaagcagaagttgtcgctgcggacgagcgtgaaacgggcttacgtgctttactgaatcttgggcatacgtttggtcacgcgattgaagccgaaatgggttacggcaactggctgcacggtgaagccgtcgcggctggcatggtgatggccgcccgcacctctgaacgtcttggcca

SEQ ID NO: 31586 - DNA, 81 bp, Glycine max
  Peptide Sequence Number=SeqID_123271
atggagtcgccaactgccgcaatctaccctttggcgggagggcgacgcgagactcacaggctttcaaaagtccacgtttaa

SEQ ID NO: 31587 - DNA, 278 bp, Glycine max
  Peptide Sequence Number=SeqID_123272
ggatcgcgcccgcaagacacccagtggacccgaagaagtccaacagggtcctaggatttccagctctgattacgtgcctctgtcagttctacaaagtgcctgtcgcccgcagcaagttcatcaggtcccctattaatcgggctttcatcaagaagtactccgcccccaggcaagcacagggcgagacaccacaacatcctagggatggccagcagcgggcaacaaacgcactgccaccacctctagagttcacctcagctcatccacaaaaaggttag

SEQ ID NO: 31588 - DNA, 456 bp, Glycine max
  Peptide Sequence Number=SeqID_123273
atgcaagcttttggttcactggccgttcgttttgtcacaacgtcgtgctggaactttcctggcgttacccactgtaatcgccttggatacacgtattaccccctttcgcagctgagcgtaataccgctcgaagaggcccgcaccgaatcgcctcccaaccgagttgcgcagcctgagtcagtgagcgagatggcgccgaagatgcggtattttctccttacgcatctgtgcggtatttcacaccgcactatggtgcactctcagtacaatctgcgtctgtgccgcattcagttaatgccagcgcccgacaggtttcccgaccggaacagcccgggcagtgagcgccctgaacgggcaattaatgtgagtctagctcactcattaggcatccccaggctttacacattatgctgtgccggtctccgtatgttgactgatggattgtcgagcggataa

SEQ ID NO: 31589 - DNA, 1114 bp, Glycine max
  Peptide Sequence Number=SeqID_123274
acgcgctgcgcgccagtaaaccagcagcatcagccccatcagcagcgtcatgacaatgctggtggcggcgccgaacggccagtcacgaatattgaggaactggcttttgattatgttaccgatcaacaggcaggatttgtccagcttctcaaggctggagtagagcggcagtaccataaatggcagcagaatatagatcagcccgaggatcaccgcttccggggtaaacatgatgcgaaacggcttgtcgatgacgccgagccacagcagaaattcattgagccagccacgcgtgctgagaaaaattttcagaccataaatgcgaatcagagagttggtccagaacggcacaatcagcagaaacagcatcagcggacgcagacgcgccggcagtctggtcaggcaccaggcaaaagggtagccgagcagcaggcagcacagcgtggcgatgcaggccatgttgagcgagtgcagcagcacgtcggcatacagcggatcgaggagccggccgtagttgttcagggtgaacaccatgctgacaaagtgcgcgtcgtcgcgcgtcagaaagctggtggcgaagatcatcagattcggcagcaacacgaacagcgtcagccagccgacgatcagcgccacaatggctttctgcagacgattacgcatccgtttcatacggcagcaccacctcccatggtcaaaatccggatcgtcctcattaaagaactcgctgacggtgagcagcttgccgttctccagttcgacggtggattccagcgtcatgcctttatagttgcgttcgcgcacatagccgatcaggttttcgctgcggctgtcgtgatcgatctcctcgacgcgcaaatcttccggtcgcagcagcacatgcagccgatcgccgggtttgaccgggaacgggcagtgaatatcacactcgcggccttcgaggcgagcccgtacctgcggcgcgtgcgcgctgccgatcacttccgcatcaaacacattgatttcgccaatgaagcgcgccacaaacaggttcgcgggctcttcgtagatctcgcgcggcgtgccgtcctgctcgatgcgcccgtcgcgcatcaccacgatgcgatcggacatg

SEQ ID NO: 31590 - DNA, 282 bp, Glycine max
  Peptide Sequence Number=SeqID_123275
atgggggtgcaaatagcacccaggcccatttgggccctccagaagattcctccagaaggcggttgcttctggaggaagcaaccctgctcgcctgggcgagctgagctcgcctgggcgagctgggcggcaaccacctcccctatttttgctataaataggggaggaaggcaagaaggaagggccgaggcgcttccgaaacgtttccgtaacgttttccgtgaagaatttcgcaaaggtttcaccgtctcgacgtcttcatcgtctcatcgtctcgatctcacg

SEQ ID NO: 31591 - DNA, 968 bp, Glycine max
  Peptide Sequence Number=SeqID_123276
caccaggcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 31592 - DNA, 603 bp, Glycine max
  Peptide Sequence Number=SeqID_123277
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgccccacccctggaaacggctcagcccgaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagtccgactttcggggcactgcccctctttttggacccaaggtcggcttcggccggtcgatccgggcggaagacattgtcag

SEQ ID NO: 31593 - DNA, 583 bp, Glycine max
  Peptide Sequence Number=SeqID_123278
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgatgttatttaagccagcaagggagatgttcattgctttgcaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31594 - DNA, 125 bp, Glycine max
  Peptide Sequence Number=SeqID_123279
atggcgcgcgggacacggcatgcctatgcccaggccttgaatgacgtgaataccgatgacgggctgatctttgatacagcttcagctgctgccgtggatgtgcggagcattgagcgggctcgtcg

SEQ ID NO: 31595 - DNA, 357 bp, Glycine max
  Peptide Sequence Number=SeqID_123280
atgtctgttataggttgtaccatttgtggtggtgctcatgaatccgaccattgtattccttttgaagaacaaacacaggaagtcagttacataggaaatcaacaaaggcaaggatacaaccaaggaggattcttaggtttccagcaaggtccctacaatcagcaaggacaatggggatcacaccctggtaatcaattcaataaggaccagggtggatcttccaacaggccgcctcaacaagggcctaacatcttccagaggactaccaaaatggaagaaaccctggctcaattcatgcaagtgaccatgtccaaccataagagtactgagtcagccttgaaaaaccttgagattcag

SEQ ID NO: 31596 - DNA, 768 bp, Glycine max
  Peptide Sequence Number=SeqID_123281
atgtcggcgatgcgcctgtcgctgtggaccggtctgctcggcgccgtggtgtataaccagaaccgtcagcagagccgcgtgcgcctgtttgagagcggtttacgctttgtgcctgatacgcaggccgatctcggcatccgtcaggatcttatgctggcgggcgtgctgagcggtaaccgctacgaagagcactgggatctggcgcgccagacggttgacttctatgatttgaaaggcgatttagagtcactgctggatttgaccggtaaactcgacgcgatttcgttccgtgcagaagccaatccggcgctgcatccgggacagagtgcaggcatttatttagccggcgaacgaatcggatttatcggggtggttcatccggagctggaacgtaagctggatcttaacggccgcaccttagtgtttgaactgctttggaataaggtcgcagaccgcgtcctgcctgacgcgcgcgagatctcacgcttcccggcaaaccgccgtgacatcgctgtggtagtggctgaaaatgtgcccgcagcagatatcatcgcggagtgtaagaaagttggcgtaaatcaggtagttggcgtaaacttgtttgacgtgtaccgtggtaagggcgtaaacgagggtgaaaagagcctcgcgattagcctgattttgcaggataccagccggacactcgaagaagaggagattgctgcgaccgttgccaaatgcgttgcagcattaaaagagcgattccaggcaaccttgagggattga

SEQ ID NO: 31597 - DNA, 2013 bp, Glycine max
  Peptide Sequence Number=SeqID_123282
atgttaaaacgaatcaacgtcgtcaccagcctgatcgcagtcctgctggtgttcggtgctatgcaattactgtccggcgggctgttctggtcggcattacaaaaagataaagaggcgtttgctgtggcacaaacgtcaagtaataacgtcgctgccatgtccgatgcctggattgaactcaatcaaacccgtaccgtgctcaaccgcgccatgctgcgcatgcagggcagcatggcgtcacagaccaacggcggccagcttaacgcactgatcgcgcagacggagaaacagctcgacaccgcggccggccactatcagcactattacgatctgccggcgacgccggggctgccggatgcgctgcgcgaccggctggaagcggattatgccgcattcaataacggcctgaaggcgatgctggcccggctgaaagccaacgatctgcagggcatgtttgatcagaacattgaagccaaacaggtcaaaatgaaagccacctatgaagagtggcgcagcgcgcagagtgctttagccgctgagggcgtggcgcagaaccagcgtgccttccacaccatgatgtggctgctggcgattgttgccgtgatggtgatcgcggtaatcgtcgcctgctggtttggcctgcgcacggtgctgattcagccgctgcatcagttgctcggtcacattcgccatatcgccgcaggcgatctgacgcagaccatcaccgttgaagggcgtaacgaaatgagccagctggccagcagtctgcatgagatgcagcagtcgctggtgcacaccgtcggcaacgtacgcgacggttcggacgccatctttaccggcgccagcgaaatttccgccggcaacaacgatctctcggcgcgtaccgagcagcaggcggcgtcgctggagcagaccgcggccagcatggaacagctcaccgccacggtgaagcagaacgctgagaacgcccggcaggcttcgcagctggcgctcagcgcgtcggagaccgcacgcaaaggtggcgacgtggttgaaggcgtggtgcgcaccatgcatgacatcgccggcagttcgaagaagatcgcagatatcaccagcgtgatcgacggcattgccttccagaccaacatcctggcgcttaacgcggcggtcgaagcggcgcgcgccggtgagcagggccgtggttttgccgtggtagcgggcgaggtgcgtaacctggcgcagcgcagcgcgcaggcggcgaaggagatcaaaggactgattgacgattcggtcagccgggttaacgccggttcgcagctggtcggcaccgcaggtgacaccatgcaggatatcgtcggagcggtgacgcgcgtgactgacatcatgggcgaaatcgcttcggcctcggatgagcagagccgtggcatcgaccaggtgggccaggcggtgaccgagatggaccgcgtcacgcagcagaacgcctcgctggtagaagagtcggccgccgctgcggcctcgctggaggagcaggccagccgcctgagccagtcggtggcggtgttccgcattccgcgcgcgtcggcagcggtcgtcgtgcgttccccggtggccacgacaccgccggcggtgcgcaaagccgctgcggccccgcgggagagggtcgcgtggcgggcccttcaccggtttgctgctggtcttacccctttcacctcacataaagatccgcgcctgcgcgccgataacaccagcgatccgccaattaatgaggtgtttatgtttagtcgtgttcgagtggtatccggcctgctgtgcgtgctggcgttatttgccttactgcagctgttttccggaggaatgtttttttcaacggtgaaagccgataaagataattttgcgtacaaccaacgtcttagcaccctgcagcgggcgatgggcacctcatggtttcgctggtacaggcgcgtatacgctgaaccgtgccggtatccgctatctgctgacagtcagcagccggctccggtgccacggtaa

SEQ ID NO: 31598 - DNA, 783 bp, Glycine max
  Peptide Sequence Number=SeqID_123283
atgatggtaggcggccatctgggcgcgctttaccagccgtcggagttgctgattattggcggcgccggcattggtgcgtttctggtgggcaacaacggcaaatcgattaaaaagacgctaaaagcgctgcccttgttaatgcgcggctcaaaatataacaaagccgtatacatggatttaatggcgctgctgtatcgcctgatggcgaaatcacgtcagcagggcatgctgtcgctggaacgcgatattgaagatcccagccagagcgaaattttcgctaactatccgcgtattttgtccgataaacctttagtggattttattaccgactatttacggctgatggtgagcggaaatatgaatgctttcgagatcgaagccctgatggatgaagagatcgaaacctatgaacacgagtgcgaagtaccagcacaaagcttagcggcggtcggtgatggcctgccggcgtttggtatcgtcgccgcggtaatgggcgtggtgcacgcgctggcctccgcggaccgcccggcggcagaactgggcgcgctgattgcgcacgccatggtgggaacgttcctcggtattctgctggcttacggcttcatttcgccgctggcatccgtgctgcgccagaagtgcgcggaaaccaccaagatgatgcagtgcgtcaaagtcacgctgctctccagcctgaacggttatgcgccgcagatcgccgtcgaatttggtcgtaaaaccctgtattccaccgagcgtccgtcctttaccgagctggaagagcac

SEQ ID NO: 31599 - DNA, 1122 bp, Glycine max
  Peptide Sequence Number=SeqID_123284
atgaaatcaggacgctatatcggcgtgatgtccggcaccagcctggacggcgtagacgtcgtactggccgcgatcgaccagcacatggtggcgcaacaggccagctactgccatcccatcccgctggcgctgcgtcagcaggtgctggaaatttgtcagggacagacgctgacgctgtcgcagctcggtcagcttgatacccggctcggccagctatttgcggaagccgtactgacgctgatgcagcagcaggcgctggaggccagcgatatcatggcgattggctgccacggccagacggtgtggcacgagccgcagtcggcggcaccgaatacgctgcaaattggcgacaataaccagatcgctgccgcgaccggcgtcacggtggtgggcgattttcgccgccgcgacatggcgctgggcggccagggcgcgccgctggtaccggcttttcaccaggcgttgctgatggacagcgttgaacggcgcatggtgctgaatattggcggcatcgccaatctgtcgctgctgatacccggtcagccggtgcgtggctttgataccggaccaggtaatatgctgatggatgcgtggatctggcgccacaaaggcctgccgtttgataaagatgccggctgggcgcgcagtggccaggtcgtacccgcgctgctggagcagatgctcggcgatccgtggtttgcgctgccgccacccaaaagcaccggtcgggaatactttaacctgggctgggtggaacagcagctgcagcgcttcccggcgctggccccgcaggatgtgctggcaacgctgtgcgagctgaccgcgctgaccatcgcccatcaggtacagctcaacgatggctgcgatcgtctgctggtgtgcggcggcggcagtcgcaatccgctgctgatggcgcggctggccgcgcatctgtctggcactgaggtgggcaccaccgatcaggccggtatcagcggtgatgatatggaggcgctggcctttgcctggctggcgttccgcaccctgtccgggctgccgggcaatctgccggcggtaaccggcgcgcgcgaaatgagcgtgctgggtgccatctatcccgccaatccctacgcaatacgttaa

SEQ ID NO: 31600 - DNA, 504 bp, Glycine max
  Peptide Sequence Number=SeqID_123285
atggccgtgctgacgctggtgtgtgctgccggtgcacacgcggcgtcagaagacgtgacgctgcatcaggtgacggagcagggtatcggtgagtcgatcggtaaggtgaccatcagcgaaaccccgtatggcctgcagttcgcgccggcgctgagcgggctgaaacccggcattcacggctttcacgtccacgctaaaggcagctgtgagcccggcgaatccgccggcaaaatcgtggcggccggcgcggcgggcggtcacctcgatccgcacgacagcggcaagcacctcggtccgtacgctgacggtcacctcggcgatttgcccgcgctgtatgtcaccgacgacggcaaagccagctatcccgtggtggcgccccgtctgaaatccctaagcgagatcaaaggcaaagcattgatggtgcacgtcggcggcgataaccatgctgaccatccgcaaccgcttggcggtggcggggcacgtctggcctgcggcgtgatctga

SEQ ID NO: 31601 - DNA, 405 bp, Glycine max
  Peptide Sequence Number=SeqID_123286
atgacgctttccgtctcagcctggttacaacacaaaatcgacgaatataagttttcggtccgcgatatcaccgtcgacttctatctggctcaggcaatgctcaaccgcaccgattgttccattgaacaactgcgtcgttttaacgatacctgtctcgacatggccgaaatctgccagctcaacggcgacgatcacagctacctgcacgcgatgggcaagctgcaccaccgcttagtacaggagatgggcaatgccgatcgcgatcgcctgttccgtattcaggcttaccagctggcgcgcctgtcgctgacccgtttgtgtcatcaactggcgctcagcggcgactgggaccaggcgacccgcctgcaaagtgatttcgtccgccacgcaggctggatattctaa

SEQ ID NO: 31602 - DNA, 432 bp, Glycine max
  Peptide Sequence Number=SeqID_123287
atgtccggctgtctggcctgtaaggcctgttcaacccagtgtccgattaagattgacgtgccggaattccgctcccgcttcctgcagctttatcacagccgctacctgcgtccggtacgcgaccatctggtcgcgacggtcgagtcctacgcgccgctgatggcccaggcgccgaaaacattcaacttctttatcaatcagccgtggatgcgcaagctgtcggaaaaacacatcggcatggtcgatctaccgttgctttccgtgccgtcgctcaagcagcagctggcaggccatcgttccgccaataccacgcttgaggatctggaagcgatgagcgtcgaacagcgtgcgaagagggtgctggtggtacaggatccgtttaccagctattacgaagcgcagctggtggctgactttcgtccggctgattga

SEQ ID NO: 31603 - DNA, 687 bp, Glycine max
  Peptide Sequence Number=SeqID_123288
atgctgcgccatcagctcatccagccgcgcgcacagcgtggtcacctgctgcgcaatcagcgccgcatcgtcgccggcaaactcgacaatattcaggccgagcatctctttgcctggcacatcggtgatcagctcgctgaccgaatgccagacaatatcctcgcgcgccaggttcagcactttggaatccactgtctccaccgacagggcctgcgcctcgaccataaaaggtgcattgcgcagtgcggaatcgaacgaatcgtacttaatgttcaccagccggcgcaccttgggaatgggtgtgatatccagccgggcttcggtgataaaggccagcgtgccttcggcgccgcacaacaggcgcgtcaggtcgaaagtttgcaaatcatcactgaacacatggcgcaggtcataaccggtgaggaagcggttcagtttggggaattttgccagaatcagttcacgctgctcgcggcagcggttaagcactgctttatagatgcgcccttcagcggtcggcgtcgtggccagctgttccgccagcgcggtcggcatggcgcgcgtatcaagaatttcgccgcccagcagcacggcacgcaggcctttgacgtgatcggaggttttgccatacaccagcgatccctgaccggaggcatcggtattgatcatgccgcccagcgtggcgcg

SEQ ID NO: 31604 - DNA, 1077 bp, Glycine max
  Peptide Sequence Number=SeqID_123289
atgttgttctcgctgatgtttattttgctgatgatcattgcctgtctgtgggtggtgcagccgttcattctcggcttcgcctgggccagcatggtggtgattgccacctggccgctgatgattcgtctgcagcaactgctgtggggtcgccgttcgctggcggtgattgccatgacgattctgctgttgctgctgtttattattcctatcgcgctgctggtcagcagcctgattgataacagcgcgccggtcatcgcctgggcgacccagcgccatctggtgctgccggatctcgcctggctgcgcgatattccctatgccggacgcaaactctattccagctaccataaactgatcgacggcggcggcgcggcgatcatgagccaggtccagccttatattggccgcaccaccggcttctttgtcgcccaggccggacactttggccgtttcatgctgcaccttgccctgatgctgctgttcagcgtgctgctgtactggcgcggtgagcaggttggtctcggcatccggcactttgcctaccgcatgggcggacggcgcggtgacgccgccgtgctgctggccggtcaggcgatccgcgccgtggcgctcggcgtggtggtgaccgcgctggtgcagggcgtgctgggcggcatcggtctggcgatttccggcattccgtatgccacgctgctgaccgtattaatgattcttacctgcctggtgcagcttggaccgttgattgtgctggtgccggcaattatctggctctactggagcggcgacaccacctggggcacggtgctgctggtgtggagctgcgtggtcggcacgctggataacgtgctgcgtccgatgctgattcgcatgggcgccgatttaccgatgattctgatactttccggcgtcatcggcgggctgatcgccttcggtatgattggactgtttatcggtccggtcgtactggcggtctcttaccggctggtttcggtgtggatgcatgaagcgccggcgccggatgacgatccggaaacggccatcgaagcactggccgaacacgaagagccgcagccgtaa

SEQ ID NO: 31605 - DNA, 930 bp, Glycine max
  Peptide Sequence Number=SeqID_123290
atgtccaatcaagaccaacagtcgctagtgctctggtacaaccagcttggcatgcatgatgttgatcgggtagggggcaagaatgcttccctgggagaaatgattaccaatttgtcgtcgctcggggtatccgtgccaaacggctacgcgacgacatcttacgcttttaatcagtttctcgaccaaagcggactgaaccagcgtatttatgcattgctggacaacacggatattgatgatgttgcagcgctggcgcaggccggcaaacagattcgtcaatgggtggtggatacgcctttccagccagagctggaagcggcgatccgcagcgcctatgaacaactttctgctgatgacgctgaagcctcctttgcggtgcgctcttcggccaccgccgaggatatgcccgacgcctcgtttgccggccagcaggaaactttccttaacgtgcagggcttcgacgcggtgctggtggccgtgaagcacgtgttcgcctcgctgtttaacgatcgcgccatttcataccgcgtgcatcagggctatgaccaccgtggcgtggcgctctcggccggtgtgcagcgcatggtacgttccgatctcgcctcctccggcgtgatgttcaccatagataccgaatccggcttcgaccaggtggtgttcatcacctcggcgttcggtcttggcgaaatggtggtgcagggcgcggtcaacccggatgagttttacgtgcacaaaccgacgctggccgctaatcgcccggcgattgtgcgccgtaccctgggctcgaagaagatccgcatggtgtacgccgattcgcaggagcacggcgaacaggtgcgcattgaggacgtggaacaggaacagcgagaccgctttagcctgaccgatgacgaagtgcaggcgctggcgcgcccaggcggggctgattga

SEQ ID NO: 31606 - DNA, 1116 bp, Glycine max
  Peptide Sequence Number=SeqID_123291
atggtttattgtgatcatcatcacttcccggtatttcaccgctgcgaagaacagattttgagaatcccaatgaacaaaactgatgaactgcgcaccgcgcgcatcggcacgctgctgacgccggctgcgctggcgcaacaacaccccatttcggcggcgattgccgctaacgttaccgccgcgcgtcagcgcatcgcgcgcatcctgaccggtgaagatccacgcctgctggtgattatcggcccctgctcgctgcacgacccaaaggccgcgctggagtacgcagagcgtctcaatctgctgcgtgaacagcacaagggccggctggaaattgtgatgcgcgcctactttgagaagccgcgtaccgtagtcggctggaaaggtctgatttccgatccggatctcgatggcagcttcgacgtcaaccgcggcatcgctatcgcgcgccagctgctgctggatatcaacgccatcggcatgccaaccgccacggaattcctcgatatggtgatcggccagtttattgccgacctgatcagctggggcgcgattggcgcgcgcaccaccgagagccagattcaccgtgaaatggcctcggcgctctcctgcccggtgggcttcaagaatggcaccgacggcaatgtgcagatcgcggttgatgcgattcgcgccgcgcgcgtcagccatatgttcctgtcacctgacaaaaccgggcagatgacgatttatcagaccagcggcaacccgcacggtcacgtgatcctgcgcggcgggcgtcagccgaactatcacgctgaagatgtcgccgctgcggccgccaacctgcgcgacttcaacctgccggaacagctggtgatcgacttcagccacggcaactgcctgaagcagcatcgccgccagcgcgatgtggcgcaggacgtggcggcgcagatccgggccggttcgcgggcagtggcgggagtgatgattgagagtttcctgcaggaggggaatcagaaagtggtgagcggccagccgctgacctacggccagtcgattaccgatccgtgcctcggctgggatgacagcgcggaggtgctggcgctgctggcggctgccgtggacagccgcttctga

SEQ ID NO: 31607 - DNA, 417 bp, Glycine max
  Peptide Sequence Number=SeqID_123292
atgggtagagtagaggaggtgcaagagcagatggaggtcgacatggaggccatgaaagagaaaatggccacaatgatgaaggccatggtgagcatgaagaagataatggaagtcaatatggttgcaatagccgctatcagcaccattcttgaggcaaagagttggcaagtatgggtagccccaattgtgtgcaaattcaaaacaagcaccccttcgcgccatatggcttgcctcccaattatacaccacccaatgtggcgtacactcccagtgaaaatgtcaataactccacttccatacccattgagagccaataaccccaaaactgatcatgcactcttaaaccgtgggggatacacacgaaattccccaccacaatctagccgacttcgagccttgcctcgaatatgccactga

SEQ ID NO: 31608 - DNA, 273 bp, Glycine max
  Peptide Sequence Number=SeqID_123293
atggagagaaggcaaacaattcgaagcagaggaagacccaaaaagactataagagaggttatcgagaaggatctcgaacttaatgatttggatagaagtatggaaggtgtgcgagatatgaggtcttgggtaaggggtcagtggatcccgtttgatgcagatgctatcggccagctcctgggatatcctttagtgctggaagagggtcaggagtgcgagtatggccagaggaggaaccggtccgatgggttcgacgaggaggccatcgcctag

SEQ ID NO: 31609 - DNA, 234 bp, Glycine max
  Peptide Sequence Number=SeqID_123294
atgatatgggtcccaaaaggatcctcagttaatactaacatgcaaggacccaataaaatttgggtacctaagtcaaaaactcttatgattatgcaggctgaatctgactccgtgagaaagcaattgttgttgaagctctctggtaacgcatacctgttagcgttagtcatactatgtgagccaaaggctactagttcatttggaacttctcagaagatgtcttatagaacatga

SEQ ID NO: 31610 - DNA, 225 bp, Glycine max
  Peptide Sequence Number=SeqID_123295
atgtcgaaggaaaagttaactcagttgatcgaaataaaagataaagctgggtcgttactcagaggccctcgatctaagtggcaaatgctcaattttttcgccattacttcgactgggcaaaaagtgttgctaaaactgtccataagtgaatcagaagcatcttggcagtttcccatgttcatagtggggcttgtggatcacatcaagcaagccataaaagcgtga

SEQ ID NO: 31611 - DNA, 303 bp, Glycine max
  Peptide Sequence Number=SeqID_123296
atggatgatgctctcctacaacctaagacaaggtatcaggagataacactgtataggctcaaggttcaatcaatcaataactcattcagcttaaactgggtgcaagggataaatcattcaagcatgtggttagctttttggctaagtggctatcacaatcaaacatggccttcatcatcctcaattcataggcctctccccctccagaaggagaaggttggactcctggccaagccacctgtgcaaggaactcctccacactcatggtcggctgctggacagagctctgcaacctctggatga

SEQ ID NO: 31612 - DNA, 126 bp, Glycine max
  Peptide Sequence Number=SeqID_123297
atggcccccctacaggatactgggctgccttgcagcaacgttttctgcttgtccagcgccgggaagggacgacgatctgtcggtcgtgaccctatcctccatttgcatctgtccctaagtacctga

SEQ ID NO: 31613 - DNA, 519 bp, Glycine max
  Peptide Sequence Number=SeqID_123298
acacagtcgtgttcgatgacaagcagaagaccaagtttggtcattctgcacacatgatacgccgagataccttacggttatccgcccccctttgccattcagacacagtcgtgttcgatggcaagcagagaccaaagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtctggtcattctgcacacatgatacgcggagataccttacggttatccgcccccctttgccattcagacacagtcgtgttcgatggcaagcagagaccaagggctgacacagtcttctgcaccttttgttcctccggggacaacaaagtcatttacatgtggaaatttcatg

SEQ ID NO: 31614 - DNA, 204 bp, Glycine max
  Peptide Sequence Number=SeqID_123299
atgcagctccgagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 31615 - DNA, 483 bp, Glycine max
  Peptide Sequence Number=SeqID_123300
atggctactccacctgcttcgcctcctcctcctcttgctcctcctcctgcagacgctgatgcgtctccatctacgttgaagcggacacgcaaggcgacacggctacgatcattggccactagaccacctggggcagaaagacctgtggtcaacgtcgatcctgctaccggcaaggccgacggtccccacaagaagaaattaagaacatatttggggattgtcgctcgtgataaggtcgacgtgacatatgacacctggaaggaagcggaatttcaaatccctgaagcttctcacagtaggacaaagaagaaaattcttcagattgtcggcgagcgctggaggcagtttaaatctgacttgactaggaaatgggcacttgtagtcgacaaggacggtgcggacgacattgtctgtgaaaaatatggcattagcaaggagaaatggactcagttttgtcagacccgcagagacccctcatgggag

SEQ ID NO: 31616 - DNA, 476 bp, Glycine max
  Peptide Sequence Number=SeqID_123301
cagagaccaagtttggtcattctgcacccatgatacgcggagataccttatggttattcgcacccttttgtcatccagaggcggcgggcccgatgacaagcagagaccaagtttggtcattctgcacccttgtatcatccagaggcggcgggcccgatgatacgcggaaatacccgagtgtcttctgcaccttttgttcctccgggaacaacaagtcatttacatgcggaaatttcatggtcgcccgcgactctcgtcaaccgagaggagcgaaattagtgtcatacactgattttcggggacctttgcttgatgacatgcgaccattctttggtccttgtgaggagcgacaagtcacggtggtcacccgcgactctcgtcaatcgagaggagcgaaattagtgtcatacaagctgcatcctatttctcggggacctttgcttgatgacgtgcgaccattctttggtccttgtgag

SEQ ID NO: 31617 - DNA, 319 bp, Glycine max
  Peptide Sequence Number=SeqID_123302
aggactacacgtcctcgccttgagaggactacacgtcctcaccatcagagggctgcacgccctcacctccagaggactacatgtcctcgccttgagagggctacacgccctcaccttgggtactagttaccctcaccgtcataggactacacgtcctcgccttgaaaggcgacacgtcctcaacttcagagggctgcacgccctcacctttagaggactactgtcctcccattcagtagggctaccctatcctcaccttaggtataatttacctctcaccgtccttaaatgcttaaccgagacttgcactcccggttaa

SEQ ID NO: 31618 - DNA, 717 bp, Glycine max
  Peptide Sequence Number=SeqID_123303
aattgcaactgtggtcaaggatcagcagaggtttggaccgcataaacagactcggaacggcatagcgggcctaccacagaggtacctagaagacaaggcgaggggtatggccaatcaaggagactgggtcccgtttatggatgtgttagctttgctaatttttggggtcgtcctctttccaaacgtggatgtgagtattgtcatactatgtacattcccgtattgcgcctttttcaccttgtcatcagcacaatgggttccatgtcctctgatcctcctcggtactagacaaaacaacggagagattccgggtccactgtcttcaaagcaactagggtaccccatgaggggagcaaccgacggcaagaaagcatgtctcctttaccttagtcaagggattcaaaggcgcactagaattccaagacatctagaatccataggcgtgaggaaccccgaaatgaaagccttccgcaagacttacgagaagatcttagatttgaccatagcagaggtatccatagaggccattgcgtcactcacccaatactacgaccagcctttgagatgcttcacgttcggagacttccaattggtaccgaccattgaagaatttgaggagattctaggatgtcctctcgggggaagaaaaccatatcttttcttcgggtgtctcccctctttgagcagaattgcaactgtggtcaagattcagcagag

SEQ ID NO: 31619 - DNA, 219 bp, Glycine max
  Peptide Sequence Number=SeqID_123304
atgtcggctttgaaagagcaaatggcttccatgatggatgccatgctaggaatgaggcaactaatggagaatagcgcggccaccgctgccgctgttagttcagctacagaagcagacccaactctcccagctaccgcgcaccatcctatcccaagcgtggtaggacaagaaagaagcatactggggcacatcagcaacccccatctgggatacaactga

SEQ ID NO: 31620 - DNA, 246 bp, Glycine max
  Peptide Sequence Number=SeqID_123305
atgagaattggtcgacggcccgggcggccgcaaggggttcgcgttggccgattcattaatgcagctggcacgacaggtttcccgactggaaagcgggcagtgagcgcaacgcaattaataaggcccaggcgagctaggttgcttcctccagaggcaaccgccttctggaggaacatcctggaaggcccaagtgggcctgattgctatgtgggatccccgggtaccgagctcgaattcgccctatag

SEQ ID NO: 31621 - DNA, 415 bp, Glycine max
  Peptide Sequence Number=SeqID_123306
atgcatagatctcacacaggtaatttagttcctctggacttagaaattgaagctacattgcagaggaacagggccgagaggagaaggaaacttttgcaagatagaacagttgcatccattcttgaagagactcatttctctgacttattatcacctgatccaccatcatcaagggaatctgccactcaattacctaaagccattaccatggcagaagagcatgaccaggggattacccttgaggattattcaagtagttcagtaccacaatttttcaccagcattgcatgtcctgaagtacaagctaacaacattaactatccacattccttaattcatttaatacaggggaacttatttcaaggattacctaatgaagatccttatgcacacttggcaacattcattaaaatat

SEQ ID NO: 31622 - DNA, 360 bp, Glycine max
  Peptide Sequence Number=SeqID_123307
atgggttactcgatcctattggacgggggaagcccgtctgatagcgctctgtgcgcgtactccgaaagggaatcgggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 31623 - DNA, 255 bp, Glycine max
  Peptide Sequence Number=SeqID_123308
gtaaggcaggaggctgctactccagagagatcaccacagatttcaccaaatccatcctctccaatggtagatcaatcttctcttcagcagccagcagaccttcctacaccagtgcatgagatgccagcagacccttctacaccagtcctgggattgactaccactccttcggccactcctgtgctacatcttacagatgaggaggacactcaagatgaggatactcagtcacaagacctgtcacaggaattttaa

SEQ ID NO: 31624 - DNA, 765 bp, Glycine max
  Peptide Sequence Number=SeqID_123309
atggggaacaaatcaaaccgacaagaggttctaccaagtcaaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatttgaccgaaggtgcgaaaagagtagcgcacagatcatctgttgcttacccgccctctgtgtttggttggtttcacacttgttccaacaagacacaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcatcgacggaagaaagcatgtctcctttcctt

SEQ ID NO: 31625 - DNA, 473 bp, Glycine max
  Peptide Sequence Number=SeqID_123310
gactacacgtcctcgccttgagagggctacacgccctcatcttgggtactagttaccctcacccgttgagaggactacacgtcctcgccttgagaggactacacgtcctcgccatcagagggctgcacgccctcaccatcagaggactacatgtcctctccttaagagggctacacgccctcaccttggttaccctcactgttagaggactacacgtcctcgccttgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttgggtattag

SEQ ID NO: 31626 - DNA, 433 bp, Glycine max
  Peptide Sequence Number=SeqID_123311
atggtggctcatgactcggatgaatctcaagagatgtctgatcattcattagcacgccgcacaaataatggtggaaaacggtattcaaactgtggcaattctagaaagaatcgcaacaacattggtgggcgtgataactcaggcgttggcaagggaggctctggtgccgggggtaaaggtggcggtggcagcaattgcgggggtggacaacagcagccccagaacaacctttggcctgcaggacagcctaattatcagcaacctccgcgccaacaacccgatattcttgggtccaaacctcagcaggcaaacacaaccacaactcctactccaacagacatcgaggctgcaatgcacaccctcgatattacttctcctgacccaaaatggtatatggacatcggtgccacctctcatatcacgtccacctcag

SEQ ID NO: 31627 - DNA, 264 bp, Glycine max
  Peptide Sequence Number=SeqID_123312
atggcttccatgatggatgccatgctgggaatgaaacaactaatggagagtaacacgaccatcgtcgccgctgttagtttggctgtcgaggcagacccgactctcttgactgctgcgcaccaccctattccaaacatggtgggacaagagagaagcacaccggggcacatcagcaacccccatccgggatacaaccaaggtacttacccctactgtttgccacccaattacacaccaccagccatacatgacgacgtgggtcac

SEQ ID NO: 31628 - DNA, 276 bp, Glycine max
  Peptide Sequence Number=SeqID_123313
atggagaattcgatttgaggacaaatccttctcatgagggagagaatgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttggcccaattggcaacctaggcatcagccttttgggagaccaaatggtggctgacttgttggctgttgggg

SEQ ID NO: 31629 - DNA, 52 bp, Glycine max
  Peptide Sequence Number=SeqID_123314
atgtgggacaaaggaactgagaccacaaactctaacaattctcccacttggg

SEQ ID NO: 31630 - DNA, 981 bp, Glycine max
  Peptide Sequence Number=SeqID_123315
atgttagctatcatcgccaagtaccaagaagagttaggtctagccacggcccacgagcatagaatcgcggatgagtatgctcaagtgtatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcgggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaagcagctcatggagaagagcgcgaccactgccgccactgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgcctcaacccaacatcgcggcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaa

SEQ ID NO: 31631 - DNA, 393 bp, Glycine max
  Peptide Sequence Number=SeqID_123316
atggggaatcaaaacagacaaggatttcatgcaggcggtttttcaggttaccagcaaggaggaaatttcaatcaaaatcaggggcaaggatggaggtcacatccagagaatcagttcaataaagaccaaggaggaccatccaacagacctcggaatcaggggcctagcttgtacgagaggaccactaagctggaagagactttggctcagttcatgcaagtttcaatgtccaaccataagagcactgagtcagccatcaagaacctggagatccaagtgggacagttagctaagcaaatagctaagaattcttctagaggttttggagctaatacagagaaaaatcccaaagaagaatttaaggttgtcataactagaagggggatcctctag

SEQ ID NO: 31632 - DNA, 300 bp, Glycine max
  Peptide Sequence Number=SeqID_123317
attcaattaggcttactaataagttatgagaaagtaaagaacagaaactataacttagacaaaagtaaagcaaaaatcaaaagtgcacagcggaaagataaagagtgtagggaagaagaagacaaacacaagatttatattggtttggcaacaacccgtgcctacatccagtccccaagcaaccaccggtccttgagatttcttttcaaccttgtaaaatcctttacaagcaaagatccacaagggatttaccctcccttgttctctttgaacaaccaagtggatgtacactcgacttga

SEQ ID NO: 31633 - DNA, 249 bp, Glycine max
  Peptide Sequence Number=SeqID_123318
atgtgggccatcatcgatgagtgcaaagagaagctaaatctagcggcgactcatgagcaaaggctagaggatgagtacgccaagatatcagcagaaagcgaagcaagggagaggagtcaagaacttccccgattgctagccaaggccaaagcaatggcagacacctactccgccccaagaagatccacggactctcagctatgtcagcatatgatagacttaatggaccatatgattagaaaccgctag

SEQ ID NO: 31634 - DNA, 447 bp, Glycine max
  Peptide Sequence Number=SeqID_123319
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccccgtcgagctgcgcgacgccgctgtacatgggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 31635 - DNA, 213 bp, Glycine max
  Peptide Sequence Number=SeqID_123320
atggttattcgcacctttcgtcaaccaggagcaaacgagcccgttgacgtgcagagactaacgtcgtcttctgcaccttttgtcatccatggacagcgagtcaggtggcaggcgaagataccttatggtttttactctcgtcgtccgaagacattcaagcccgatgacgcaccagattcttctttgctaggtggggacgatcaagttcgatag

SEQ ID NO: 31636 - DNA, 308 bp, Glycine max
  Peptide Sequence Number=SeqID_123321
ctttcagagcagcgaaaagggatgctggggttcctatgagccaagcgtcaacaaaagttgaaaaggtaaacttaacggatggagacgggcataatatactcggtaaagattatcagcctataaaaacaagagaatatacatttaatagatatgggaaagatgatgtggttattcaggatcactggcctggccatatctatggccccgagggaactcttggtaaccaagggccacatgtaaacattcgacctatcaacgatactcgtaatggcaaagtttcaggtaccctcgaacattaccctttttag

SEQ ID NO: 31637 - DNA, 381 bp, Glycine max
  Peptide Sequence Number=SeqID_123322
atggttatgggggatttcatcagcagactctccttccccgcatgtttgcattttagcgaagaaaacaccgagactttttcaagtctcacaagctatccagaactacgtaggtctgagttcctcattggaggatacgtaggagcaagagcctcgcttttgtcgaccataccgccttttgttgccatgactcaagagctggtagcccgcggagacaccttacggttatccgcacctcgtcattcagtgaccccaagtgtgatgacgagcagaggccaatatggtcatctgcgccctttccggagagtcagcgggcattttccgatggagatccttacggttattcgcacccttttcgtctcacaagtatccagaggtacgtag

SEQ ID NO: 31638 - DNA, 264 bp, Glycine max
  Peptide Sequence Number=SeqID_123323
atgatatgccatgaattcttcatacacactttcaagatcaggagctctttcttcttcataattgaaattctgataccaggggacagatgtcgtaccggatgtcacgacatcacgcttcagaacatgcagattatatgtagaattgtttacccagttcggtgcaacctcacctacatctgggggctaccaagccagggaggaaatccactctcaatagtgttagttcaaggtctaacagcccctgtttacaaccttctcacctaa

SEQ ID NO: 31639 - DNA, 604 bp, Glycine max
  Peptide Sequence Number=SeqID_123324
atgggattaataatcccacaagattatgctgaagaagttgcaaatcgctcgatcgaaggccagagagcacttcgattaacacccaagaccttcgatcaaaacccacaaaagctgttcctaaatcgagaggtcggcccggcctggttcactgactattttcctgctgtcgatccggacaatgaagaagaagtgaacgaaatatggtcattttacttgaatccacagatcctgtcttgtcgtacaggtgttcaatcaaactatttaggcttggttggataccagcctaatttggtttcaagacaatttggcctctcgcaaatccgtcctaaaagcttgttcgaagatcctcgagatgttataagaggagccaatctttcagaaaaaactttcaagaagtttttgaagatttctctagatgaaaactataacctgcatccttttgagttcaaccattcctacttctgcaccatagggtttgttacctggtgggagaaatattattcgggccgttcagttggagacactactatcatgatctccagacttgagagtggttttacacaaccaacggtcgagaatatccgctcaaaccttcaagctcgag

SEQ ID NO: 31640 - DNA, 221 bp, Glycine max
  Peptide Sequence Number=SeqID_123325
aaggaaaagaggctcctagcgtgaaggttgcttgtctcgcccaggaggtgggaacagttgaaaacaaagtggcgaacgggctgaccaagccaatgatgcttagctggtcttttcggatgatcagccacactgggactgagacacggcccggactcccacggggggcagcagtggggaatcttggacaatgggcgaaagcccgatccagcaatatcgcgtga

SEQ ID NO: 31641 - DNA, 241 bp, Glycine max
  Peptide Sequence Number=SeqID_123326
atggcttctatggacacctctgctatggcttttgaccttgacttggtagaacctcttgccgtagggatcaagaagaacccatatgcaatgcctatgcaaaagacacaatgcgggaatgtacacagtatgacaatatttaccgaacataagcaaaagggtatcatcccctttgaagaacatattgcagcagtagggactactagcaacaataagttttcaaagagaaaagctctagatgagg

SEQ ID NO: 31642 - DNA, 855 bp, Glycine max
  Peptide Sequence Number=SeqID_123327
atggtgtatgcagatggtgtcgtaagggttagggttgaaaaagttattgtcggtgtagctgaagtcccattgtcgacatacaaaattcagtatgttaggaaggcccttaacacattcattgcatggccaacacctcttgtaaacctggtatcagatgaggattcagtcattactccaaataaagtcactcaagctgttgaaggggtcaatgatgttgctatacatgaccccttgcgtatatcgatgagtggagtaatagcttgggtcatgtaccgatgtatggattccttgagcctcaatccatacacaatgcaaaggacagacgtgggcaatgttaagactatattgaaaaatggcttaaggaatcgcaccgacagggcccattggcagctggttgttttgcgtcttacaaacaatgtggtggtgtggttttgttcgttgcataaaagaatcactttcaaagcagaggctatgagtataggggcccatctttgcaagtgtttggaaacatgcggtgtggagcaggaggcaacaatagaggacaatgagattgatgggcagacattggcacatgggaacaagcataggcacgaacatggtggacatcaccatggaattgatcgacatggagcatcctatccttgctttgaatatgacaattgtgtcaatgttagttcacaaaggagcacaagctttcacttcggatacttgatccatttatgtcttgggtctttgatgcaattctaccccgcaagggcattggatagaagactccaagaagattgggtcagagatgcaagagaaggccctagggttctcatgagccttagggtagatttcgggcccatgggctaa

SEQ ID NO: 31643 - DNA, 231 bp, Glycine max
  Peptide Sequence Number=SeqID_123328
atgaggtcctttaatggtgattttccaccatggagatgcagtggaagacaaaggagaagaggtgagaggaggtgtcatccaccagggaataagtcatggaagaatgaccttcaccaccaagatgagccttggatcagaagcttggagaggatgcttcaatggaggaaaagagtgagagaaagagagaggggggagcacgaaattgaaggaagaaaaagggagagaagttga

SEQ ID NO: 31644 - DNA, 468 bp, Glycine max
  Peptide Sequence Number=SeqID_123329
atggtgcagcccaaaccaagtactggcctaaaggggaaatctctccaacatgctctcactttcatacctcctcgcattcaaaaatcaaaggcttgggtccctaggcctaagtcatgtgcaaacaccattgagacatttcaccgagcatatggtgggcgcacttttgggtaccaacaacaaggggataggggcaatgtggcttgccccatcatttcagaacacaacctaggcctaaggccatcccctacaaccccccaattcaatgaatcaaagcataaatttgcccaacattgtctcacgaaattgggcaaatcatctagaaaccaaaggatagtgcacttacttgtatggagtggcaaggacactaaaatggaagcaaaaagcacacaatggtggcctagggtcagaaaaaccagcaatcctgtgagggcagcgttcttaggtgagggggagaagtttcttgggtga

SEQ ID NO: 31645 - DNA, 572 bp, Glycine max
  Peptide Sequence Number=SeqID_123330
tcgattgggaccaacatttggctgggatagggggcagcgcaatcaattggtttcctcgatggaaggaaggcaaggagggagtccttttctcatgtggggactaccctaatgttccgttgttagggacaaggggttgcattaactataatcccgcacttgccataagacagttagggtaccccatgaggggagcgccaacagaggagagtctctcgcctctccttgtgagggatctaggcgcgcaaagtctcaaggttatacaaagagtccacaaggcgtggagaagtccgttgaggaaagacaaggagcttaggggcattcgtaatggcgtcatcggtggttatcatggatggctaagagttcacacgcgagggttagattggctctccaagttgaaagttatcaatgaggagaacttcaaagctccggaggaagatgaagaagtccaagctctaaaattagagctagggaaggcgagactcgccaaggacaagttcaaatcagccgctacacacatccggaaagagtgcacgagttacaagaggaaacgcggccactgcaagagcccttga

SEQ ID NO: 31646 - DNA, 462 bp, Glycine max
  Peptide Sequence Number=SeqID_123331
atgtcagtgaaaaacctcggcagacgcctaggagtacatgacaagacaaaccacacactagcaagtcaggtcactctcactaggcttaaaggagcactcaaactgggtgatccccaaggcctacacttcgaagagtccgtcaggtttatctcgtcgcccttaaatggtcttagcattaactcatcacccttaaatggacttaacattaactcatcgcccttaaagggacttagcatcaactcatcgcccttaaagggacttagcattaactcgtcgcccttaaagggacttagcatgaactcgtcgcccttaaaagggtcttatagtcgtgtgattgtacaattcatagttcataactcaatgcacacaacatctcaatcacgtgcatactcagttcatcacatacactcgatctcatcacaatggtataatctcaatttaacacattattacacttcataa

SEQ ID NO: 31647 - DNA, 159 bp, Glycine max
  Peptide Sequence Number=SeqID_123332
attgtggaccctgaaaaggtaaaagccatccttgatgatgcaatcctccctaggaagggaccaatcactagaaccatgagcaagaggctccaagaagattgggttagagctgctgaagaaggccctagggttctcatgaaccttagggtagatttctga

SEQ ID NO: 31648 - DNA, 459 bp, Glycine max
  Peptide Sequence Number=SeqID_123333
atgggactaaatggagagtacaatttgaaggagttaatgacattggtaagcttaggagctgcacgcacccgttctgacccaaaattaagaccaaccactagacacatagtaagcattcttggtgcgaagttatggacatttattgacaatgcagtaagcattcttgatggcaatgaaaaattaatcaagggaaagaacatggatagtagggaagattggagagaaacaaatacttgctctttgtcattggttaagacaactgaaggtctaggaatacaacgaaaagtagcacaaacaccaatgaaaatgaagctagtcaagctgctctttcaagcaacaatatgcagcaacaaaccattttggaaacaacaaaaacacaacatgcagaataaccaatcaaggcagaacgaagaaggcagaataagcaagcaaaaacacaccaaaaacactctgaagtaa

SEQ ID NO: 31649 - DNA, 915 bp, Glycine max
  Peptide Sequence Number=SeqID_123334
atgacccaagagctggtagcccgcggagacaccttacggttatccgcacctcgtcattcagtgaccctaagtgtgattgatgagcaaaggcctgtgtggtcatttgcgccctttccggagatgtcagcatcttccggtggagactttttcaagtctcacaagttatctagaactacgtcatgtgacatgcaccctttgtcatccaaggcggcgggcccgatgacatgcggagacaaatttggtcattccgcaccccttgccattcagacacagttgtgtccgatggcacgcagagacaaaatttggtcattttgcacccttttgtcatccagaggcggcgggcccgatgacatgcagagacaaaatttggtcattccgcaccccttttccattcagacacagtcgtgtccgatggcacgcagagacaaaatttggtcattctgcacccttttgtcatctagaggcggtgggcccgatgacatgcggagacaaaatttggtcattccgcacccctttgccattcagacacagtcgtgtccgatggcacgcagagacaagatttggtcattctgcacccttttgtcatctagaggcggcaggcccgatgacatgcggagacaaaatatggtcattccgcacccctttgccattcagacacagtcgtgtccgatggcacgcagagacaaaatttggtcattctgcacccttttgtcatccagaggcggcgggcccgatgacatgcggagacaaaatatggtcattccgcacccctttgccattcagacacagttgtgtccgatggcacgcagagacaaattatggtcattctgcacccttcatcaatcgcggtcgacaagcccgttgacacgcggagatttacatcatcttccgcactcacaagatctgtcatactga

SEQ ID NO: 31650 - DNA, 237 bp, Glycine max
  Peptide Sequence Number=SeqID_123335
atggtggagatgcataaacgacaatcaattcatgtggctccgaataagatggtggaggatgcacgaacagtgctaggcaatcaatacgtggggctccggactcaagtgtggaggatgcatgaacgacaatcaattcatggggctccgaataagattgtggaggatgcacgaacagcgcttgtaaacaattcgtggggctccggactcaatggtggaggatgcatgaacgataattaa

SEQ ID NO: 31651 - DNA, 177 bp, Glycine max
  Peptide Sequence Number=SeqID_123336
atgtcaggattcacaagcgattctcctcaaattttagccagcccgcatcaattagactttgcaccttacgcttcagggccctacaatgctcagtggaatgccccggggctctccatgatagcacacgttgcgttcgagtcgtttcctcagaaaatggaggttgagaaacctagcagg

SEQ ID NO: 31652 - DNA, 234 bp, Glycine max
  Peptide Sequence Number=SeqID_123337
atgccccttttgcgggcgtgcgaggcgaggctcatgagtgcgctttccaaaggaggaaagatgcgtggagtctccaccaacgtttatttgtggaaaacgtcggaaaaaccgaaggataccggtcaaaacgaaaattctaagttcgggagttgtgatcattttaaggtgttggaccttaaaaatgatccatttagttgtgacttttttgtggacgagcttgactttgcgggttga

SEQ ID NO: 31653 - DNA, 222 bp, Glycine max
  Peptide Sequence Number=SeqID_123338
atgccaccttttgctttgaagacacaaaaccaaatcattgttgcttgcatggctatacataatttcattcaaagaaatgacaagagtgatggagaatttgattcactagatgaagataacgaatatatagatagtgatgaagatgaaagtgaagttcgacaacatgggagaaaccggatgctcaaagtactctacaaatggaacaatttagaaaatctttga

SEQ ID NO: 31654 - DNA, 252 bp, Glycine max
  Peptide Sequence Number=SeqID_123339
atggaggccatgaaagagaaaatgaccacaatgatggaagccttgatgagtatgagaaaaatgatggaggtcaacatggctgcagtcgttgccgcaagtactgccactgaggtggacccaactcacccatctggcctcaatcaagtaaatcctccaatcttggatatggtagggcagggaggcgaagcgttaggaagtacgagcggcccccattttgtgcaggtccagagtaagcattcggggatcctctag

SEQ ID NO: 31655 - DNA, 520 bp, Glycine max
  Peptide Sequence Number=SeqID_123340
cgtgagctatgagaaagcgcacgcttcccgaagggagaaaggcggacaggtatccggtaagcgcagggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31656 - DNA, 149 bp, Glycine max
  Peptide Sequence Number=SeqID_123341
ctgttttgggtgaaaaaaattatttccgtgaagaaaatctaagccgaggtgcttccgtaacatttccgtgggtaattaagcgaagattttcaaccgttctttgtcattcatcgttcgttcttcattattcttcgatcttcaaccggtaa

SEQ ID NO: 31657 - DNA, 387 bp, Glycine max
  Peptide Sequence Number=SeqID_123342
atggtgattttcaaccatggagatgtagtggaagataaaggagaagaggtgagaggagacgtcatgcactacggaataagccatggaaggatgagcttcaccaccaagagagtgccttggataagaagcttagagaggaagcttcaatggaggaaaataatgagagagagagagaatggccaaaatccaaggcccaaaagaaggaaaacctattctaatatttacaaagacaagtggacccaaccttggcccatggactcagaaatctaccctgaggttcatgagaaccctagggccttcttcagcagctctagcccaatccttttggagcctcctactcatggctctggtgactggtcccttcatagggaggattgcatcaagtaa

SEQ ID NO: 31658 - DNA, 402 bp, Glycine max
  Peptide Sequence Number=SeqID_123343
atgacaggctttgccaccagtgtgattggttgcggggtagaggcgggcatagaacgagagctcagtgaagacgaaaccccggatggccgcccaggtgttagcgtactcatgtttgccatgggtagcaaagtgctgatgcagcagctggaaacccgtatggggcaatgtattctgacctgtccgacggctgcagcctttgccggtattgagtctgacgacatgattagcctgggtatccaaacaaatcccggatgcgaatggcaagctcaaacgttactggcgtatcccagtcatggatggcgaatttttgaccgaagaaaccacggggatggtgcgcgccattggtggcggcaatttcctggtattaggggccagtcaggcacaagtgctgaccgcgtgtga

SEQ ID NO: 31659 - DNA, 348 bp, Glycine max
  Peptide Sequence Number=SeqID_123344
atgtctcttgctactctatttggaaaattacaggaacatgagatagagttgcaaagactaaatcaagatgaagaaaatgataagaagaagaagggaattgctcttaaagcctcatcttcaatccaagaggaaagtgacatagaagattcaaatgatttaaatgaagatgaagatcttagcctctttgtcaaaagattcaacaaatttattagaatgagaggaaatcaaagaagacaaaacttcaaatctaaaagaagaactgaggagtcatctcaaatcccaaaatgctttgagtgcaatcaacccggacatctgagggctgatttccaatctttaagaagaaaatag

SEQ ID NO: 31660 - DNA, 432 bp, Glycine max
  Peptide Sequence Number=SeqID_123345
atgacatcttcatcatcatcttcatcacatattaacattaagtctggccccatcgatgctgatgtattatggatgcaacctaagcatgtttcagaacatgtttggaatgggaagaagatcggaaattacatatccgacgagttgtccctacgtatcaaggggaagaacaaattccagagcaaatttttccttttcttcaacaatctggttataagtgtggatggtttaccattaatcggtccaacaaatcttgattcggctgatttatgtgaggaattattgggagtcagaccacaagaagactgtggcacatatgcatggggagctgccgtacttgcttttctatacaaagagatgtgtagtgccaccgattataaaactcaatcaatcggaggtatgtgcatcttactacaaatgtgggcatgggaatga

SEQ ID NO: 31661 - DNA, 348 bp, Glycine max
  Peptide Sequence Number=SeqID_123346
atgaccggaaggctgcttgccagatcattggctcttgaaagccacatccttcactatctcattgtgcgtattttacttccaagatcttcaaaccttgcacaggtttctgaagaagatcttattgtcatatcctttttgatcggtgctgctgtgattgcatcttttggttaccgcaaagagcatgatggctcttgggtaaaaaaggatgctcaacccattgatgatgaaggacacttaccagttggaaaggattcctctctccttcagagaattttggacaggtttgatggtcttcaaacctatgttggtgaaaggtttgatgctttggaactacaagtggacaggtga

SEQ ID NO: 31662 - DNA, 629 bp, Glycine max
  Peptide Sequence Number=SeqID_123347
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaacccaagggttcctccgcaaggtcgtccacggaggccgaaagatggttatcggttcaaggacgcaaggtgcccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 31663 - DNA, 522 bp, Glycine max
  Peptide Sequence Number=SeqID_123348
atgactaggggcaatccaggtgatttgcaaccctttgatcctgaaatagatagaacctttcatagattagttaggcatagtgtgcatcctgatcattttgagcattatgagcattccatgcattctgagcattttgttgctggtgattctgaacattctgattttgagcattcggctgctaattttcatattgagaacatggctcaaactctacctcgtgagaggactcttagggagatggctgcacctgacttcacttatgaaagcttgtgcattcaatatcctgatgaggatgttccatatgttctcaagactggactaatacatttgctgcccaagtttcatggtcttgtaggtgaagatcctcataagcatcttaaggagtttgatattgtttgttccaccatgaagtcccctgatgtccaggaacatcatatctttctaaaggcttttcctcattctctggagggagtggcaaaatattggttgtactaccttgctcccaggtccattaccagctaa

SEQ ID NO: 31664 - DNA, 150 bp, Glycine max
  Peptide Sequence Number=SeqID_123349
atgattgtaggagcagcagccaacaacttgctagatacatcactctcttacagtgttggatatatgagcactttccatcagttgtgtagtgtatggctgatccggactatgatgaggtatcaccacatgcatgtcggtggattgctatga

SEQ ID NO: 31665 - DNA, 255 bp, Glycine max
  Peptide Sequence Number=SeqID_123350
atgtgtgttcagcaagaagaaagacttgtaatggagatgtgtgagagtgcatcgctgacaactgcttgtgggaagaacaaagcaactaagtctcaagctaataagaaggggaatggtaaaataccacctcaagctgatattaaaaaggtgacaaagtgtttctttttgttaatattaacacctggtggattgattttggatctacaatccatattgcaaatgtatgaaaaacctaaggaaaccagtgggaagtga

SEQ ID NO: 31666 - DNA, 304 bp, Glycine max
  Peptide Sequence Number=SeqID_123351
agggctttttccggaggagccctggtgcttaccaacatggatggcgaagagctaccttcacccggatttcctgtctgttgtatctctcgttacaatctttcaaagaaatgaacgtggattcgaggcttttagtcctcacgggcaggatcaccttgggctaccttctggagtagagacgaaacatgaacggcagaaaccaatcaaggtacttaaggacggatgcaagtggggatggggtcacgaccgaccgtcgttgcccttctctgtgcgaaacaagcagagaatgtcgctgcaaggcagcccc

SEQ ID NO: 31667 - DNA, 311 bp, Glycine max
  Peptide Sequence Number=SeqID_123352
atgggtctgagcaaggacaaccacgggaatgccgatgtggtcgacattagggggaacccgtacaaatatgggttagggtatgaacccgggaaaccgggaagaaggaatgcgccgtcaagactctgggcagatagggcatggcccgaccatgttagccagtgtttcacaagtgctgggataatggtcgaggaagagggtcgattctttgaggatcctaacaacgagggttcgataatcgattttgaccgagaagtaagtcaaacaataaacgaagaaggggaagaggacgtcctttcaccagagttggagag

SEQ ID NO: 31668 - DNA, 378 bp, Glycine max
  Peptide Sequence Number=SeqID_123353
atgactagaggcaatccttctgacttacaacccttagttagacatcattttataccttttgagcatcctgagcattctgttactggagagtctgtgcattctgttatcggtgattttgaacatcctgattttgagcattataattttgaacattttgattatgaacattctgagaacatggcacaacctccaccccgtgaagacccacacaaacatttgaaagaattccatattgtctactccaccatgaaacccccagatgtccaagaggatcacatatttctaaaggcctttcctcattctttagagggagtggcaaaggactggctttattaccttgctccacggtccatcaccagctgggatgacctcaagaga

SEQ ID NO: 31669 - DNA, 171 bp, Glycine max
  Peptide Sequence Number=SeqID_123354
atggctctcatcatcaaggaagcaagcccagtggaattttggggaaaaagttgcaccttcagatacccaagagagaaaataagagagcacaagattagtttccaaggaatgccctctatggggacattcccaaacttgttaaacgaaggattcatggggatcctccagtga

SEQ ID NO: 31670 - DNA, 303 bp, Glycine max
  Peptide Sequence Number=SeqID_123355
atggaaatctttattcagtcaattgatcctggtgcatggaatgctattgttaaaggaccttttataccatctaaagaagtgaatggtgcaaaagtgcaaaggaaatatggaaaatgtttgaagtcactcatgaagccacaacggatattcacccatattgtgaaacaccttcttggtcttggaaaaacgtttaaagatgatgagctaaagaacttcggaaccaaagatcacaatgatcaaggaatccaaggacttagcatcaatgtcaatggaagctctcttcgaaaaattgcttgcatatga

SEQ ID NO: 31671 - DNA, 793 bp, Glycine max
  Peptide Sequence Number=SeqID_123356
atgttcccggtcctgcatcagctgttaggccagaccctgattaccaccgatggtaaaacgctgctcggcgccgacgataaagcgggcatcgcagagatcatgacggcgctggcgacgctgcaggcgaaaaagatccctcacggcgatattcgcgtcgcctttacgccggatgaagaagtcggcaaaggcgcgaagcactttgacgtcgccgcgtttgatgcccgctgggcgtacaccgtggatggcggcggggtcggcgaactggagtttgaaaatttcaatgccgcctcggtgaccatcaaaattgttggcaataatgtgcatcccggcacggctaaaggggtgatggttaacgctttatcgctggcggcgcgtattcacgccgaagtgccggccagtgaggccccggaaaccaccgacggttatgagggtttttatcacctgaccagcatcaagggcagcgtcgaccgggcggagatgcactacattttgcgcgatttcgatcgcaagcagtttgaagcgcgcaaacgcaaaatgatggagatcgccaaaaaggtcggtaaagggctacatccggattgctacatcgaactggtgatcgaagatagttattacaacatgcatgagaaggtgattgcccatccgcatgtagtggacatcgcgcgtcaggcgatggtggactgcgatatcgagccgcagataaagccaatccgcggcggtacggacggcgcccagctctctttcatgggcttaccgtgcccgaacctatttaccggcggctacaactatcacg

SEQ ID NO: 31672 - DNA, 297 bp, Glycine max
  Peptide Sequence Number=SeqID_123357
atggaagaatctattcatgttgtgtgtgatgaaactaattctattgttcaagaaaattctttggaaaatgaagatgcaggttttcagcataaggattttgctcttgaagataaaaccaaagtggaagaacttgaacaatgcaaagaaatctcaaccacacctcctaaggacctccctagagaatggagaactcaaaaagacctctccttggataacattattggagaaatatcaaagggagtctctactcgctctagatttaggattttatataatagcatggcttttgtttcttaa

SEQ ID NO: 31673 - DNA, 1077 bp, Glycine max
  Peptide Sequence Number=SeqID_123358
atggcagaatcgtcaaagaaacataagggttcatccgcctccgcttcggcttcaagagctcatcgttccggagccactagcgcatccacagcaccaattccaccctcattatcctcttccacattgttttcttccgaagaacagcagaaatggtattcaaatcttttctcatctcgttccattatcgatcctaagttcattgatatggaattcttttctgatgaaacctttgattgcattcaagcatttcagaatttaggtctcatacctttcatgtcattacagttgcctatttatcctgaattggttaaagccttttattgtaatcttgaaattcaggacaacaccttaatttctgaggtttttgtgataaaaatggtcattgaccaatccctttttcatgacttaacccaattgtccagtgacggtgtaccatttgaagttggtttgcaccaacaatgcggatatgaccggacgcttcttgccagctcattggcttttgaaagccgcatccttcattatctgattgtgcggatttgcttccacgatcttccaatctgcccaggttctgaggaagatcttgttatcatgtgggcctttcataccgggcgtcaacttgactgggcacatcttgtaagatatcgcatgcataaggcattgcgattaaatgcacctttgccatatccacatcttgtcactctctttttccgccattttcaaattcctcttgattctgaaccttatgttccaatcaagagatcttttttaattggtgctgctatgattgcttcttttggttaccgcaaagagcatgatgactcttgggtcaaaaagggcgctcaacccgctgatgaagaaggcaacctaccagttgaagataattccactcttcttcgaaggcttatggacaagtttgatggacttcagacttttgttggtgagaagtttgatgccatggaattgcaagtcgacatgcggttcgatgccatggaatcaaggatcaccaaagttgaagaagatgtatccttcatccgtacttgctttgatccaccaccaccgcctccatcatcatcttag

SEQ ID NO: 31674 - DNA, 174 bp, Glycine max
  misc_feature (27)..(27): n is a, c, g, or t
  Peptide Sequence Number=SeqID_123359
gattctattgaaaacattattgatgtncaagcggatagtaactgtggttatcggacaatagctgccttattgggtttgggtgaagaatcaagctcattggttacaatggacaagtggatgaatattacggatatgagatatgtcattgtttcacgatacaacgtaattgcataa

SEQ ID NO: 31675 - DNA, 123 bp, Glycine max
  Peptide Sequence Number=SeqID_123360
atggagacctcagccagctatggcaggctgccacggcgctgtcctggaagcagggaaatttttttctcaaaatactctcttaaagaagtcatcccagcttgtgatggaccttggagcaagtaa

SEQ ID NO: 31676 - DNA, 522 bp, Glycine max
  Peptide Sequence Number=SeqID_123361
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttaataaaaggtcaacacaggctctgctgtgctttgatgatcatgataactcgtcggatcgcacggcctttgtgccggcgacgcatcattcaaattctgccctatcaactttcgatggtaggatagtggctaccatggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagag

SEQ ID NO: 31677 - DNA, 599 bp, Glycine max
  Peptide Sequence Number=SeqID_123362
gtgagtacggaggaggttacagatgcagatgctccagttcctgtacccactgatgaggtttccatagtggggcaggcacttcacaccttccttgcttggtcgacacatctggtcaagtttttatcacagctggttagatgggatgccaccgtgttcggggtctttaatccagatttcccgctctacataaagcacgaagatctctccgaaatcgcacacggtggtatgcaagcggggaattccgatatctatggattcctcgagccacagtccattcagaggtctgggcaatcacaatttgagtctgaaagttacataaagactttgatgcagagttcaaaacacgatatctatcttggagcctacctaaatgggccagacaactaccttaaggggattattaacagcctaaatcaaaggctcctgctaggtggattgtctttaagacaaaaaggaagtactgagtgtggctactatgtcatgcactggatgtccaacatcattttaggaacttttaggaataactgggaagcgtattttaacgatcctagaccattggagccagagagattaaaggcattgcggatccagtgggcaca

SEQ ID NO: 31678 - DNA, 905 bp, Glycine max
  Peptide Sequence Number=SeqID_123363
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccggctcgcacgtgattgttgtcgagcgtggctcatccaccattttatcacggcgagtcggccatgaaccagatttcaaccaccacgaggcgggcaggcgtgccctcggcctaatggcttcgggcgcaacttgcgttcaaagactcgatggttcacgggattctgcaattcacaccaagtatcgcattttcgctacgttcttcatcgatgcaagagccgagatatccgttgccgagagacgaggaggccgggcgcacggggcgccgtggtcatcccctccctcccgacgggagatgaataaacaagttcgcggtggacttctcacaactgtcgcgggcagtgaaccgctcacgtcgccgcaatccgaacacttcaccggaccattcaatcg

SEQ ID NO: 31679 - DNA, 360 bp, Glycine max
  Peptide Sequence Number=SeqID_123364
atgaagatgaatatgaatgtggggtacctcttctcccaccagatctccctcatagcacaacatgacacatccagactaggattctctcccttgatcacaactttatgtatagctaggggagttcaatcagattcgaggtccctggagagtctgagtgttgccattaaattggcttatattaagaagaactattggaatcttgatgatccaacaataactttcagaggacccaggaaggccaggggtaagatatctgaggccccttccacttcagcatcagaggcaccaacaccttcttcttctacagtacctctctcttcatccactcagattctagttattcctcctgcacccacatag

SEQ ID NO: 31680 - DNA, 351 bp, Glycine max
  Peptide Sequence Number=SeqID_123365
atgaatgacgaagagcggttgaaaatcttcacggaatcacccacagaaacgttatggaaacgttacggaagcacctcagcttggattttcttcacggaaacaattttcctcagcaatttcaacaaaataggggaggagcttgccacccagctcgcccaggcgagccaggttgcttcttctagaagcaaccgccttctggaggaagaatctggaaggcccaagtgggcctgcgctaggcaatcaattcatgggtctccgaaagattggaggatggaggataggcgaacagcgctaggcaatcaattcgcggggctccagcctcgatggtggaggacacatgaacagtgctag

SEQ ID NO: 31681 - DNA, 253 bp, Glycine max
  Peptide Sequence Number=SeqID_123366
ccaaccgccgatcacccgggccttcattgagaagtattgcacgcctaggcaggcgcagggtgatgcacctcaggccgcagactcaccgccaccacctcatcaggccgatcccgctggatcactaggcatggagcgttatctacagcacttggttcgccagcaggcggccaaccaccgggggcagagcagtttggggctgaggtcgcatgacccggagataggcccgaggcccaagcaggggaggagcccgtag

SEQ ID NO: 31682 - DNA, 173 bp, Glycine max
  Peptide Sequence Number=SeqID_123367
tgaaagtcgaagaagcaaaggggggagaatctagtgaagaaatctatccccaagaagaaggacaacctttaatggttaaggaggagtgtaaggagggctttggttcgcaagagattaaatccttgtgctttgttggtgcccaaaataggtattataaggcaccaaatccctaa

SEQ ID NO: 31683 - DNA, 451 bp, Glycine max
  Peptide Sequence Number=SeqID_123368
atggctctagaatggtggcctcagatgactcatcatccatatgctgtggtactagggctgtgggaccttcatcttccctgtgaagagaaggaaggagctgttgaagtggatgctggagtaggagctgcagatgtggaaggaagctcaactggcctcgccctcgccctcctagttccttgggcggtgatcagagcaggaaacccaagtctagaagtgctagactgggctatagaaatcatctggctagaaataagagctcctatgttcatgtccatgcaagaaactaggccaaagatcagcctagctctatcgactgtcagatcagaggtatgtgatgtgggggccaggttggagtatgagagaacactccacacctgggctaaagtagtcaaatatttcttgagaatcctcccaggatggtcctcagcgttcaaaataaaccctcagcccg

SEQ ID NO: 31684 - DNA, 141 bp, Glycine max
  Peptide Sequence Number=SeqID_123369
atgaccgcgcctatccgtcaaggcttgataacccttcttcaagagtatcaagaagtctttgtgtggtcgtatcaagacatgcccggtctcgattccgacattgtgcagcataagttgcctttgaatcctaggtcttctctg

SEQ ID NO: 31685 - DNA, 138 bp, Glycine max
  Peptide Sequence Number=SeqID_123370
atgccagaggacccaactacaccagtcctaactgtggacacttctcctcccgctactccagtgcttcaattgacagatgaggaggatgtgaaacacttttatctttctgtgaaaaatggatgtatgttttcattttga

SEQ ID NO: 31686 - DNA, 231 bp, Glycine max
  Peptide Sequence Number=SeqID_123371
atggcagcggaatggagaaggaagagagagaggagacgccacttcaaggagaagatgagtctagaagaagctcacaaccataagaggccatggataagagcttggaggaagaaggagatgaatgaagggagaggaagagaagagcatgaaattttgtgctctaaaagagctctgaaatctaaacccactaatccaagatcaagtccaagattctccactaagtgtgcttag

SEQ ID NO: 31687 - DNA, 343 bp, Glycine max
  Peptide Sequence Number=SeqID_123372
aatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgcgcctcttgatgacaaaagggtgcggataaccgtaaggttctccgcgtcagtatga

SEQ ID NO: 31688 - DNA, 99 bp, Glycine max
  Peptide Sequence Number=SeqID_123373
agaagaagggaaacaaacggggaaaggaagaaaagagagaagggatctagcttgtaatgttggggcagacggatgtgttttcaacgtttgcgtctgcgg

SEQ ID NO: 31689 - DNA, 780 bp, Glycine max
  Peptide Sequence Number=SeqID_123374
atggaagaaagcatgtctcctttccttgtgagagatttcggcacgcaaaatttcaaggctatacaaaggatccctaaagcgtgggaaaccccgttaagaaaagataaagaacttaggggcattcataatggcattatttgtggttatcatgaatggctgaaagttcatacacgaggtttagattggctcgccaagttaaaagtcgtcagtgaagagagtttcgaagcaccggaagaggacgaagaagtccaagctctcaaaagcgagttaggaaaggcgaaacttgccaaggagaagttcaagttggccgctacacgcatccggaaggagtgtgccggattacgggaagagaatgcaactaccgcaagagcccttgaacaagaggccaagagggctcgcaaggaagagtatggccgtaacaaatttcgtggagctctgtggggtagcaacaatgaactcaagctgcgaagggaagaaagggaccagtcgcgagcgcatagcatggtcttgaaaggggagttagttgcctgttcaaggtccaaaaggagcttgtctcagcgtttatacgagacggagaccaacatgctagctatcatcgccaagtaccaagaagagttaggtctagccacggcccacgagcatagggtcgcggacgagtatgcccaagtatacgcggaaaaagaggctagaggaagggtgatcgactctttacaccaagaggcaaccatgtggatggatcggtttgctcttaccttgaacgggagtcaagaacttccctga

SEQ ID NO: 31690 - DNA, 129 bp, Glycine max
  Peptide Sequence Number=SeqID_123375
atgaacaggtcagaccaaccaaccacgggatttgaagaagtcagggcaatcacaggatttgaagaagacattcccgtgattcaaatttgtcaccatgagcaggtcagaacaaccacgggatttgaagaa

SEQ ID NO: 31691 - DNA, 204 bp, Glycine max
  Peptide Sequence Number=SeqID_123376
atgattgacctgatcttagccctgaagatcgagatatgtggattgaagatctggtgggagagaaaacttcaatatggcagacagatgaacttaggcgttcaaaaccccactccagttgatgaagctagggcagaatggtctatggccattttgaccaagtgttcaagagttttgtccttgttatccccaaaggcacctacatga

SEQ ID NO: 31692 - DNA, 492 bp, Glycine max
  Peptide Sequence Number=SeqID_123377
atggttaatgttcccctcaaaaaaaaaaaaaagtgcaggttagctcgcctgggcagtcaccgctttaggagcgctgtacaccagcagcgcttcgaggccatcaagggatggtcatttctccgggagcggcgcgtccagctcagggacgatgagtataccgatttccaggaagaaataggtcgccggaggtgggcatcactggttacccccatggccaagttcgatccagaaatagtcctcgaattttatgccaatgcttggccaacagaggagggcgtgcatgacatgaggtcctgggtgaggggtcagtggatcccgtttgatgcagatgctatcggccagctcctgggatatccgttagtgctggaagagggccaggagtgcgagtatggccagaggaggaaccggtctgatgggttcgatgaggaggccatcgctcagttgctatgtataccggggcaagattttgcccggactgctgccgggagacgg

SEQ ID NO: 31693 - DNA, 108 bp, Glycine max
  Peptide Sequence Number=SeqID_123378
atggggagtcaacaaagtatttatggcaccgttgccagatctactgcaggtgatttgatccccattgatttggagattaacgccaattgtagaaggcgtaatcaatag

SEQ ID NO: 31694 - DNA, 825 bp, Glycine max
  Peptide Sequence Number=SeqID_123379
atgccgaatcgagaggagtgggtcccgtttctggacgtattagcattgctaatctttgggattgtcctctttccaaacgtggacgatttggtggacctagccgcgattgatgctttccttgcatatcaccatagcaaagagagcccagtggtagctatcttggcatacttatttgatacatttgaccaaaagtgcgagaagagtagcgcatggatcatctgctgcttacctgctctttgtgtatggggcatccgtaatggcatcatcggtggttatcatgaatggctgaaagtttgtacaggagggttagattggctctccaagttgaaaataatcaacgaggagaacttcgaagttccggaagaggatgaagaagtccgagctttaaaaacagaactaggaaaagcaagacttgccaaagaaaaattcaagttagtcgctacacacatccggaaggagtgtgccgagttacgagaagaaaatgcagctaccgcaagagcccttgaacgagaaaccaagagggcttgcaaggaagagcatggccgagataaattccgtggagctttgtggggaagcaataatgagctcaagcttcgaaggggagagagagaccaatcacgagcacatagcatggtcttaaaagaggagttagctgcttgctcaaggtccaagagaagcttgtctcagcgtttatgcgagacagagaccaacatgttacccatcgtcagcaagtaccaagaagaattaaatctagccacggcccacgagcacaaagtggcggacgagtatgcccgagtgtacacggaaaaggaggctagaggaagg

SEQ ID NO: 31695 - DNA, 168 bp, Glycine max
  Peptide Sequence Number=SeqID_123380
agagttgctgctagttctaagaagcacaagaaagccattggatggactttagcagacattcttggtattagcccatctacatgcatgcataggaaattgttagaggatggagctaagccaatgaggcagccacagcggcgactcaaccccatcattctagattgttag

SEQ ID NO: 31696 - DNA, 789 bp, Glycine max
  Peptide Sequence Number=SeqID_123381
atggccccgaggaagcttgcctcaaagaggtccaggaaggataaagcggccgaaggaaccagttccgctcccgagtatgacagccaccgctttaggagcgctgagcaccagcagcgcttcgaggccatcaaggggtggtcatttcttcgggaacgacgcgtccagctcagggacgatgagtataccgatctccaggaggagatagttcgccggcggtgggcatcattggttacccctatggccaaattcaacccagccgtagtcctcgaattttatgccaatgcttggcctacgaaggagggcgtgcgagatatgagatcctgggtgaggggtcagtggatcccgttcgatgcggatgctatcagccagttcctaggatatcctttagtgctggaagagggccaggagtgcgagtatggccagaggaggaaccggtccgatggttttgatgaggaggccatcgcccagttgctgtgtataccggggcaggattttgcccggactgttgcagggaggcgagtgcgaattatgcgcaccaacatgaccaccctgacccagatatggatgacgttgctgctcagcaacatcctgcccagcgatcataattccgacctccctctaccgaagtgtatggcgccgaccaggcaccctatggacccagataagtccaaccgggccctgggatttcccgcactgatcacaggactctaccagtcgttcggagtccccgtggcacctaccaaggtgattcagctgcccatcacccgggcttttattgagaagtgttag

SEQ ID NO: 31697 - DNA, 723 bp, Glycine max
  Peptide Sequence Number=SeqID_123382
atggggacaaatcaaaacggcaaaaggttttatcaagtcaaggttaaaggtctagatgtcactagcctcaaggaattgggacgattgatgggacccctccaaatgcaagccttccgcaaagtttacgggaagattctagatttgaccgtagcggaggtatttacggaagccgtcgtatccctcgcccaatactatgaccagccgttgagcaaggttgcggctgtgattggagattcagcaaaagagttggatcgcacgaagcaaactcgaaacggcgtagtgggcctgcctcggaaatacttggaaggcaaggcaagggatatggcgagccaagagaagtggggcccgtttgtggatgttttagctttgctgatttttggggttgtcctctttccgaacgttgacggcttggtagacttagccgccattgatgctttcctcgcatatcaccatagcaaggaaagtccagtggtagctatcttggcagatttgttcgacacctttgaccggagcacaatcaattggtttcctcgttggaaggaagacaaggaaggagttcttttctcgtgtggggactatcctaatgttccactgatagggactaggggttgtattaatcccgcactcgccataagacagctagggtatcccatgaggggagcgccgactgaagaaagtctctcgcctttccttgtgagggatctaggcgtgcaaggtctcaag

SEQ ID NO: 31698 - DNA, 177 bp, Glycine max
  Peptide Sequence Number=SeqID_123383
atggtgattttccaccatggagatgcagtagaagacaaaggagaagaggtagcttccttgagaagctttcttgtgaaaacttccttgagaagcttctttgagaaaacttccttgagaagctttcttgagaaaacttccttgagaagcttctttgagaaaacttccttgagaatctag

SEQ ID NO: 31699 - DNA, 411 bp, Glycine max
  Peptide Sequence Number=SeqID_123384
atgggatcttctctaccaaaagttatgcctctgtggtgggaattcaactcctgggttagggaggacagagttcttcattgtaggcccatggataatttcctccagcactcctccatagcaggctcgaaggtttccaatagaagaaggaaaatatggtggatagcagctacaaggagatcttctctcgtgtgctatcctgtagtacctctggggttagaggacttgaggcattctcttttgtacacaaccttgttgctagatgcaacaattgcatcagctaaggaggacattacaagaagagaatgtgaattgatccatgtgaatgacctcttaagcagggtcatcaaggagagacatgaggcacaagcaaaatgccagaagctaatgctggaaaaactagaactccaatag

SEQ ID NO: 31700 - DNA, 243 bp, Glycine max
  Peptide Sequence Number=SeqID_123385
aaaaataaaaggctacaacgcgaagggttttcctctaagctcagacataatatcaaaattcccaacggtgataatgctcttaattgggtttcgaacgtggtgttcaaatttcacaatgatctaacggtgaatgagcccgagatcgtcatttttctaagacaggtttggtgtgctacgggaaaaagaaagggttttgagaggagaatgggaaaaacaaaaatgaggccaaagagaggcatctga

SEQ ID NO: 31701 - DNA, 252 bp, Glycine max
  Peptide Sequence Number=SeqID_123386
atgtcaatctttaccctcggaagcaaaagagaggaaaatttccgatcaaagaaaaagagaaggaaaatttccaatcaaagagaaagcaaaaaaaagaggaaaggaaattcccaatcagagggtgggagaaagaaaaagaaaagaaagaaaattcccaaccaaagaatgggagaaagtaaaaaagaagaaagctcctggtcaaagaaaccagaagaaatgtacagagaggtctttggaccagacaatatctga

SEQ ID NO: 31702 - DNA, 525 bp, Glycine max
  Peptide Sequence Number=SeqID_123387
atgtcagctagtgatcatgccattctacgagacagaacccatcaacccacgaagaaaagcttgttacaggttgtaccatctgtggtgaggctcatgaaatgggccaatggtccctataatcaacaaggacagtggaggacacaccctggtaaccagttcaacaaagaccagagtgggccttcaaacaggccaatccaacaaggacctaacatattccagagaactactaagctggaggagaccttgactcagtttatgcaggtaacaatgtcaaatcataaaagcactgagtcagcactgaagaaccttgaggtccaggtgggacaactggccaagcagatagttgacaagtcatccaacaattttgtggcaaatacagaacagaatcctaaggaggaatgcaaaactgtgatgacaaggagtaaaaggtttgtggaggttgaggatgaagatagtgttgtgcatgagaaaaaaattgctgacaagaaaagtactaatggcaagaaaaatgaggtgagaggttaa

SEQ ID NO: 31703 - DNA, 381 bp, Glycine max
  Peptide Sequence Number=SeqID_123388
atgaccggaaggcttcttgccggttcattggctttcgaaagccgcatccttcattatctaattgtccgcatcttgcttctgagatcttcaaaccttgcacaagtttctgaagaagatctcattgttatgtgggcctttcataaaggtctaaaaattgattgggcacattttgtcagatatcgcatgcataaggcattgcgattgaatgctccattgccatatcctcatctagtcacccttttccttcaacagtttaacatccctcttgattatgaaccctatgttccaatcaagagatccttccttataggcgcttcagtcattgcatcctttggttatcaaaaagagcatgatggttcttgggtgaaaaagggtgcttga

SEQ ID NO: 31704 - DNA, 282 bp, Glycine max
  Peptide Sequence Number=SeqID_123389
atggtggggtacgcaccttcaagctttgcggatttggtcttcgttggtgaaaggatcgaagcgggtttggaaagaggcaaatttgatcatcctgctttgatgaatgagaaaactgaggcaaatgaagaggatgagaatgagggagaaacccttgttgtgactgtcattcctacaccaccaaatttcccatcagcccaacaatgtcataacttagccagtatcagcccttctcattacccatcaaccaatcatccacaaaggccgtcctcaaatcatccgtaa

SEQ ID NO: 31705 - DNA, 132 bp, Glycine max
  Peptide Sequence Number=SeqID_123390
atggatcctcctgaagattcagaaaatgaagaaataacctttgccttatggcaaaaagttatgaaagtgatgaagaggatgaatgtaaatgaaagtataagacatgcaaaagaggttcacacacatagttaa

SEQ ID NO: 31706 - DNA, 495 bp, Glycine max
  Peptide Sequence Number=SeqID_123391
atggtgggctacacatcttcaagctttgctgatttaattatcgttgacgaaaggatcaaagtgggtctgaaaagaggcaaatttaatcatcctgcttggacaaatgagaaaactggggcaaatgaagagggtgagaatgaaggagaaacccatgttgcgattgtcattcctacatggccaaacttcccaccagccaaacaatgtcattactcagccaatatcagcccttctcactacccaccacctagtcatccacaaaggccatccctaaatcaactacaaagcctgtctaccacacttccaatcacgaacaccacctttagcacgaaccaaaacaccaacgaaggaaggaattttgcagtgaaaaagcctatagaattcaccctaattccggtctcctatgatgacttgctcccatatccactccataattcaatggtagccataaccccaaccaaggttcctcaacctccatttctccgaggatacgactag

SEQ ID NO: 31707 - DNA, 156 bp, Glycine max
  Peptide Sequence Number=SeqID_123392
atgtcaaatgaagaattgaagttgcaggatccacgatgtcggatacaatgtcctgacatcctgcccgagaatactggagttgctgtacaatgcaagataaaagtcaagtgcagaaatttttcagaagaagatagatctcctccggggatcctctag

SEQ ID NO: 31708 - DNA, 312 bp, Glycine max
  Peptide Sequence Number=SeqID_123393
atgaccatgattacgaattcgagctcggtacccagtgatatgtcagaaactgtttttggatacagcactgctaggggaggaaaatggtgtatgttgccaaagtccttggcagcatcctcattgtcccttaggctaaagtggccatctagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31709 - DNA, 559 bp, Glycine max
  misc_feature (26)..(26): n is a, c, g, or t
  Peptide Sequence Number=SeqID_123394
cgccacgcttcccgaagggagaaagncggacaggtatccggtaagcgccagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctcaagaaacgccagaggcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31710 - DNA, 72 bp, Glycine max
  Peptide Sequence Number=SeqID_123395
atggaggttgaggaaccttggttggggtggttcttcgtcattggaagtgcggtagacaggctttgtggttga

SEQ ID NO: 31711 - DNA, 118 bp, Glycine max
  Peptide Sequence Number=SeqID_123396
atggatccccgtaagacaaaagccacaacttcattgtcccaggccagttatgactcatctagatttgtatcaagggatgcttggtgatgcaatcctaccccgcaagggcattggatag

SEQ ID NO: 31712 - DNA, 615 bp, Glycine max
  Peptide Sequence Number=SeqID_123397
atggttggtccttcagttgctcgtgtcagcacaaaggagaattgtgttgatccctcagggaatgatccagacaggggtgactcagacaaatgcaggttgtacgtcaaagaaaatcctccccgcctggttgccctaagaatactttatgaggggtacacaatcgttcacgacattcctttgctccatgatcaagtcaaggttggtgttgaggaggttagagatacaaatgctctcattcctgtacccactgaagagggagttgtgggattggcaaaacctgcaaataggctggatcatgatgtcgatgatctcctatacctgatgacattgaccatcccacaaatttttctgaagtcgttgcaggttatgtgggatgctaccgtgtttggggtgtttaatgacaacttccccttgtacataaaacatgaatatctgtctgaaatagcacacagtggtcaatgtctcaacatctctgttatacaattgtggattctgcatatgactaagacaagtatgcgagcggggaataccaacgtgtatggattcctcgagccacagtccatacagagatctggacaatcaaaatttgaatcaaaaagttatattaagaattag

SEQ ID NO: 31713 - DNA, 255 bp, Glycine max
  Peptide Sequence Number=SeqID_123398
atggaaaacgccagcaacgcggccttttacggtctggcctttgctggcttttgctcacatgttcttctgcgttatcccctgattctgtggataaccgtattaccgcctttgagtgagctgataccgctcgccgcagccgaacgaccgagcgcagcgagaaacagctatgaccatgattacgaattcgagctcggtaccatgacccactggtatgttgcccaagtgttcttcagcccaaaggacatcaccttgtag

SEQ ID NO: 31714 - DNA, 633 bp, Glycine max
  Peptide Sequence Number=SeqID_123399
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctttctccagccaagttcctgctggtactgcagcatcatcccctaggcaagtgacagttggccctagcaaaaggcacagagtgaccaatgatgcagaaaccgatccatgcccgtcacaaaagccgtcacaaagcggatcaactaccaacggcgaaaacaccaggttcaaaggtcatttgccacaggtaccgagctcgaattcgtaa

SEQ ID NO: 31715 - DNA, 267 bp, Glycine max
  Peptide Sequence Number=SeqID_123400
atgccagcatctctctcagctgcaagaagatcaactgcattgccaagctccaactctgcttttagctttagtcggctgagcgactctcctcctggagttaggaatcggcaagagataagagggacgtacttaacagcaaggaagtggaatcaatcccgtttgctacaggattctttcgatctgtttgaaaccccaatacttgctacttcagcagaggcatcttcctggcttagaaaagatccgctagagattccctctgactcctag

SEQ ID NO: 31716 - DNA, 235 bp, Glycine max
  Peptide Sequence Number=SeqID_123401
ggaccagtcactagagccatgagcaagagtctacaagaggattgggctagagctgctgaagaaggccctagggttctcatgaacctcaggactcatcttctccttgaagtagggtcacctctctctcttcctttctccattccactgccattcatcttccaagaagcaaaggaatccattgatgaagaagatcctaggcctacaagctccaacggagcttacatcaacacccatc

SEQ ID NO: 31717 - DNA, 225 bp, Glycine max
  Peptide Sequence Number=SeqID_123402
atgccttctcttcccctcattttggctttttccccttctcctcccaaaaccctatctttttcccgcagacaaccaaatctgtcccagaaaaacgacgatctcatactcattcaccgttggatcatcctgaaacttaagcaccaggttcggaacctaactccgagcactatcaccgttgggaattcagaaatcatgtcggagctgagagaaatacacttcacatag

SEQ ID NO: 31718 - DNA, 654 bp, Glycine max
  Peptide Sequence Number=SeqID_123403
atgaaggaaaatcattttgcaacaaaagttgatatcaaaatagcactccttcttaaacaatccttctaccttctcctatcaaaggaaaaatcccttagcactgccatacctcttgagcttgaggttattcctcaagtaaaggagttgttggatgagggtttggttcataagagattaactccttgtgctttgttggcgcccaaaataggtattatgaggcacataatccctatgataggtggtatgatgaatgtgttgagtggtgcaaccctcttttgtaaaatcgcccaacatcttcatgattcacaaacatggggactcattagtgatcaaggggttcccatggaccctaagagaataaaggtcaatcctgagtggcccactccatcaacatcactcgttaacttggtgtggaaccatgttccctcatgggaagatcccaagaaaaggaaattttgggatagtaaggccttagctccaaaggtcaaagagaaggaaaaagagggagggcattcctctaagaaagttgtaaagaaagagactcattttgcaacaaaaagagatattaagagagctcttcttctcaagcaatctttctaccttctcctctctagggagacttcccttagcattgccacaattcccttactttag

SEQ ID NO: 31719 - DNA, 468 bp, Glycine max
  Peptide Sequence Number=SeqID_123404
atgcaaagaagatctactgcaagtgatttgatccccatcgatttggagattaacgctacttgcaaaaggcgcaatgcagagagaattagaaattttttgcaggacttagaagcagtaacaactccagaagaagaacctcgatcttccgaggcatcttctagctttcctattccagggcaatctcatatagatttgattgaagaagttatcatggctgaagagccaaggagagtgaccttagaagattactcaagttcaaacccatacgcacacctggccacttacattgaaatatgcaatactattcgattggctggtgtgcctgaagatgcaattcgattgagcttgttttcattctcattgtctggagaagctaagaggtggcttcactcgttcaaaggcaacagtcttaagacttgggatgaagtggttgagaaatttctgaagaagtattttttaaaagtctaa

SEQ ID NO: 31720 - DNA, 147 bp, Glycine max
  Peptide Sequence Number=SeqID_123405
gagggaggaggcactgacgactcttcagagtgtaggccttggggtcatccggttgagtgctcctgtaagcctgtgccgatcccacatggttggagcattctcgcaaaacagcgtgaccctgactggtctccctttgatttcacttag

SEQ ID NO: 31721 - DNA, 513 bp, Glycine max
  Peptide Sequence Number=SeqID_123406
atggtggcgcgtgttatgctcaggaacggatttgagcccggaatgggtctaggcaaggactgcctcgagaatgccgacgtggtcgatatcaagggaaatccatacaagtatgggttagggtatgaacccgggatgccggggaggaggaacgtgccgtcaagatttcgggcggatagggtatggcccggccgtattagccagtgtttcaccagcgctggaatggtgtccgaggaggaggtgatcgcaatagaagaggagttccctcaagacccaccaagttttgtgcaaccatgccaccccgattcccaagtggggaactggcgcgtgataagccagtcagaagtctataccgctgattcaatatgtgagggtcgattctttgaggaatctaacaacgagggtttgacaatcgatttcgatcatgatataagccaaacggtaaacgaggaagaggaagaggacgtcctgtcaccagagttgagaggttggtcgctcagtaagaacgtgaaatga

SEQ ID NO: 31722 - DNA, 636 bp, Glycine max
  Peptide Sequence Number=SeqID_123407
atgattcctgatataaatagatttccgaaattaaatggtgtggtgctcattggcggtagaagtcaacgtatggggagtccaaaagaaaagatccgttggcatggcaaggaacaacgcttttatttagctgacctgctacagaactactgcgaaagcgtatatatttcttgtcgtccggaacaggttaatgaggtaaccgccaacgaagagaatacgtccagctatgcatgcctttccgatcgttatgtggatattggccctatgggcggtatattgacggctctcgaatttcagccagagcgtgcttggcttgtcatggcttgtgatttacccatgctgggaccagaagcaatcaatcatttaattcaaaaacgcgatccacgaaagatagccacagcatttgcaagcccagggaacaattttcccgaaccattgtttgctatttgggaaccccatagtctgtctattcttcagcagatgtttgcacaaaataaattatctccacgtcatgttttggtacaacatcatgccctatgcatccaagcaccagatggacagacgcttacgaatgtaaatacgccgaccgaagccaccttggcaaaatcaatgattaccggcaaagctcaaggccgctga

SEQ ID NO: 31723 - DNA, 198 bp, Glycine max
  Peptide Sequence Number=SeqID_123408
atgggtgacgtagaagaggtgcaagaacagatgaaggccgatatggtgaccttgaaagatcaaatggcttccatgatggaagctgtaacgacccgcctcgtcactacgcgtcatcatgtcggctcggcggctcctcaccagaatcttgctccctgcaccctgccactgtcattctgctcccatggacaacgttcctga

SEQ ID NO: 31724 - DNA, 378 bp, Glycine max
  Peptide Sequence Number=SeqID_123409
atggctagtttatcgtattatcacgagggatcgggatctcccacagaaaatttagttcctctggacttggagattgaagctacgttgagaaggaaaagagccgagaggagaagaaaattacttcaagacaagataatagcgtccattcttgaggaagaaactcatttttctgattcttcatcatccgattcactatcatcaaaggaatcagtgacctatttaccaaaatccgtatccatggcagatgaacaccagcaaagagttacccttgaggactattcaagcagttcagtggcgcaattctttaccagcattgcctgttatgaagtggaagctcgcaacataaactaccctcattctttgattcatttcatatag

SEQ ID NO: 31725 - DNA, 621 bp, Glycine max
  Peptide Sequence Number=SeqID_123410
atgcagaggctctcgttcctcgtgcccactgacgaggttaccttagtggggcagacacttcacaccttccttgcttggccaacacatcttgtgaagtgtttatcagaacaaacagctgtgtctccagcaaaacctccagaaagcccggatgaagaggtcgatgattccctgtacctgatgacattgaccatcccacaactgtttttgaagcctctccaggttatgtgggatgctaccatattcagggtgtttaatcaaaacttcccgttgtatataaagcacaaagatttctctgaaattgcacacggtggtcaatgtctcagcatatctgttatacagttgtggattcttggacactggcaaatggccgtcattctgcctaaggaaaacctagttgtctggttttgttctttacataacaggccagacaactacctaaaaggaataattaacagtgctttgaaaggacttgatgatacaccacaacctaaatccaagactgctgctaggtggattgttgttaaatgtaatagacaaaaaggaatcactgaatgtggctactacgtgatgcattggatgtctacgataatcttaggatctttcaagaataattgggagacg

SEQ ID NO: 31726 - DNA, 699 bp, Glycine max
  Peptide Sequence Number=SeqID_123411
atggctccgaagaaactctccacgaagaggtctagaagagacgccgcagcggaagggtccaatgccacccccgagtttgatagtcatcgtttccagagcgctgagcaccagcagcgcttcgaggccatcaaaggatggtcattccacagagagaggcatgtccaactcagggaggatgagtatacggactttcaggaggagatagctcacagatgttggacgtcgctggtgactcccatggctaagtttgaccctgagacagtcctagagttctatgctaatacttggcccacagaggagggagtgcgagacatgcattcatgggtgaggggtcagtcgattccctttgatgcagatgccctcagccagttcctgggtgacccgctagttttggaggaaggccagcaatgtgagtttagccagaggaggaacagggccgacgggttcaatgaggaggccattgcccagctgttatgcacaccggggcaggatttcgcccgaaccgctgcagggaggcgggtgcagatcatgcgcactagcatgaccactttgacccagacgtggataacactgctgctcagcaatgtcttgcctagcgatcataactccgatctccctctgcctaagtaccagttgttgtatgccatcctgacgtgggccaggtatgccaccaaccaggcaccctctggacccagataa

SEQ ID NO: 31727 - DNA, 120 bp, Glycine max
  Peptide Sequence Number=SeqID_123412
atgaggtcctttaatggtgatttccaccatggagatgcagcggaagacaaaggagaagaggatgcttcaatggaggaaaagaaagagggagagaaagagatagggggagcaagaaattga

SEQ ID NO: 31728 - DNA, 369 bp, Glycine max
  Peptide Sequence Number=SeqID_123413
atgagtgctcttgcagacaaagatgttactcttaaaaaagtttccatagaacgttatggattaataaatacaaattactctatcaaggcaactgtgaaaaataatggaacacagagtgttaatagtgtgaaaattaactggaatgatggaacaacagaccatattgctaccctgtcactgccttctcccttagccactggacaggagaaaacgattacccatacaacagctataagctattcgactgcagtagacaaaacccttaacgtttctgtattgcaggttaatggatctccggataacaatccggatgacaacacgcttactactaaattcactactgtatcccaaaactcacctaaaaggtag

SEQ ID NO: 31729 - DNA, 291 bp, Glycine max
  Peptide Sequence Number=SeqID_123414
atggaggccatgaaagagcaaatgaccacaatgatggaagccatgatgagtatgagaaaaatgatggaggtcaacatggctacagtcgttgctgcaagtaccgccattgaggtggactcgactcacccatctggcctcaatcaaaggaagcattccttcccaccatatggcttgccttctaactatacaccacccaatgttgcacacactcccgatgagaatgtcgacaactccgcacccatactcattgagagccaacaacccctatcttatcatgcacatgcctcttaa

SEQ ID NO: 31730 - DNA, 423 bp, Glycine max
  Peptide Sequence Number=SeqID_123415
atgacgttgctatttagtaacattctgcccggcgaccataatgccaatctccccctgcagatgtatcggttgggatcgcgcccacaagacgcccagtgggccctaagaagtccaatagggccctggggtttccagctctggttacgggcctctgatcagtcctatagggtgcccgttcccccagtgaggaatcgcacccacaatgacacccagtggacccggagaagtccaacagggccctggggtttccagctctggttacgggcctctgtagtcctacagggtgcccgttccccccggcaaggtcacgtcatcatagggatcgtgcctgcaagacacccagtggacctgaagaagtccaacagggtcttggagttgtcaagctctaattacgggtctctgtcagttctacggagtacctga

SEQ ID NO: 31731 - DNA, 552 bp, Glycine max
  Peptide Sequence Number=SeqID_123416
atgggggtagacttcctcactagactcttcatcccttacttcatcttcacttccactagaggaagggcaagaagtagtctcctcttgactactataaatgtcttgacccctcatgatcatggttttctttgtggggcattgagaggcaatgtgacctctcccaagacatttgaagcatttaatgttgctagtcctttcttgggaactagccttaggggtgtatttctctatggtcatatcttttattatccaagggttttgaaggtgcagcccctaaaattccatgggcttggtccttccttggataagactttggagcttgtccataagctccctttcatagtaggagggaatgtgcctcttcctaagggcactcttaagatcattccaatactctactggaggatccccttgaatccttcgttccctaacaagggaagtccaccaatagagggcatacccttgaaagctaagggtagccaatggaacttttctctcttcgctaatatgatggcaagcaaagagttgttcaaccttcatttcctaatctaa

SEQ ID NO: 31732 - DNA, 889 bp, Glycine max
  Peptide Sequence Number=SeqID_123417
atgtcctcaccaccagaggctgcacgcctcacctcgaggactataagtcctcgccttgagagggctacacgccctcacttgggtactagttacctttcaccttcagaggactacacgtcctcgccttcaaagggtcatggctacacgccctcaccttcagaggactacacgtcctcacctttagaggactacacgtcctcgccatcagaggactacatgttccccattttcaaaggggggcatgccctcacctttagaggattgcacgtccttgccatcataggactacactccctcgccttcgaaaggcgacacgtcttgaacttcagagggctacacgccctcgcctttagaggactatgcgtcctcactttcagggccagtagtttccttttaacggttcctgggccaccccctgatattggaggagggccaactgtgcgagcacaaccagagagggaggctatcacacagctactatgcatactggggcaagatttcacccgtgcctgcaaagagacaaggatcgcacccacaagacacccagtggacccgaaaaagtccaacagggccctggggtttccagctctggttacgggcctctatcagtcctacagggtgcccgtaccccctcggcaagggatcgcgcctgcaagacactcagtggacccgaagaagtctaacagggtcttggagttgtcaagctctaattacgggtctctgtcagttcaagggaggcgaaacaccacaacagcattgggatggccggtagcgggcaatagacacaccgccaccacctctagagttaacctcagctcatccgcaaaaagcttagagcgttgcctacgacacatggccgaccagcaggcgaccaaatccaaagccaaag

SEQ ID NO: 31733 - DNA, 153 bp, Glycine max
  Peptide Sequence Number=SeqID_123418
atgactaaagcacgtcaaaagggggtacgaaaaggaaaggaaggagatgcttgccacccagctcgcccaggtgagctaggttgcttcctccagaagcaaccgccttctggaggaacatcctggaaggcccaagtgggcctggttgctatttga

SEQ ID NO: 31734 - DNA, 689 bp, Glycine max
  Peptide Sequence Number=SeqID_123419
gatcccccgaattgccggaggtactggtggaatacccgctcggccacgcccgacgccgcgaggaaggcattccgctgctgatggacaagttccgccggcacctggcccatcgcttcccgaccgtgcagcagcagcgcatcctggccgcatcgctggacccggtggcgctggcggcgatgccggtaaccgactacgtggacctgtacctgccggggtgaggccgctctggagtgacgacatgagcggtccggcacggcggaagcggtggggatgggcggcggcggtactggcaggaggcctgttgctgggtctggccggctgccgcaacgacagcgggcagctgcccaaggccagcggtgaagccatcaccaccaaggccgagcaggtgaaggagttcaccctgctgcgtgcctacccggaccagaagaatgacggcttgtcgctggcgctggagttctcgcgcccgctcgtcggcacccaggatttcgacaaactggtgcgcttcgaggaaaagcctggtggtttcgccggacctgctggccgccgatggcagccgcctgggcaaggaactgaagcagaaggtgttcagcggcgagctgaagccggtggtcggcttcgcctcgcagggcagcgtgctgccggccaaggacagccgtggcctgccggtggtgtcggtgaacgtgccggag

SEQ ID NO: 31735 - DNA, 363 bp, Glycine max
  Peptide Sequence Number=SeqID_123420
atgaatgccgcaaaagacgacattagtctctacgtgctatctggcttttcatcttacagacaacaaaaagtttatacggataactactcgggtattttcgcccgtcagcgtgactcaaaagtcagtatgacagattttgtgagcgcggaagataagcaaaaagtttatatgaataaccactcacgtatttccgcccgtcagcgtgactcaaaaggggcagaatacgacgttagtctctgcgtgctattaggcttttcatcttacagaatgcaaaaagtttatacggataaccactcgggtatttccgcccgtcagcgtgactcaaaagtcagtatgacagatcttgtgagcacggaagatgac

SEQ ID NO: 31736 - DNA, 65 bp, Glycine max
  Peptide Sequence Number=SeqID_123421
catttaacgatcctagaccattggagccagagagattaaaggtgatgcagatccagtgggcatag

SEQ ID NO: 31737 - DNA, 402 bp, Glycine max
  Peptide Sequence Number=SeqID_123422
atgaccatgattacgaattcgagctcggtacctagcattcatctggcaccgggcctcacctggagcgtaaaagcgacgcgcttcctgtgcgacgccggcgtgaccaactcggtgccggacgaggcgcgcgtggtgtgggatctgcgttcgcaggagaacgcgccgatggaactgctcaaagagaaagtcagtcaggcgattcagcacagcgtggccgcgctgggcgcaaccgctgaagtggtggtgcagaaagagatgccggcggcggaaattgatgccgatgccaccgcgctgctgagcgccgcgattgtcgatgtgctcggcgagcagggattactggcggcgaaaaccacgccgggcagcgaggatttcttctactatccggtgaaggggatcctctag

SEQ ID NO: 31738 - DNA, 201 bp, Glycine max
  Peptide Sequence Number=SeqID_123423
atggcttttattccaagaggatacaacaaaatgaagccttgtaaggtttcctaccaaaacataaagcagaaaatgaagttcagcaatcaagaattgcctgtacttacaaatgagtttcactaccctggtagagaagctgttaatgacaaattcaatcgtctcattgataaatatttggaatattccaaaaaatacaaataa

SEQ ID NO: 31739 - DNA, 381 bp, Glycine max
  Peptide Sequence Number=SeqID_123424
agggctacacgccctcgccatcagaggactgcatgtcctcaccttcgtagggctacagcgccctcacctttagaggactacactgtcctcgccttacagagggctgcaccgcctcaccttcagaggactacacggctacacgccctcaccttagaaaggactacacgtcctcgccagcagagggctgcacgccctcacctccagaggactacacctcctcgccttgagaggactacacgtcctcgccatcagagggctgcacgcccttaccttcagaggactacacgtccttgccttgagagggctgcacgccctcaccttcagaggactacacgtcctcgcctgagagggctacacgcccgcacctggggtactagttag

SEQ ID NO: 31740 - DNA, 207 bp, Glycine max
  Peptide Sequence Number=SeqID_123425
atgacgttagtctctgtgtgctatcatgctttgagtcttagagatagcaaaagaaagctttttacggataaccactcgggtatctccgccatgtcacgtgactccagtgtcatgtatgacaagaatttgtttgcgcaggaagatgacgtaaatctccgcgtgtcaacgggcttgttggccgcgattgacaaagggtgcagaagatga

SEQ ID NO: 31741 - DNA, 304 bp, Glycine max
  Peptide Sequence Number=SeqID_123426
gtccccagtggagtcgccaactgttgcaacgtgcccaattgcaagcgagcgagggcgaggctcacgggtgcgctttccaaaggaggaaagatgcgcggagtcgccaccaacgtttatttgtggaaaacgtcgaaaaaaccaaaggaaaccggtcaaaatgaaaattctaagttcaggagttgtatttacgcttgaggaaggtattagcatctctcacgtcgacaaaagcggggcttttgctcctacgtaccctccatcaaagaggaaatcagacctacgtagttctttcttatgcgtgaatcaa

SEQ ID NO: 31742 - DNA, 698 bp, Glycine max
  Peptide Sequence Number=SeqID_123427
gtagaggcgaatgggccccgttcatagacatcctcgcactgttgatcttcggaggagtcctctttccaaatgtagatgggttggtggacctagcagcgatcgacacttttcttgcctatcatgaccgcaaggaaagcccgattgtcactatactagccgatctatatgacaccttcaaccgaagatgtgagaagagcagtacaaggattgtttgctgtactccggccctctctgtatggttgacttcgcacctttttcgccaagaggtaaggcatccttgcccgctagaaagccactattcgtgcatagagaaaagaggggcaaattgggaccaactcttagcaagcaaagaaggagcatttgtcaattggttccctcgttggaaagaagggagaactggggttcttatttcgtgcggaggatttccgaatgttcccttgatggggacaaagggttgcatcagttacaatctcgttcttgctataaggcaacttggctaccctatgagaggggcaccactagaggaagagctcacacctattattgcccgaggtttcaataagaccaacgtggaggcacttcagaaagtccgcaaggcatgggaaataatgcaaaggaaagacaaagaactcagaggcaataacaacgggcccatcagtggctaccgtaagttgttgaaagccacagggatcctctag

SEQ ID NO: 31743 - DNA, 369 bp, Glycine max
  Peptide Sequence Number=SeqID_123428
atgtcgttaagcgatatacacttgaaatctggggcaattgaggaaaccgctgcattttgtgataacctgagccctttcgctcagttcatgggtgacccgctagtgttagaggagggccaggagtgcgagtttagtcagagaaggaaccgggccgatggatttgacgaggaggccattgcccagctgttatgcataccgggtcaggattttgcccggaccgctaccgggaggcgggtgcagatcatgcgcaccagtatgccacctaccaggcaccctctagacccagataagtctaacagggccctggggtttccagcgttgatcacgggtctctgcagttgtcttcagtcaggctcagcgcacgactga

SEQ ID NO: 31744 - DNA, 96 bp, Glycine max
  Peptide Sequence Number=SeqID_123429
gtcgactctagaggatccccgacgttagtctttgcgttctatctggcgttgagtcttacagatagcaaaagaatgtttatacggataaccactggg

SEQ ID NO: 31745 - DNA, 704 bp, Glycine max
  Peptide Sequence Number=SeqID_123430
atgcaagtacaaccagaggaggaggctatcgtgcaactactatgcataccggggcaagatttcacccgtgctgctgcaaagagacgagtgcggatcatgtgcaccaatatgaccactcttacacagatatggatgacattgctacttaggaacattccgcccagcgaccgcaataccgatctccccctgcggaagtatcagttgggatcgtgcccacaaggcacccagtggacccggaggagtctgacagggccttggggttttcagctctggttacgggcctctaccagtcctattgggtgcccatccccccagcaaggatcatgcccacaaggcacccagtggacccggaggagtccgacagggccctggggttttcagctctggttacgggcctctgccaatcctatagggtgctcgtgcccccagcaagggatcgcgcccgcaagacacccaatggacccggagaagtccaacagggtcctggggtatccagctatgattacgagcctctgtcagttttacagagtgtctgtcacccccaacaaggtcattaggccccacattaaccgggctttcatcaagaagtattgcgcccccaggcaggtagagggcgagacaccacaacagcctggggatggccagcaacaggcaaaaaatgcaccgacgccacctctagagcccctcagctcatccacagaaag

SEQ ID NO: 31746 - DNA, 638 bp, Glycine max
  Peptide Sequence Number=SeqID_123431
atgttccaacatcctccaccccaaatgtttctgtccctgatgctgatacagatgttccaacatcctccaccccaaatgtttctgtccctgatgctgataaagatgttccaacatcctccaccccaaatgctgaagtcctctcttcacccagtgaagaggaatcaatagaggaacaggatcaagccacagaggagacccctgcaccaagggcaccagaacctgcgccaggtgacctcattgacctagaagaagtagaatctgatgaggaacccattgccaacaagttggcacctggaattgcagaaagactacaaagcagaaagggaaaaacccccattactaggtctggacgaatcaaaactatggcacagaagaagagcacaccaatcactcctaccacatccagatggagcaaagttgcaatcccttccaagaagaggaaagaaatttcctcatccgattctgatgatgatgtcgaactagatgttcccgacatcaagagggccaagaaatcagggaaaaaggattgctttagaaagagaactgggaagaaatgccttggattgcaaggagaccatggacctcatcaaggctgctggactgatgaaaactgtcaccaagttgggagattgctatga

SEQ ID NO: 31747 - DNA, 681 bp, Glycine max
  Peptide Sequence Number=SeqID_123432
atgtcggtttacagcatctttcacccgttagtcgcatccagtgcggcgcatagtttaaaatgcctgtcatctttacgctatcacttctgcaaaaaaatgatgacaccgctggttttagcctcaacctctccgtttcgtcaggcgctgctgcgcaagctcggcctgccgtttatcactgccgcccctgaaagcgatgaaacgccgctgccgggagaagccgcgccgcagctggtgcaacgtctggccattgccaaagcgcaggcgctggccgtgcgctatcctgcgcactggatcattgggtccgatcaggtctgtgtactggacggtcgcatcgccggcaagccgcataccgcagagaacgcctgtcagcagctggcgctggcgagcggtaaagccatcaccttttataccggtctggcgctgattcaccccgccagcgcgcagcagcatgtactgtgtgaaccctttaccgtgcattttcggcaactgagcgcggcagagatcgcgcgctacgtcgaactggagcagccgctgcagtgcgccggcagtttcaaaagtgagggactggggatttgtctgttcgaacggctggaggggcgcgatcccaatagcctgattggcttaccgctgatcgcgctgaatggcctgttaaggcaggcgggcatcaatccgctgggctga

SEQ ID NO: 31748 - DNA, 210 bp, Glycine max
  Peptide Sequence Number=SeqID_123433
atggaggttgaggaaccttggttggggttatggctaccattgaattatcgagtggatatgggatcaagtttagcatatgacaacggaatttggggctttgtggttgatttaaggatggcctttgaggataaatgggtggtgggtaaggaggaggtttgttattggctgagtaatgacattgttgggttggtgggaaacttggctgtatag

SEQ ID NO: 31749 - DNA, 390 bp, Glycine max
  Peptide Sequence Number=SeqID_123434
ggactctgccagtcgtttggagtccccgttgcacctaccaaggtaattcggccgcccatcacccgggcttttattgagaagtactgcacccagagacaggctcagggggatgctccaccggccacgggcgcgccaccaccacctcatcaagctggccaggctaggtcatttgacatggagcagtatttgcggcatttgagccagggcttcgcttctttttcatgccctactccagaccagttcagggcagaggtcgcatggcccggggattggcccgaggcccaagcaggagaggcgcccccggaagttcccggcgatggagaggaggcccacgaggacgaggagatggccgatttgcttgacttcttggtagggagtggagctacatga

SEQ ID NO: 31750 - DNA, 1419 bp, Glycine max
  Peptide Sequence Number=SeqID_123435
atggataaggaaacccttaggaaaaatttctattctccggagaatgaacctcaaaggagatggtttttccaacagtacaagggtacaaacagaaaacaaatccaagacaagttctacgaatttgtcgaaagagtcaaaattaatgtccttttctttgattggtttcatgcttatgccatcagaaaggatatagactacccttggaaacaagacatcataggtaatccaacaacaaatgtcataacaaattggcaagtgaaggatggtgagttaatccagtcggaattacctcccactacacaatatcaactaccaaatatcaaagacagtaacaacaaacctgtcatggcaattccattcaagacaaaagatgtcaacgaggaagtaacctctagagacattaaaagcctaatggaacaggcaaattataccaacaaatacttacaagctttaggagaaaccattaaaactaaggtagttcctaaacaaaaatcaattgaggaagcttcgccgagtgtccccattgaaaaacctttattcaaacctttcaaagttagtgataaggctaaacgaaaaattagggaacttagaaaaactaaatccttaattgaaggcgtaggtgacaatcatagcgaattactaaacaagattagtagtttgcttaaggtcattccagatactccccaagcttcggaaaatacttccaaaatggtaacaagaagtacctccaaattaattaatgttattaatgaagatagtgaccaaaacttagataacacaactgagataggatcagtgtcagaaaagaatataaatccattaaactccaaacactggaaaaccccctccaaattatattatcaacgtccaactgcccctgaccttctattagaagaaagaggtgaaaacaattttaaaatttttagtgcaaataacatctatgaatggaacatagatgcacaaacggagtataacatcatgaatacactccaacatatgaccatggtagccacggcttaccaaacctcccatgaatgttcggaagaaaccattatagatatcttagtggcaggattttccggacaactaaaaggatggtgggataattatctcactaatgaagagaaatcaaaaatttacagcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaaggttattggctatcttctttggtgtaa

SEQ ID NO: 31751 - DNA, 652 bp, Glycine max
  Peptide Sequence Number=SeqID_123436
gattgacagactgagagctctttctgattctatgggtggtggtgcatggccgttcttagttggtggagcgatttgtctgatcattgcaattgttggtcttcaacgaggaattcctagtaagcgcgagtcatcagctcgcgttgactacgtccctgccctttgtacacaccgcccgtcgctcctaccgattgaatggtccggtgaagtgtatacggattgccgggacgttgagcggttcgctgcccgcgacgttgtgagagagtccaatctgaaatcccttatcatttacgaggaattggagaagtcggattgggtcgatgacccggccgcctccgtgtcgcaccggcctcggctcgtcctcggaaaacacaaaccccggcgcttcgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 31752 - DNA, 266 bp, Glycine max
  Peptide Sequence Number=SeqID_123437
gggactggaacattgtggaggcctctggtaatcgattaccagcctgtgtaatcgattacacagagggatgggccactggtaatcgattaccagagatggagtgtctagagggagcttgggagaccctcgaaggcaacacggggtgccgagttcggggcaccattcgattcatggctacttctttggtgcatccagatgaacctgcacggacgcttcagcgcacggtggagtggacagctccttggatgagttttgtatattgttga

SEQ ID NO: 31753 - DNA, 498 bp, Glycine max
  Peptide Sequence Number=SeqID_123438
actttttcaagtctcaacaagttatccagaactacgtaggtctgagttcctcattggtcatctgcaccctgatacgtaggagcaacgagccatcgcttttgtcatccacgccggcttttgtcgccgatgacatcagagcaagtttggtcattctgcacctgatacccgcggagataccttatgagaccaagtttggtcattctgcacccatgatacgcggagataccttatggttattcgcacccttttgtcatccagaggcggcgggcccgatgacaagcagagaccaagtttggtcattctgcacccttgtatcatccagaggcggcgggcccgatgatacgcggagataccttacggttatccgcacccttttatcacccttttgtcatccagaggcggcgggcccgatgacaagcagagaccaagtttggtcattctgcacccttgtatcatccagaggcggcgggcccgatgatacgcggaaatacccgagtg

SEQ ID NO: 31754 - DNA, 584 bp, Glycine max
  Peptide Sequence Number=SeqID_123439
tgcccactttttaccaccaacaatgggcaccagaataccctgagtttgtcaactttagatatgatggaacaatataccaaatcaggctaaagcaggatcggacaaaagtctactttgcggaagggctgaaagaattcagaaaagatttatcaatttacgaatctgtgatcattaaattcttggcatgcaacgaaaaatccatgtttgatctttatttcgttccctcactggaatgccagacttgcggaaggccagaagttatgtcaagacaacatatttggacacttgaaatcgcacaatcaattcttggtgcaccaggaccactgagacttcccaattgtgccattacacatgtaaatgcctgcggtcaacacatgaccattctcaggagatttggaccaccattacagtggaatgttgtggtggttgatggtggagttaggcgcagatatgttgtccaaccatggtatcaattcattgcagataatgatttctcccacggtgatgaagtctccttctattacaggaccattgataaaatatgggaaattgtcatccgccaaagaaagaattgggagtattag

SEQ ID NO: 31755 - DNA, 454 bp, Glycine max
  Peptide Sequence Number=SeqID_123440
atggtgtctcctcaagggaggaatacgtggacagttgatgatctcgtgccatatgtagagaaaataacgattctatcagaagagcaagagagaatcactgagtctgtgtcacatggtctagcaacggagcatcaatttccagcacaacagtttcacgttctccactcaagtgttgaaactcaaggcataggcagacgaagggatgcttttgaagcggaaaaatattccccacaaatggcggagcgtggccatgaaatgtattacacgccaccaacattttctcagtatccgacacagatgtatcaatatcctttcaaaggtcagcacactgacacttctgcaagcaaacactcgttcggtggtgttgcggaaacacatcctaatttttcgtggcctactatgaccccttcacagcaacatgatgtctcaattccaacacctaatgccccattag

SEQ ID NO: 31756 - DNA, 423 bp, Glycine max
  Peptide Sequence Number=SeqID_123441
cagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttatccgcacccttttgtcatccagaggcgccgggcccgatgacaagcagagaccaa

SEQ ID NO: 31757 - DNA, 519 bp, Glycine max
  Peptide Sequence Number=SeqID_123442
atgccgatctccccctacggaagtatcagttgggatcacgcccacgagacacctagtggacccagagaagtccaacagggccttggggtttccagctctggttacgggtctctatccatcctgctgggtgcccgtcccccccagcaaggggtagcgcccataagacacccagtggacccgaaggagcccaacagggccctggggtttccagctctggttacaggcctctgtcagtcctacagggcacccgtccccccagcaagttcatgccatcgtgacatagggatcatgcccgcaagactctcagtggacccggagaagtccaacagggtcctggggtttccagctctgattatgggcctctgtcagttctacggagtgcctgtcacccctagcaaggtcatcaagccccctactaaccgagctttcatcaagaaatactgtgcccctaggcaggcgcagggcgagacaccacagcagcctggggatggccggcaacaggcaacggggatcctctag

SEQ ID NO: 31758 - DNA, 107 bp, Glycine max
  Peptide Sequence Number=SeqID_123443
gtgttgaggaaaaaatccatgattttcaaaaacctctcgatttgaggtcacatccttttcaagggggagggaatgatgcaatcctaacccccaagggcattggatag

SEQ ID NO: 31759 - DNA, 327 bp, Glycine max
  Peptide Sequence Number=SeqID_123444
atggctatactcatggatgataaagacttccgctcgagggggagactaccatgtggaagagactcacacttgaaggggagatgtgttgggttacaagtgtctccttatgtggtggctcgtggtccacaggtgtacccctcgaatctccccaacaattggtatcagagccgatggttcaagttgatgaccggctcagacgagtgtagcggggtggccagaatggctagtgggcagggcaactaccgcaggtggccatggctatactcgtggatgataaagacttccgctcgagggggagactaccatgtggaagagactcacacttga

SEQ ID NO: 31760 - DNA, 279 bp, Glycine max
  Peptide Sequence Number=SeqID_123445
cattcatctgagtggctgagtggtggagagaacttctggtgtgaagatcctgagggacaacacagattaaagaggaagttatcatgcgtagtattggatgagagtttgagtgattgtgagttatggagagctaaatcctcagttggttcttcctatggggtacttgatggattgaggtacggtaacctagttgttggtatgtatgtcttaatgcagttctggtcaagtttagtccaacaagaggaatttgaagatgacacttggctaggattaggctaa

SEQ ID NO: 31761 - DNA, 328 bp, Glycine max
  Peptide Sequence Number=SeqID_123446
agtttccacttctgacccgtttcggtctggtcagtcccaaggtgatcttgttgggtgtctgtttctgatcaagctgaactttctttgttggaagggagtgagaacctctttgatgctgaggttgcggctcatcgagaactgttgcggggagaccatagctgaggctgggcttgatcctaaacctctaactatcctaggttctaggttaggtggaagtgaaaagactaagggagatgcagattacagcattgctgattcagaggagattactgatattgtggggacaaatttaattttcatgacaggccctgttattgatctccttctg

SEQ ID NO: 31762 - DNA, 362 bp, Glycine max
  Peptide Sequence Number=SeqID_123447
gaatcgcacccataagacacccagtgggcccgaagaagtccaacagggccctggggtttctagctctggttacgggcctctgtagtcctacagggtgcccgttccccccggcaaggtcacgtcatcatagggatcgcgcctgcaagacacccagtggacccgaagaagtccaacagggagtacctgtcacctccagcaagggcatcaggccccctactaatcgagctttcatcaagaagtactgcatctccagggaggcacagggtgaaacaccacagcagcctggggatggccagcagcgggctacagacgcaccgccatcacctctagagttcacctcagctcatcaacaaaaaggttag

SEQ ID NO: 31763 - DNA, 327 bp, Glycine max
  Peptide Sequence Number=SeqID_123448
atggacttggtatcgtatgccttttatgcaccaagagtccgacaacctaaaacaacttatccactagctaaaagtttatttagtgtcgcaacgtgccctttcgcgggcgagcgaaggcgaggctcacgggtgcgttttccaaaggaggaaagatgcgtggagttgccaccaacatttatttgtggaaaacgtcggaaaaaccgaaggaaaccggtcaaaatgaaaattctaagttcgggagttgtatttacgtttgaggaaggtcgacaaaagcggggcttttgctcctacgtaccctccatcgaagaggaaatcagacctacgtag

SEQ ID NO: 31764 - DNA, 153 bp, Glycine max
  Peptide Sequence Number=SeqID_123449
atgatggcacatcactcaagctcttatccatggcctcctatggtgccattcaacttcaagaagcaaaggactccattgatgaagaagatccaaggtctacaaactccacatggagctacatcatgtggtatcagagcaccttcatctaggtga

SEQ ID NO: 31765 - DNA, 258 bp, Glycine max
  Peptide Sequence Number=SeqID_123450
atgaaaagagaaaaacatgactcctatagtagtcatgactcttgcaagagtttaagtgaagaacttagcgactattatagagggcgccatagttcacatactaaacatcactcccaaagaagggaaagggatagaaggcctcaagaggttaacattaagtcagtagcaagggcaacctcccttaagggagatattggactaagcaacaggcttaaacaaggattgagtgaatcaccagagagaacaaccccaaattga

SEQ ID NO: 31766 - DNA, 258 bp, Glycine max
  Peptide Sequence Number=SeqID_123451
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggctttggcgcttgacacaaggtcactattatacagagaaagagaatagggaccacaaatgctttacgtggcatatcttcaacgaagtacagttagccaatgtcgcctag

SEQ ID NO: 31767 - DNA, 201 bp, Glycine max
  Peptide Sequence Number=SeqID_123452
atgaatttaagaggaagacaagtggacatagctgatccattgtgcccgttctggaacaatttggatgaagatgcagcgcaccttttcttcaactgcagcaaggtacttcccttgtggtgggagacagtctcatgggtcaaatcagtgggtgctttcccaaaagaccacttcatgcatcatagcagatcgaatgcaacatga

SEQ ID NO: 31768 - DNA, 363 bp, Glycine max
  Peptide Sequence Number=SeqID_123453
atgggttctccacctgcctcccctcctcctcctcttcctctttctcctccttgtcctcctcctcttcctctttctcctccttgtcctcctcctcctcctgctccttcggacgcatcgacttcgccgtctgccgtgaagcggacacgcaaagcctcacgtctacgatcgttgtctactagaccacctggtgctgagagactagtggtccatgttgatccagctaccggcaaggccgacggtccccacaagaagaaattaagaacatatttggggattgtggcacgtgataaggtggacgtcacctacgagaactggaaggaggtccctactgctcagaaggacttgatttgggaggatattcag

SEQ ID NO: 31769 - DNA, 507 bp, Glycine max
  Peptide Sequence Number=SeqID_123454
atggaaatctcttccttccatcaatttctcgatgaatccctcagcgaggcactcgaccgcttccgcggactgctaagaaaaacacctacacatggatacagtgagtcagtccaactcaacattttcatagatggtttgagacctcaatcaaagcagcttctagatgcatccgcaggagaagccctgacagagaccctcaacaagcttccacagcaactacaagcggtagggagatgtcacatatgtggaggaacacataagtcaggcttatgcatggtccaagacgacgcatccaatgaagttaactacatgggtagtcataatcatcaaggattccatcaaagaggaccaccaagattctatcagaacgataattttttacaggaccacgattggagatattatccaagtaataacctcaaccaagggggttcaccctatcagcatcctagccaggggccgagtcatcaagagaagcccactaatatagaagaaatgccaccttga

SEQ ID NO: 31770 - DNA, 147 bp, Glycine max
  Peptide Sequence Number=SeqID_123455
atggtcagaagtcgagacaagttgacgacaaaaatcaaccaaggacagatgcaaatggaggatagggtcacgatcgacagatcgtcgtcccttcccgacgctggacaagcagaaaacgtcgttgcaaggcaacccagtatcctttga

SEQ ID NO: 31771 - DNA, 654 bp, Glycine max
  Peptide Sequence Number=SeqID_123456
atgggtgaccaagacgagacacaggaacagataaaagttgacatgttggctttggaagagcaaatggcttccatgatggaggccatgttaggaatgagacaactcatggagaataacgtggccaccgctgccactgttagttcgactgccgaagcagacccaactctcctagctaccgcacaccatcctctcccaaacgcagtaggacaagaaaggagcacactagggcacaccagcaacccccatttgggatacaaccaagtggcttacccttatggattaccacctaattacacgcgaccagtcatgcgtgatgacgcgggtcatgtcctttcccccgtccttgaaggggagcctcctcaacagtcagacgaggttcatgaggatcatagagagtatgcccaaggagacgtcgatttctacccctcggtccccgtcgagggtctgacacccaacatactacctcagcccaacctcccagcacaaccaatattattgtccacaaaaggaccacccccggcggtggaagaaagaaggaaactcgatctcatcgaagagagattgagagctgttgaaggatttggcgactatccattcgcagacatggcggatctttgcatggtactggacgtcgtcatccccccaaaattcaag

SEQ ID NO: 31772 - DNA, 533 bp, Glycine max
  Peptide Sequence Number=SeqID_123457
ttagcgattttatcccaagagcaagagaggatcactgagcctgtggcacatggtccagcatcagagcgtcgatttcccccacaagagtttcacatgcttcagtcaagtgttgaaactcgaggttttgacagacgaagggagattgttcaagcggaagatttttcccaacatatggagcagcgtggtcatggaatgtattacacgccaccaacatttgctcagtatccttcgcagatgtatcagtatcctttcgagggccatgacactgatatgtctgcaagcgaacattcgtttggtggtgttgccgaaacacagcctcatttttcatggccgaccatgaccccttcgcagcaacatgatgccccaatggcaacacctaatgccccattaggtcagcaatgggatgtacctggagcaatccctcctatgggtgatttattaggtgttgatttgcgtcacgagttttctgcagaggctgaggaacaagggcggagacagcgcgcaagaagaaatccggatcgtcaagcccgaag

SEQ ID NO: 31773 - DNA, 432 bp, Glycine max
  Peptide Sequence Number=SeqID_123458
atgcctttgaatatgaataagcctaggctaagcaagtctatctcgctcagcccaatgcagtttagttttgcgcgcgctaagcgagtctacctcgctaagcgcccggagaggtacgagcagaacatccactctaggaacatcctccctgagatgaatgtggatctctatgtcacccagtacgacgagtttcgaaaggagctcgagaggaggtggtggcacaaggccttgaccaggcagcttgataaccacattgatgtggcccaggtcaaggagttttatgcaaacttattgtcacaaccaacccttcgacgggagggcaacgcgagggctcatgggtgcgtcttccatgggagaaaaatgtgcggagtcgccaccaacgtttatttgaggaaaacgtcggaaaaaccggaacatgtggtctacgaacttcaa

SEQ ID NO: 31774 - DNA, 465 bp, Glycine max
  Peptide Sequence Number=SeqID_123459
atgccggaacataataccccccaagccaccctcgaccgccgggaggaggccgtacaacgtctcacccaagctcaggcaaccttatcccagaaccacgccaacctcgcccaaacacaaacctccatgaccaccaaactcgactctgtcctcaaacacctcgccaccttgaccatcccatcacccatccctctgccacccccgcacaccatctctcctccgcctccctcacctaagccgcacatgaaacttgacgttcctcatttcgatgggcaagacccggattatactcggagctccggcgagaggttcaggcgcttcagcctatgtcgttgccgcaagttgtggctcttgcaaagcttcaagaggaaaaactcaaagatcgtcgttggccatctcgaccaccacctgtgcactcgcccgtgcatccatcaccggtttctcctcccggcactggctcttccctga

SEQ ID NO: 31775 - DNA, 723 bp, Glycine max
  Peptide Sequence Number=SeqID_123460
atgtgtaaactgatttgggtctgggttgggttagaagcatctggtggttcggttagtgggtctatgttagggtcagactctagaaaaccctcatcatcatcggttaactcctcatgggataagcgtttaatggatactgaaggggttggtttcgaaggggtgggcacaaagggtgagggtggtgacagaaggggcgttgagtgtctaggaacttttattcctgaagttaggccagaccagtttcttgcaccaacgttaatggatgaagagcctgtacctcacgacaaatttctgcgtaccaatgggatcttcgtactgagaaggggtgaagcaagtttgaggggcctgaaggaaaccaggccaagaggtgagttgcccattgctggtcatccattggaaccaagcaagggcacgaccatccatataaaaagacgcaatggtgagacactcatgtttaggggtggtatggtactcaaaaaattggttgatcttgaagatccagtcgagaggatagggacacaggagagggaatggcagaggaagaagaggggaaatttggtgtgtagtgagcttggtaatggattcctcaagcctgtcggaattggctttggacctagtggattcatccatggaaacaggacaacgagagcaccaaatttgttaagagtagagaagatagagctggcttcgagggccaatgacctccttgaggaaaaagaatag

SEQ ID NO: 31776 - DNA, 870 bp, Glycine max
  Peptide Sequence Number=SeqID_123461
atggaaactggaaacaacaaaccggaaaaaggctcccttctggtctccttcaacttggcatcagagcaggttgccgccgtccgccgccgcgccgcccgccgccgccaactccggcggttttctccggcgagaccagggttcggatcgcctcgaaaagcgcgatccacccctggaactcgcgccgccgtaggccgccgcacgcgcccacacgcgcctcctttcctccgcgcgatttccggcgcgtgctgctcacgcgccgccgtaccggcgtcgggagctgtcccttccggtcccggcagcctcgccgtcacctcctggacctgtttcaggcttcaaatcccgcttccggcaagtcgtttgttgtggttccttggtcaaggacaccatgaccacttggagaaaacttccgattttgtttcagatgataaaagagctgaatgggagaagcttgactatcaattatgtgtcgtgttatggcaatcagttgagccggatatcttggagattctccgatcttttaaatcatgccgttctttttggaagaaagcccaggaaatctttgccaatgatatccaaagcttgtttgatgcaactatgaaagttacagccctcaagcaaaccggtcatgacatgatcgctcatgtgggtaaggctcgggctgccgtggaagaactaagaaagttccttgtagctgattcattggaggaagtgaataggaaacttgacaagttctacatggttcttattttgaggagcttacattcagacttcgatcatgtgcgtgatcaaagtgcttgctggggaccaaattccatcactggattctctcatcaccagacttctccgtgtgcctcatttattgacggatga

SEQ ID NO: 31777 - DNA, 1818 bp, Glycine max
  Peptide Sequence Number=SeqID_123462
atgaagaaggtaccaaatgcatttgtaatacatggtgtaagcggtagaggaatgtttcgaacggagtcaaagatggaagttggagaagtcgttgttgtgcctggaagtagtggagacttggtggaaggtggtgaactaattgtgtacgctcttcaatttttcaggttcttggggttgataaaaatgcaagtcagcgggaaattcagaaggcttttcacaagtatgtatgcttggctatctcttcagtatcaccctgacaagaacaaatccaagggtgcacaagagaagttttctcagatcaataatgcatatgagattttatccgatgaagagaagagaaagaattatgacatgtatggagatgagaaaggaaacccaggatttcaaggtggccatcctggaggtcagggtggatatacttttacagggggtggtcctggacaaagccattttaacttcaaaccagggggtgactggcaaggtatgggcggtcagggaggatctaagtcattctccttttcctttggtcgtggctcaggtgattccaatccttttggatttggcttggatgatctttttggcagttttttcggtggtggaggtggtgggagtcagtttggtggttttggcagttcagccaagtctcaatctgggtccaagagttcttccaaaagtcttagagctgtaaattcacagatttacaagaaagaaatagagaatgcagggatgacttggcttttgttatcttatatgccctcatcgatggagatccaatactttgaatccactatagaggaggttgcaagttcgttgcagggagctttgaaggttggaagcataaactgtgaaaaggaagtctcattctgtaaggagcttagcatatatccacgcagagctccaaggcttattgttttttcttacaaggagaatgaaaaaggttatttggtggagtataggggaaacttggctgctaagaatttgaaggctttctgtcaagaatatttgccaaggttttcaaaacgaactgacttgaatcatcttgatcaattcagcactactggaaagttgcctagggtgctgcttctctccaccaagaaggacactcctgtaatttggcgtgtccttagtggcttgtatcacaaacgcattactttcattgatgcagaggttcatgatgtttctgatccaagagtaaaaacgctaggagttgatgcacttccagctattgtaggttggctaccaaatggagaaaagcgtgttctaaaaactgggatatctgtgaaagatttaaaatctgcagttcttgatcttagtaacatacttgatagttttgaaaaagtaagtaaaaaggaatcatcaggtcaggccaaggaggcacaaactgactcagacgagggacgcgtaccattactttctaaatcaaacatcgaggctctatgtggtgagaaaactccagtctgcataattggtgccttcagttcttctaaagctagagaaaagcttgaatcaatcctctctttggtttctcaaaaatctttgtcaagacaaccaaatcagggatccagcagctctagggactccatttcctatgctctcttagatgctgcaaagcaaaaatcatttctaaaggcatttgacaaaacaggttataaatcatcaaataatttgttgattgcctacaaacctcgaagagggaagtatagtatatttatgggtgaaatgacaatagaggagatagagaatttcattagctccgttctcagtggagatgtacccttcagagaagcaacacgggggaagcctgtactagagtattag

SEQ ID NO: 31778 - DNA, 111 bp, Glycine max
  Peptide Sequence Number=SeqID_123463
atgacaaggaccaagggcaaagaacctttagaaggacttggaggacctatgccaagggctagaacgaagaaggccaaggaagctcttcaacaagtgttaaccatggtataa

SEQ ID NO: 31779 - DNA, 222 bp, Glycine max
  Peptide Sequence Number=SeqID_123464
atggaagccccaaaactcattcactatgtggtggttaagacgagaaccaaagaggtgaagaaactagaactcgatttgagaactaacgatgacaaccagcatgaggttcttcatagtcatccacctattcatctgctcccccgaacacaaagttcaagatcaacacaggatccaaacacaaacagcaaaccgggagtgagttatcacattgctaactactag

SEQ ID NO: 31780 - DNA, 543 bp, Glycine max
  Peptide Sequence Number=SeqID_123465
atggaggttgataatggagtttgcatgtgggggcgaatattcgtgcaaaatgccacaaagccgtcaagggtggaggatctcactggctcaaggacgatgaccaaccatcatccaatgtggcatgtgcttgttcaaaaaaccctaaatttgggaaatttaatgttgatagatatcccactaatggtgcaatcattgctaaaatggacaaaaaggaccaactattattgtctacttttaagagctcagatgttatgtttcaaactgtctgacacgttaaaaactcttaatgacgacaatgaaatcaactcaaaaattgatgatgacgatgatgatatggagacaaatataatcaatggagataaaaaaagaaggttaataaatgcggcagaggttaccaccatggccaccaatcatgcagtcgtttccaccattgttgcttttgaggaaaaaactcaagtctctatagttgaaaccacatttattaggggaaatgagttgttaaagttggaactattgggacttgggaaaatcgcaagtagttaa

SEQ ID NO: 31781 - DNA, 378 bp, Glycine max
  Peptide Sequence Number=SeqID_123466
atggtatctgatacgggcagtcatctcacatggacccaatgttttcaatgcaagtcatgttatgaacaagccaatgcaagatttaatccattaaattcttcaacatatgaggcttcagattgcttagatgatgtatgcgaggacctcataagcagtggacaaggtctgagttgtcaatggcgttgcaaatgtcccgtcattggcattggcgggttgtccaatgtctcgctggtgctagtggcggcacacgctgtaccgcaattggtgttggcgacacccaaccacgtcagcccattctcgccacagctagtggcggcaccacctgaaccgctgatgcaactggcggccccctgcaatttctttcaaaagggaccctaa

SEQ ID NO: 31782 - DNA, 201 bp, Glycine max
  Peptide Sequence Number=SeqID_123467
atggaaagattggaggctccgtgcggtgattcgacgacaagcaaaggcggctcatggcggtcaccagtggtcagtggtggtggaggaggatcttgggggtgttgggggaggcctgcaacacttgcccaggcgaatttggctcgcctaggcgagctgatccagttcaaattttactgcttcggtaaaaaaattcatatctaa

SEQ ID NO: 31783 - DNA, 363 bp, Glycine max
  Peptide Sequence Number=SeqID_123468
atgtttgccaccactttcaacactccatcatctgcatataatcttgcaccatcgagttcttgttatcgtccatcattacctactcaaatacgtgacatgagtcacgaagatgaggacgagggtgaaaataacaacaataacaacgatgacgatgatgatggtgatggtgttgatgatgatgacaacagtggtcatcatgttcctcaacaacaacggacaattacacatcattatcctagaacaagaggaggtagaggccgcagaccgagaggacaacaaacacagacaaattcaatccaacaagatgagagatccagacgcatatctagaagaactcgctgtgggacatcgtctcattattag

SEQ ID NO: 31784 - DNA, 369 bp, Glycine max
  Peptide Sequence Number=SeqID_123469
atggacgctggttgccagagcaattgcgttggggcccacagaattgatgtgactagtgcctccattgcaaggctttgtggaagaaaactcagagtgatgatggttggtgtggatctcatcctcatccatgctgtccgaggattacacacactcagtgctctccaaatccatcaactcgccaaaccaaacccccttccttccaccactgaagggtacatcctttgtggtacaagtagagggtgcatctacttgggttgtaatactgagaacaagagagggtacatctcttgtggatcagttcaagtggagggattttacaaggttattggaaatctcaagaaccagtggttgcttggggactggacgtag

SEQ ID NO: 31785 - DNA, 531 bp, Glycine max
  Peptide Sequence Number=SeqID_123470
atggagtgcatcaataaccctacctcttgtgaagggtcatcatcatcttccaagcaccccaacaagagcaatagggagaaaaaaggtgtgaggaaaagtaacaaaggaggaggaggaggagtgaggctttccactgatccacaaagcgtggcagccagagaaagaaggcacagaatcagtgacaggttcaagatccttcagagcatggtccctggtgggagcaagatggacactgtttccatgttggagtgtgccattcactacgtcaagttcctccagacagagattttgctccaccaagcattgatagactttgtagatgttgatcatcatgagtctccactgttcctccccgcagagtataataatttccctgatgaacactccaatatttcccttcagcaaaacccttcttcagtttcggtgcattctcatcatcatcagcagagtttaccacagctaccactgtcacagtgctactttcaaggtgaagaagattttaacacctttgatgccatcatgccaccatga

SEQ ID NO: 31786 - DNA, 403 bp, Glycine max
  Peptide Sequence Number=SeqID_123471
ggaggttgttgaagcggaagaattttcccaacaaatggagcagcatggccatggaatgtattacacgccaccaacattttctcagtatccttcacagatgtatcagtatcctttcgaaggtcatgacactgatatatctgcaagcgaacattcgtttggtggtgttgcaaaaacacatcctcatttttcatggccgactatgaccccttcacagcaacatgatgccccaatggcaacacctaacgccccattggctccacaatggaatgtacccagaactatacctgatatgggtgacttattaggtgttgatttacgtcacgagttttctactgaggctgagcaagtagaagcggggagacatcgcagcagaagaaatcctgatcgtcaagcgcgaagatag

SEQ ID NO: 31787 - DNA, 120 bp, Glycine max
  Peptide Sequence Number=SeqID_123472
atgtggaagagactcacacttaagggggagatgtgttgggttacaagtgtgaggtctccttatgtggtgactcgtggtccacaagtgtacccctcgaatctccctaacaattggtattag

SEQ ID NO: 31788 - DNA, 549 bp, Glycine max
  Peptide Sequence Number=SeqID_123473
atggtatcaaggtacgctttaaatgaaattgctggtgagtttgagtgtgtaccttatgcaagcaagaactcttcacgttgtggatgtgtcatgaggactacctacggtcttccatgttcatatcaagggttatgtgagactgaggtgaccataactgaggagatgaaaaccatatcgaaacgatttgagcaactcgatatttgcggcaaggtacatttgaagacaaagcttcgagaaattgcttatccagatctgaactttatgtgtcctcctccagaaaagaaccctaacagagcaaccggaggaggagctctagagagcaccagagacgccacaattgctaacggagaacgattgagggactacgtcgaggagggagaggccttgacagacttttcggagtgcaggccttgggggtcatccggtttgagtgctcctgtaagcctgtgccgatcccacatggttggagcattctcgcaaaacagcgtgaccctgactggtctccctatgatttcacttagtgagagtgacctgacttacccattgtga

SEQ ID NO: 31789 - DNA, 841 bp, Glycine max
  Peptide Sequence Number=SeqID_123474
atggacgatcgaggactaatgtctacttttgtggagtgctggcataaggaaactaatagtttccatttgcccgtcggagaggtgactatcaccttggatgatgtggcatcgttgctacatttgcctatcgtaaaggcgttccatagcttcaaacaacttcatgtcaacgacactgtcgatatattggtggaattacttgaggtcagcattgtagaggcaagagctgagacgattcaatgtcatggctctttgtttgactatcgtggctacgagactgtcacacatgtgcacgtggtattcttggatgcactgcgtgacttgacgcagagtgggacttatgcttggggcgctgctgcacttgtgcatatgtatgataatttaaatgaggcatcaaagagcacagcgaggctgcttgtaggatatatcactctgttacagcatttcccgtctgttgattccgccctagctgccgaggattatgacgagaggagatcacatgcataccgatggacctctggcaaggcactacccgtgccgatgtatcgtaggcgtttagacagactaacccctgatgttactattccaccacatcctactgtgtctttgacttctgttgaagaaataaatgctagatggatgcagttcagtgactacattgcacctatagggcaaatttgtgtagtgccttaccagcatgtgcctcagcaaccggtggcgacaacgacacctaatgaagtagacgttgatgatggttatgtggcaattgctcataaattggagaggctactgaacttgaggatcttaatcgaaggaacagaagcctatactattgctgaagaat

SEQ ID NO: 31790 - DNA, 654 bp, Glycine max
  Peptide Sequence Number=SeqID_123475
gccctgcgtgacctcactcttgctggacggtatgcatggggagttgctgggctcgtccatatgtacaatcagcttaatgatgccagtctcagcaccagccgacagcttgctggttacatcaccttgttacagtgttggatatacgagcactttccgtcaattgcggagtgcaatgctaatctggactacgacgaggtgtcaccacgtgcgtgttggtggattgcgacaaagaagactatgaaaaaggtatctgcagcgatgcacaagcagcgcctggatcatctgaggatcctagatgtttgctggatgccatattcagagcatcgacctgtgcaggactttcatccgatttcgtgcttctcgggacagctctgttgggggcctgttgttgtcagatacagaccagagagggttatgcgccagttcggctacgtccagtgcattcctgcacaccctgtccatccatgggtgtcatatgatgacgtagacgatacgtggatgcactactcagaccatttggcggcagcaggtgatccatgtgttatgccaggtcagtgtgcgcttgactacatagactggttcttccgtatttctcatccattcatgaccgcggcacaaccatcagatcctccgacagatgcacctgctgcgtag

SEQ ID NO: 31791 - DNA, 273 bp, Glycine max
  Peptide Sequence Number=SeqID_123476
atgactgctactcatgatgccctgctatattacaacgggagatggaacatgtcacgccaagatgaatttgtgggtcattctaactattcagaaaaagttatcaaatttaaaataattgagctaaaaactgatgatgacctgttgaaggtcttagtacagtctaactactggaaacaatttggcccaatagaaattttaaccgtttttagtaaatcggtaatcaaaatggaagataacatgtctccgtcacgacatgattcaatgcaaaattag

SEQ ID NO: 31792 - DNA, 360 bp, Glycine max
  Peptide Sequence Number=SeqID_123477
gcaagtgacattgataatgatgcccccaggcctaccgcatctgcccataggcagcgacaacaggtgcatattattgagtatcctcctacaacaacaaaggatttaaacgaagaacataaacaaccacttgttgaagaagtctggaatggagaggaacatcttgagatgaagctatcttcccatgaaaggaagatggctaagttcgggaggtctgctctagagattgaaggccttgtggctgccaacggactaagtcatttgattgcatgttccctagatatggatgatcgaggactaatgtctgcttatatggaatgctggcataaggaaactaatagtttccatttgcccatcggagag

SEQ ID NO: 31793 - DNA, 840 bp, Glycine max
  Peptide Sequence Number=SeqID_123478
atggaggaaggagagaaaaatttggagaccatggattttaaacgacctagaaagctaaacttcaatgcacctctattgtcaacaaaacgtttaggcttttcaggtgttgcagatagatcttgcttgtcaaactcacttaatagtacagtactaaatacaagtgttccattttcatgggaacaagccccagggaagcccaaaaccatggagaggagtgatagcatctatgatggagacatagacacccctcggctaagaccacctccttgcctctggcatccactaaaagaagcaactaaagctgataatggtgctcttgcgtttgatcaagatgatggttgtgatgctgacgacgatgaggatgatgacaagcagaatgatgtgttctcagatgcagtggatgttctatcactatcagaggcatcagacattatgcaacaatcagaggcagctcatagtgacagcaaagatggtttgagattaaagctttcagagtctaatggtggtccatctccaacttatatgatcaaccgttttctccctgatgccaatgcattggttgcatcatcttctgcacatttttccaatgatgccaaagtttgtgataattgtagtcatgagggttatctcaaaggttccactaggcattcacatgctacttctccaaaaggttgtggcttggaatttctcttctcttggcttatgaagaataagctttgtgctataaagagtcctgtcttaccatcatttacaaatgtgcagaagcatcggtacagttcaaaacatacgaaacatcgtacgtcagtccataagccctgcacaaatgttaaagatgtttga

SEQ ID NO: 31794 - DNA, 543 bp, Glycine max
  Peptide Sequence Number=SeqID_123479
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatggaatggtctcgcccaacgcagctaggagaaataccatcaccacgtgctggacatgctggtgtgacagtaggggaaaactggttcattgttagtggtggtgacaataagagtggggtctctgaaacgattgtactgaatatgtctacactgacttggtcagtggtaacttctgttcaaggacgagttcctgttgccagtgagggattgagcttggttgtaagctcttatgatggtgaagatatacttgtatcttttggaggagtaacaacacattatgctcatgtcattgtgtcaaaatccaaaggtgatcttgtatcagtcttgaaggctaagaaagaagtgttggaatcatcactgagcaaggagaaaccatcttctagatttttgtag

SEQ ID NO: 31795 - DNA, 213 bp, Glycine max
  Peptide Sequence Number=SeqID_123480
atggaatggtctcgcccaacgcagctaggagaaataccatcaccacgtgctggacatgctggtgtgacagtaggggaaaactggttcattgttagtggtggtgacaataagagtgtcgggaaacctgtcgtgccagctgcattaatgaatcggccaacgcgcggggagaggcggtttgcgtattgggcgctcttccgcttcctcgctcactga

SEQ ID NO: 31796 - DNA, 1677 bp, Glycine max
  Peptide Sequence Number=SeqID_123481
atgatgcagtcagaggatctgcaattccaatggccattctttgaagacatgaactcaacttttgatcaaggtgttgagtcctatggtttcaccaccatggatgaccatgttggtaattgtgaaccttatggcttcactatggatgaccatgttggtaattgtgaaccttatggcttcactatggatgaccatgtcggtgattgtggcctcagtactctattgagcactccaggggattctacttctgaaatttgttccatcccctttccttcctcccccatgttctccaatgatcatattcatatccaatacccaatcaatgaagaaaccatggaccttccatcactgatggaattggatgatttttattccatcttggatactcaaattattagtattcaaggtcatggagaaagtgaagggagcttcttcccttcacagaatttgtcaagtgaggtggaaaatgcatggagtccaaccccatctgtgatgtcagaattgtccacaaatcaaacatcaccattgaccttaccactagaaaacatggaaattgaaaaacaagtgagccttccacacttgttgaaggcctatggagaagccttggagcaaggacaaaaagcactggaagaagtgactttgaggcgcataagccagaaagctagtccacttggtgagtctttagagcgctttgcattctacttgtcccaaggcatgacaaatcatggagactatctcaaaggggaggccttcaagaactttgggattactttgagggcactctatcaaggattcccaattgggaaaattgctcactttgcagctgtttcaacaattcttgaagccatgccacaagattatgatgttgtgcacatagtggacttttgtattggacatggtgttcaatggcctccaatgattgaggctattgcacacatgcacaaaacattgaaattgacaacaatcaaatggggtggtgagggttctgaatgtgtctctagtccatgcaattttgatgaaactagaaggcagctctatgagcatgccaaatcctgtggtttgaagttgaaggtagaggagaaaggcgtggaggaattggttactgagattaagaaaatgaacaaaaaaggtgggaggagagagtttttggccttcaattgcatgattgatctgccacatatgggaaaagtaaggagcagaaaaaatgccttgcagtttctaagggtagctgaggaattgatcaacacctctggcaacaggggaattatcacttttggggatgggggtgcttttgagaaagtgaaaaataacttgaatttctggtcatttttttatggacacttggtgcattaccaaatcttgttagaatcaatggaatcacattttccaacccgtttctcagaagtgagaattgccatggagcaattatttttacaaccttgcatctcttctcttgattggttacaaacatgggaggagatgaaaaggggtgaccatcttgaggcagagactagtttagaaggttgccaattaagcaaaaatatcttaatggaaatcagagaagtgttgagagaaagtgaaggttcctatcaggccaaaattgaaggacaacatgacaatgaactagttttggagtacaaaggaactcaactattaagattttcaacttggaaaaactaa

SEQ ID NO: 31797 - DNA, 327 bp, Glycine max
  Peptide Sequence Number=SeqID_123482
atggcaacaccaccgggcgtagccaaagaagaagaatggtacatcgtaatcctgaagaaggtcatgatcgattgttcaatgtctatttttcagaaaatcatgtgtacacagacattcagttccgaagaagacgcgcttaaaaaccatgatgaatactttcaaatgagggtcgatgcactacgtcgaaaaggcttatctccattgcaaaagtgcacaactgctagtatattgacttatggatcacctgaattggtgaaacaactgcagtggaatgcttggagcgatttgtatcaggcatctgcaccatatttgggaatgaatacttga

SEQ ID NO: 31798 - DNA, 483 bp, Glycine max
  Peptide Sequence Number=SeqID_123483
atgtgggacatcagctatgcatctgtgctcatggctggtgaggtccctgttgagttgcgaacattgctcgagtttgggttcgaactgcaacttgatgagttcttcaataggctttgggcctctatcagaagtgttgttgcacatatctacatcgaaaacattctccctgcatgcttggtagatagtcaaggttcggactggagacccttcgtccatgctcatgacctgagtggtaccatccgctgtgagatgcggtgtggaaaaaatggcttcgagctcgttaagcattttcctgccaatcaaagcaaatataagatgtcagtggagctcccatggtcgatgaggaccttagacaccatgaagttggagattacgatggagacaaccataaggtcatcttggttgatagggttgatatccttgaagtctctatcaatgaaagtgatagaaggaaggctttatggtgatggtgtatcaacatag

SEQ ID NO: 31799 - DNA, 399 bp, Glycine max
  Peptide Sequence Number=SeqID_123484
atgatttcaagaacaagattcaagaatcaagagaagtttgatttcaagattcaagagaagatgaattcaagattcaagaaaagaaatcaagaagacttcacaagggaagtttttctaaaggttataactcttccaatggttttcttgaccagacatgaagagtccataaaaggtacatcctttgtggtacaagtagagggtacatctacttgggttgttgtgactgagaacaagagagggtacatctcttgtggatcagttcaagtggagggtacatccacttggttgttcaaagagaacaagggagggtacatcccttatgaatctttgcttgtaaaggattttacaaggttgaaaagaaatctcaaggaccgcaggtcgcttggggactggatgtag

SEQ ID NO: 31800 - DNA, 1587 bp, Glycine max
  Peptide Sequence Number=SeqID_123485
atgggtgtcgcagttgccttgaatattgctctggaatctcatgaaagaactatgtcatcattgagtaaaactgatgaaaatttgtctgcctcctttttgaaaattactgcacttgaaaactctttagtggtagctgatgagaagtacaggtttatgcaaaagctccgaaattatgtctcaaatatgtgtgactttttacagcataaagctttttacatcgaggaacttgaagagcagatgaagaaacttcatgaagaccgtgcatcagccatttttgaaagaagaaccactaacaatgatgatgaaatgatcgaggtggaagcagctgtaaaagctgtaatgtcagttttaaacaagaaaggtaacaatatggaggctgccaaatctgctgctcaggaagcatttgctgctgtaagaaaacaaaaagatctgccagtgaagttagatgaatttggtagagatttaaatcttgagaaacgaatgcaaatgaaagttagggctgaggctcatcaacgcaagaggtcacaagcatttaattctaataagctggcatccatggaattggatgatcctaaaatagagggtgaatcaagcactgatgagagtgatagtgagagccaagcatatcagtcacagcgtgatttggtactgcaggctgctgatgggatcttcagtgatgcttctgaggaatatggtcaattatcctttgtcaaaagaagaatggaagaatggaaaagagagtattcatcaagctataaagatgcttatatgtcattgagccttccactggttttctctccgtatgtaagattagaacttctgaggtgggacccacttcacaagggtctagattttcaagagatgaaatggtataaattattgttcacttatggtttacctgaagatggaaaagattttgttcatgatgatggagatgcagaccttgaacttgtcccgaacttggtggaaaaggttgcacttcctattctgcactatgaaatttcccattgctgggacatgcttagtcaacaggaaacagtgaatgctattgctgctacaaaattgattgtgcaacatgtgtctcatgaaagtgaagctcttgctgatctgctagtttccattcgaacacgattggctgatgctgttgctaaccttacagtcccaacatggagcccgccagtagtagctgctgttgcagatgctgcacgagttgcagcatatcggtttggtgtgtctgttcggttgttgagaaacatttgctcatggaaggatgtattttcaatgccagtgttagagaaccttgctctagatgagcttttgttcggaaaagttctacctcacttaagaatcatatcagaaaatgttcaagatgcgataacgagaacagaacgaattattgcttccctgtctggggtctgggctggcccaagtgtcatagcagataggaagattctggagagaagaaatgcaccagagagtgacacaagtcatctagctcgtcgattaaagaaaattcttgttgacctcaatgaatatgatcatgctaggaccatggctagaaccttccatctcaaggaggcattgtga

SEQ ID NO: 31801 - DNA, 423 bp, Glycine max
  Peptide Sequence Number=SeqID_123486
atggggatagcggtagggatgcacattcacaggcgcggagttcataagaagcttgatagtatgattggtgggttgtggtggctggagctctgtgactcgaatatggaagaaagtgcttgtgctatctgtcttgaccattcgttgaagcagattagtgttgacagagtcgaggtccctgtcatgggtgccctgcaggatgtgaaaatcaatggtgaagacatgtccatggacatggatggagacattgccgcaaaagtgaagacagtcgagctcattgccgttacccaccgtgaatctaagggtggtggtggcaacaaggacgaagataaggcttggcgaggtagtcgaggagcgaacaagccttgggaagaggttgtagagcttggatctcacgacgaatgtccggcgacaagcccgagatga

SEQ ID NO: 31802 - DNA, 687 bp, Glycine max
  Peptide Sequence Number=SeqID_123487
atgagaacaaagattacaccaacattacataaaatccttggttcatgttcactttctcaacaaagagaaacacaaaacgatcacacaagggttttcggcgaatttggcgagggattggaggttgcagcggaggatggtgtcgacgaagacgcgagtgtcctcggtggtgttgccggcagggacgtcgacgacgtaggactcgacgacgacggtgtcggtggcggaacgggggtggaggatggtgacggagcggtagttggagaggcggtggtcgccaccgaccatgctgaagccgatgacgtggcgctcgtcgtcgaggacgtcgaggcgctcggtgctgacggcggcagggagaccggagatcacgcggacctcgcggagggtcccgacatcgccgtcgccgaggatgacgtggcagctcttgacgaagtgcttgtaggcctgcgggttgtcgaagcgccgcacgacggaccacacggtggagaccggggcggcaatctcctgcaccacggcggagcagcactggtgcggggacacgacatgggtgtggtgccgagccaccgcgtcggaaacaatcgtggaaggattgttaggggaagattagacatagaacagataaagaaaggttcaagagggaggggtccaccgcttggattgtcgaaactatatgaaaggttattggagtaa

SEQ ID NO: 31803 - DNA, 264 bp, Glycine max
  Peptide Sequence Number=SeqID_123488
atggttcaagttggtgaccggctcagacgagtatgcaagtaccgcaggtggccagaatggctaatggcacagcgtgccctgcaggtgtgcccctcgaatctccccaacacatgtgatgatgagaaaccctacaataattttctatgggaaagaggtagagagaagagagacacaactgggaaggtcacacttgtgaggcttccatctccaattctggtaactcagatccttccttccaaacttctcacaagcaaacttatctga

SEQ ID NO: 31804 - DNA, 528 bp, Glycine max
  Peptide Sequence Number=SeqID_123489
atgaagagagaggaaaaatctcaacgtggcagaaaagaaaggcaagccagcaagccaggtgacagaaaaccaagacaaaagctggagggcaaaagagtgaggcgacgtagcacagtggagggccacaacaacctgaccggtaaagcttgggcacaaatgcacatgggagaagcaatgaaggtgcagcaagccaacaagacacatggcagaaaacaaaggcaagacaccaagccaggtggcagaagactaaggtcaaagctggagggaacatttacacatgcaaaaatcaagtatttcaaaccgccatttgataagctagttggtcatgagttagaatccagaaacatatttgcatgtgcaaagataagactccgtacaacgaccctcccccatatataccttcacgtaaagagaagcctccgtccattgggatacgttagttttttattcaagtattggatcaatgatggaaaattctataccaaaagcacagacagtaagagcaatgaacggatgcaaatatcatag

SEQ ID NO: 31805 - DNA, 327 bp, Glycine max
  Peptide Sequence Number=SeqID_123490
atggcttctaatttccgagcattcttgaacagtcctgttggtccaaaaacaacacatttctggggacctattgccaattggggatttgttgctgccggtttgatagacatgaaaaaacctccagaaatgatctctggcaacatgacagcagttatgtgcgtctattcagcattgttcatgagatttgcatggatggttcaaccgcgaaactatctgcttcttgcttgccatgcatccaacgaggccgtacaaatacgccaactcacccgttgggcaaaggggaatgggtacctttctgtgaagaaggaaggagcttcgtccaagtaa

SEQ ID NO: 31806 - DNA, 1509 bp, Glycine max
  Peptide Sequence Number=SeqID_123491
atgaagactaataacaacgtttctggagagaggaaatcgcggaagagacgcagtggtgaaagtgattctgtggaggacacacttgaaaagtggaaggagtacaacaggcagcaacaacttggctctagagaaaatggggtggaagtgattcacaaagttcctgcaaaagggtcgagaaaaggatgcatgagaggaaagggagggcctcagaactccgattgcaagttcagaggtgtgaggcagaggatttggggtaaatgggttgccgagattcgagaacctatcaatggcaagcttgttggtgagaaagcaaataggctttggcttggtactttctccactgcacttgaggctgctcttgcttatgatgaagcagctaaggccatgtatggcccttgtgcccgtttgaattttcccgagccaatagactctaatggatcatcatcttctagtggaagtgataaaaaatcaccaagtggttcttcggagaatggtggtgatgttgcaatagctgaggagttggaggtgaaccatcgtcggtgtcatgaagacagaccaagattttctaaggttggtgtctttgagaaagcagaagagatgccggttctttctgtaggttgtgtggctgatgactcaatagaggagttgaaggaaatcagtaatggctttgaacagtgtcaaacaagtgaagaatgtaaggcaacatctttgaatgatgttaagtctgaagtaccgagagaaaatgaaggaatagagaaagaattggaggaggttttgaaaaactctggcataggtggagagggtagacacttgcagaaggagcctatggatatacctatgaatacaagaagtaacttttgtagctcttctgcctcttcggatgctgctaccattctgataaagagtgaagaaacaagaggagaatcagttgaaactttgaactcttatgagttgagctgcagcaaccattgccttggatatatgcataataatatgctgccagataccaatccaagaccaaattctgagacatctattgcaaagaaacatactgatgaacattttgatgagatgaaaactaggcttaagggtttggaatgcaagctgagagcacattctattcattacaagaatcaggcaccaatagtaggggactccaatcatccttctatgcagggaattcatctctttggtggtggcacagttggaccaattgaaggcatgtcccaagttgaggctttgaacaacatcaacacaaacagaaattcactacctggattcagttctggccatggtaggaagttgtgtgatctttctcaacagctgcacaaacttggtggttaccttcctgagcaatggaatagtatgcagtttccagacttggatgctggtcatgattatagtttcttaaatcctgattatgattttggcttatatgaagaacagaacatgtttttttccccaccttggctattcaataagatatgtttctgttctctttcactatag

SEQ ID NO: 31807 - DNA, 426 bp, Glycine max
  Peptide Sequence Number=SeqID_123492
atggctatcaaagcaattcaagatgcctttgaagcaatatggaatttagtgcatccaggagatctcatttcctcattgttatcttcaacttcagcaacagaatggtacataggtgtttcaaatgagacttcatatggagtggtggagtttgttcatgcatcgaaagttgaaggccttccaaagattgtcagtatccaaaacaactacagcttgcttgttagatgtcattttgaagagggtattaacagcaaagcatcaattgataccaacattgaagttgcaatgtccactcaacctatacggacgacccttgagaggaaactacaaggcaacatcgcaataatctcaaaagttgagccaaaacatatagacgaggcaatgcaagatgaaaaaggggtcaaagttatgcaagaagagcttgattaa

SEQ ID NO: 31808 - DNA, 81 bp, Glycine max
  Peptide Sequence Number=SeqID_123493
atgaggaaggtagtgtatgggtttcaagtcaccgatgaagaggtcgagagcttgaataaaagacctaacaggaagttgtga

SEQ ID NO: 31809 - DNA, 153 bp, Glycine max
  Peptide Sequence Number=SeqID_123494
atgtggaaccaaccattcatcggcgccgtcgtcgtcaccctccgcccaatcagcgtcttcttcgccaccaccgacagtggattggctctctacatcgtcctcatttttgttcactttataaggaaggctaccactgtagttgctgaaacttga

SEQ ID NO: 31810 - DNA, 471 bp, Glycine max
  Peptide Sequence Number=SeqID_123495
atgttgggtttggacgaaaagcaagaaaagctcagccatttcagattctattggcatgacgtggtgagtggacgcaacccttcttcaattgaagttgtgccaccacccttgaagaactcaaccacatcctttggatcggtgaacatgattgagaaccctttgacattagaaccccaattgaactcaaaattggtggggaaagctcaggggttctatgcttccacgtcacaaagtgaaatcaccttgctcatggctatgaatttcgccatcactgaagggaagtacaatggcagcaccatcacaattttggggaggaactctgtttacgacaaggagagagagatgcccgtgattggtggaagtggactctttcgatttgctaggggatatgctcaacttagaacgcattggttctcacccaccaccaaggatgccattgttgagtacaatatttatgttttgcattattga

SEQ ID NO: 31811 - DNA, 858 bp, Glycine max
  Peptide Sequence Number=SeqID_123496
atgaataaatggaagattcgtcttcaactcacaaagcctgtcacttggcctccgttagtttggggtgtagtttgtggtgctgctgcctcgggaaattttcattggaattttgaggatgttgctaaatcaattgtgtgcatgatgatgtccggcccattcctgacaggatatacacagactctgaatgattggtatgaccgagaaattgacgcaataaatgaaccttatagaccaattccttctggggcaatatctgagaatgaggtaatcactcaaatatgggtgttgctgcttggtggtctttctctggctggtatattggacatatgggtgggtacaatacacaatagtctcatggtcgttttttatcagaagcttgattgtgttaagttctattttctggacttgcactgtatctcagaagatcttgattggtttcttactgacaggtgggcaggtcaggctttgtttggaactcttacaccagatataattgttctcacactcctatacagcatagctggattgggaattgctattgtcaatgacttcaaaagtgttgaaggggatagggctctagggcttcagtctcttccagttgcttttggttctgaaactgcaaagtggatatgtgttggcgctattgacattacacaattatctgtagctggatatctacttggggctgataaaccgttttatgcgttagctttacttggcctaataattccacaagtcttttttcagttcaagtatttcctcaaggaccctgtgaaatatgatgttaaatatcaggctagtgcacagccatttttggtgcttggtttgttggttactgctctagcaactagccactga

SEQ ID NO: 31812 - DNA, 480 bp, Glycine max
  Peptide Sequence Number=SeqID_123497
atgtccttgtctttgtgcttcttaagactcaacgtcccctgttcatatgctctgaaaagaaaagaagaaaaagaacttcaaatgtctcccgctctatatgacttgaatgtcctctattttacgtttcataaaacttcattgtctttcgatttcacttccttggttttcgctagtttcccgtttactggacccaagcttgcccaggctagcctctggctctctagggcccccaaaagacttcagggtgaagtaaccagctcgcttgggctagccaattactttaggagtaagcatgagctcgcctggcatgctagggaggctgaggggaggttccaaggtttagtacttgatggaattgagagaattaagagagaagaagaagaaagaagaggaaacgaagccgaggcattgccgaatcccgattgtgatcaatctctacattgttcctcattcggtgttctttgtatgatcatcgattag

SEQ ID NO: 31813 - DNA, 451 bp, Glycine max
  Peptide Sequence Number=SeqID_123498
atgtcagttctagaattgtacatagaaaaggatgtggctggtggttcaatgtttcattctgcaaattcccttacatcatgtggaaattatgtatctaatgattacacacaaccgccaacaaatatgagcaatttaaatcttgacgaagatgatgatcatgatgatgataattatcttgtgtctaactcatacgttgaagagttgttagacgaagatgacagtgttgacggtatatcagatacagacaatgaagtccccgagatgattccaccacaaatcgccagtgtcgccaccatgacgggcaacccgctagtcaaactagcggtttccaaaacatgcacagactcgccagcatgggtggcgagttcaggcttctatggattcgccagtggtactggcgttttccttgtcacgtgggagatgctcagcaaactcgccattgccaatgacg

SEQ ID NO: 31814 - DNA, 381 bp, Glycine max
  Peptide Sequence Number=SeqID_123499
atggccaacaaggtttgcactatgagaaatgtactcgcacgatggtaccgaggtaattgtctcttctctggtgcgactctgccttcgtttccaactctgaactcctccgatgcggtggggatgggtacctacaaaggaactccgatgctcaagttagagctctgtcccaaaagttttagcttcttggatgccttcgaggtccacacctgtccaacgggtgtttggcttaggccgaggggtatttggctaaagctgaaggccatgacagaagggtatttcaactattaccgccctctcacctataagttcaagaatgtctcagtggatgttacctatgttgtcctcactagtatgcttgtgggttcttgtggagggtgctag

SEQ ID NO: 31815 - DNA, 287 bp, Glycine max
  Peptide Sequence Number=SeqID_123500
atgaagcatccgagtgatcatatggcctgttttaagatggataaggtggaacaagagattgatatggtagctaaagccatggttatgcaaaatccacttgaaaaagtgctgaccaatacccttgagtgtttgactacagaagaagaaaaagaagtgcagagttgcttgaaggaattagaaggtgagcaagagagtttccctgaaaggatgaaagttgaagagttaaagagagacagaccaccagaggaagcaaaagtggaattgaagacccttcctaagcatttaaa

SEQ ID NO: 31816 - DNA, 519 bp, Glycine max
  Peptide Sequence Number=SeqID_123501
atgccatctactgtttgcagggatcgcgcccgcaagacatccagtggacccggagaagtccaaaagggttctggggtttccagctctggttacgggcctctgtcagtcctacagggtgtctgtcgcccccagcaaggtcatcagacctcccatcaccatagcccttgtcaaaaagtactacgcccccaggcaagcgtagggcgaggcaccacaacagcctggggacagtcaacagtgggcagcagacgcaccgccaccacctccaaagtccacctcagctcatctacaaaagctggagcgttgcctacgacacgtggccgaccagcaggtggccaaccatcggggcaggtacgagcagacgttaaagaagcactactaggaggcaacctagaattggctacaaagaagctccccgcgaagcagtccaggaagggaaccattgaagagggttccagtgcggccccacaagccgacacaagctttgacaaacaccaattccagagtgcggaacatcagtag

SEQ ID NO: 31817 - DNA, 459 bp, Glycine max
  Peptide Sequence Number=SeqID_123502
atgtatccccacaaaatgttatcatcactcctaggaagcaaagaagttgcaaagaatttgattctttatagctataagcatggtttttcagggtttgctgcaagattgacaaaatatcaagcagaagcaatagcaaagtttcctagggtagtttctgtcattccaaatggcattcacaaacttcatacaacaagaagctgggactttatgggaatccatcattccacttcaaaaaattctttctctgacaacaacttaggtgaaggaaccatcattggtgtcatagacacagagaacaacattagaggcaatggcgagattgtcgagaaagaagagcaccaacacaatatactagtaagacggagcatcgacgaggaggtatcagaaccttacccttcatccttgatcagccacactcattcattctatttctctctcaaacttgattctactttttaa

SEQ ID NO: 31818 - DNA, 369 bp, Glycine max
  Peptide Sequence Number=SeqID_123503
atggtagtagttgacgatgatgaatctctgtctgaccatgtcctcggtagtgtatttgagtatgagagagtcctatatctctttagattccttgtagaagcaatagacatcaaaaagatcattagacaaggcactttagaaagtgtgacgacataccttattggtctaaacccattgttgaagttgactggcatcaacagcgacatcaggtttgggattggaaagagcaaagacaactccatgcatgtccagcaaggcaacgaattggcaaaggttgcagtcagtggcatggggttggaagcgtcgacattgttgacagtcactgacctaaaaggtttatccgcagtgttccacgtaaccttcccatga

SEQ ID NO: 31819 - DNA, 924 bp, Glycine max
  Peptide Sequence Number=SeqID_123504
atggagggtcttgccaatccctatgtgaccaccaaggggtgttttgtgaaattcctccaacagaatgagaatgaaatgagacctggtgatgacgtgaagcttgtggatgtaagtagaagcgcgctggagacgagggcaaaacaccctcctgtagtaggcaagggggtgggaattttggaagaggacaatgcccatggacgtgcccgaagcatttgtttccagtgtgaagggaatagtaaaatctggagtggcaaggtacgacgtgacaccctggacaaataccatgtgtctgagatactacagttgggtttgggtgaaaacacacttagattggcgcagcaggaactgtccataaatggtggtaaaacatctttcattgtggctgggaaggaatttggtgaaatccctaacataaatcgagcttggagagccaagaagcaggacccaagtcatcaagcaactcgtcaatggtgggcacgaaaaacgatctttcatcgttattgcattgagagccctgctagcgtcaagcaaggtggcaaattgcctctcaagaggaaaggagtaaggttcctggaagaggttggagaattcgtcgaggagagagacgatggccaggggtgtaggttgaagggatggagggggtgtacccttggatggaaatgggcacctgaagggagagctgatgtcccagtgagagcattaaggctgatctgggaaaaagggtgggttcagagtctgtgggaacctcttggtgatggggttctgtcaatagggctattagtgggtctacgtcctcctatttcctcttatgacagttgtttgaagggtaattggggtggtgacgaacctttcaggccaacgcaaccgcttaagggagcgatagaggctgaagagcctggacctcacgacaaagttctaggttga

SEQ ID NO: 31820 - DNA, 612 bp, Glycine max
  Peptide Sequence Number=SeqID_123505
atggagtttgcaaaccatgtccaagaaaaacacgatgaccttgtaggcggggtaatgagtgaatccgtgcaagagtggaagtccaataataaagtccagggaaaggtcctcccagaccaaagtacgtgcaggcaaaggttgaagcagtccggccggcttcctggtttcatacttcatttgttgacaaatggggcactaggacacataccatcgaatgcactttcgcatttggagctgtcataccctaatttcgtctggggactatcgttcgttgatctttcgatccttgctagtcgatttacggtgttgaatgccaattacagtacaaagcaaggaaccattcggtgttatgatcaagaagacaaaagataccaagaaaggaggacaatagagtcttttccttcatttggcttgcctgggccaccaaataacttcaaggctaagggactagctcgcctgggcaagctgcaaccgccccaaggtggccttttgcctataaataggcatcctaggggtgttttaaagggtttcaaggttcaaaagttgagggaattgagagaagagagaaacaagaggaaacgaggccgaggcgctaccaaatcgcgaccgtga

SEQ ID NO: 31821 - DNA, 225 bp, Glycine max
  Peptide Sequence Number=SeqID_123506
atgtgtttcaatggaggtagttgccagtacaagttcaaaagtctcaccattaagtactcatggagcagatcgggaaacataccggattttgtgcaagcaaaaattatgcagcagaaggcttggaagatgattgaagaactagagcaacacgctcagtgcatcatcaaccactcggcgcgaggagccaacctggaggccagttctagcacgcatctgatggcttag

SEQ ID NO: 31822 - DNA, 504 bp, Glycine max
  Peptide Sequence Number=SeqID_123507
atggatacagggaaggcatattgcataaggctaactcccgcagtcatgatgcaaagaggaaaaaaatatatggagcagctctactttgatgtaatgactatttgtggacagcttggatttcctgatttgttcttgacatttacatgtaatccaaattggcctgaaattgaaagaaatgtcaagatcttgaatttacgatctgatgagcgcccagacatggtgacaaaagtcttcaagcagaagcttgatgatcttatcaatgatctcaaaagcagacaagtgtttggtcaaatacttggatcaattgttaatgtgaacaactcagatggcacacaaactcaaatccacgatgaaatcaagaactatcttgattgtaggtatgtctcaccatgtgaagcatgttggaagatttttagttttttacaacatgggcgtaaaccaacagttgagcgtttatactttcatttggaagatgaacatcctgtctattttaagggcaaataa

SEQ ID NO: 31823 - DNA, 222 bp, Glycine max
  Peptide Sequence Number=SeqID_123508
atggctgagatcacgttgcattttcaggctaaaagaagagaagttttagcagccggtgtctcgctaagcgaggcatgtgcgcttagcgagtggcatccgctaagcgagacactcagctcgcttagcgtgttgggaaatcctaaaagaggatcagtcagagatgcccgcccccagcgtgcagccagctcgctcagcgagtcgtttgtcccttctcgcgcttag

SEQ ID NO: 31824 - DNA, 551 bp, Glycine max
  Peptide Sequence Number=SeqID_123509
gccaagtaaaggtgagtgtggaggaggttacagatgcagatgctccagttcctgtacccactaatgaggtttccttagtggggcaggcacttcacaccttccttacttggtcgacacatctggtcaagtctttatcacagcagctgtgtctctggcaaaaccacctccaaagcccgatccgaaggcatctcactgaaacatgtatgcgagcggggaattctgatatctatggattcctcgagccacagtccattcagaggtctgggcaatcgcagtttgagtctgaaagttacataaagacttggatgcagagttcaaaacgcgatgtctatcttggagcctacctaaatgggccagacaactaccttaaggggattattaatagtgctttaaatggtcttgatgatgctccacagcctaaatcaaaggctcctgctaggtggattgtcgtcaagtattttaacgatcctagacccttggagccagagagattaaaggcattgcggatccagtgggcacagttttatctccgagttagagatcaggcctag

SEQ ID NO: 31825 - DNA, 972 bp, Glycine max
  Peptide Sequence Number=SeqID_123510
atggcttctaggaaacgcaagagtatcggttcaagacccacaacacaatatgatacaaggagatttcactccttagatgcttggaaccggtacacggataatgtcctagggagaaacatcttgcctgagaggaagttggagctctaccacatcgagttggatgatattaagactgagttggagaggcgtaatttccataaatgcctcaccaatttgatcgatgggagcatagatttggctttggtgaaagagttctatgcaaagttatatagctctaagggcccttcaccaaagcaagccagagtcagaggccatctagtgaaaatcgacgctgacagcctcaacacattcctggagacacctgtggtgttggcagagggtgagtctttgcccatatactccagatactgcaagctgcccacaaattacagagagattgaggctgccttatgcataccaggccgagggttcatcttgaacgctgagggccatcctgggaggattctcaggaatgatttgactactttagcccaggtgtggagtgttatctcatactccaacctggctcctacctcccatacctctgatatgacagtggacagagctaggttgatctttggcctagtttctcgcatggacatgaattctaactcttctagactagggtttcctgctctgatcatcgccctatatagagccagaggggttgtctctgacagcctaacttttgagtgcctgagcccgatcattaatttggcctacatcaggaagaactgttggaatcctgatgatctgacagtttctatccgtggggctaggaaggcgagggcgaggcccactgagcttccttccacatctgcagctcttactccagcagctccttcagtcccagctcaaagtgattctcagcgctttgaagccatgcttcagagcattcatcagggacatatcattttactccagagcttatag

SEQ ID NO: 31826 - DNA, 204 bp, Glycine max
  Peptide Sequence Number=SeqID_123511
atggagtgtcaccactgtggcaagtatggtcacaaacagcccaagtttactgatctcatcatctacatggccatcactcatgatctcaaagtcagccatacagcagcaacagaagatggcatagtgaagatgagagctctaaaggagaaagatggatcccaattggaggatcagggaaagctagttcatgtgggatacttctag

SEQ ID NO: 31827 - DNA, 639 bp, Glycine max
  Peptide Sequence Number=SeqID_123512
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctcgtgcgtcgaaaagggaaagggagtcaagaacttccccgattgctagccaaggccaaagcagtggcagacacctactccgcccccgaggagatccacggatttctcagctattgtcagcatatgatagacttaatggaccatatgattag

SEQ ID NO: 31828 - DNA, 261 bp, Glycine max
  Peptide Sequence Number=SeqID_123513
ggagctgataccgctcgccgcagccgaacgaccgagcgcagcgagtcagtgagcgaggaagcggaagagcgcccaatacgcaaaccgcctctccccgcgcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31829 - DNA, 180 bp, Glycine max
  Peptide Sequence Number=SeqID_123514
atgcttgttacccacgtctgggccatccaacaagctagtgccaaagaccctggaagatcagtgcatagtgccccccacgatcataaacaacatccaacgtatgaacgtgcccaaaagctagttccaaagaccctggaagaaaaatcagcatgcaacagggacaagcggatatcctcatag

SEQ ID NO: 31830 - DNA, 482 bp, Glycine max
  Peptide Sequence Number=SeqID_123515
gcgtggcagtacatcccagagggattcacggctggcggcaataatgctcgggttggtggtgacgcccgcgatgggaaaaatgcgcgccaggcgttctacttccgccacgttggcggtatccagatgccgatcacaatgctagtttttggccgtcaactggctgtgatactgacggcgatattcggaaggggaacgttctgtgtgtttgcgaaagagacggcagaaatagttgctgtattcattgaacccgacgttcccggtcttctgaaaaagatgggaaagatagttgggggaaatataaaacgcctcggcaacggaatctcgggagaaacgcgcccgttctgggacctcgtctggcaacctgctgctgttgtgaaagggcattatcccggtggagctgaagcgggtaatgtgccgttaatcagatccgtcaggatgtgcgtgatatcgtggtacatgaggtgggaaccgggatttgccgg

SEQ ID NO: 31831 - DNA, 264 bp, Glycine max
  Peptide Sequence Number=SeqID_123516
atggtcatactttcactcgggggtccgattcaggcgcataatatatcgagacgctcgaaaatgaacagcggaagctctcgagaaattctaaatggtgataacttttcactcggaggtccgattcaggcgaataatatatcgagacgctcgaaaatgaacagcagaagctctcgagaaactccaaatggttgtgaaaacaaaacaacgatggataccttagagccctacactggggcaatgaaaggcactatgcataaaccttaa

SEQ ID NO: 31832 - DNA, 387 bp, Glycine max
  Peptide Sequence Number=SeqID_123517
atgttggtctccacgcgtcaacgagctcgtttcccctggttgacgataggtgcgggacgacaaaatggtgcagaggaagatgtaagtctccgcgcgtcaacgggctcgtttgcccctaggttgacgaaaggtgcgagtaaccataaagtaacccgcatgtcacctgacttcacgggtcaggacgacaaaagggtcaggacgaataaaggttgcagaagacgatgtcagtctccgcgcgtcaacgcactcgttagcccctggttgacaaaaggtgagggacgacaaaaggtgaagaagacgatgttggtctccacgcctcaacgggctcgtttcccctggttgacgataggtgcgggtaaccataaggtaaccccgcatgtcacttga

SEQ ID NO: 31833 - DNA, 574 bp, Glycine max
  Peptide Sequence Number=SeqID_123518
atgagtcatcattcaactagtgttaatgatgagggtactagtcataaggaccctctatctagaatcttagatgagttgagttctctcaagttatggaaagaaaaacaagagagaaaagaaaaaggaataaaaagagtggaagaaatatgtcaagatgaaagaaagaaaataagagaggaagaaagaagaaaaataatgaaagaaatgaaaagagaaaaacgtgcctcctataatagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaagacaatagaaaagcaagaccctaaggcta

SEQ ID NO: 31834 - DNA, 707 bp, Glycine max
  Peptide Sequence Number=SeqID_123519
acgaggaagaagcacagattggtgctgatcgttctagtgcaacctctaataaatctgagatttataaggaggaagcacggaatgcagcacagaagcataaaccaaagagggtgaagagtgtcaatgttgatgcagaagcctttgctgaagcactagaacatacgaagaaaagagatacaggccatcaaagtgtgtcattggagaataagacaggagattcaactgtgctgaagataggagattcagctaaagttgtgataaaacaaaacatgaagggaagaaagcataaatatgggtttaacaacaataaacgtgaaaagacagagaagaaaagggtggtggatgatgaaactggcgacaaacatgagctgtatgaaaaaattacattagacgatgttaatcaattctccttcatcatgatcatttcgattagcatgaacgtcgtcagcttcttcttctccgacaactttacgagtgatttgagcagtcaaaggactaacataggtgtccatgtctaccagcgtaaatcctatatcatcggtgcgcacaccggtgttgctgtcaacccatttacatttgaaaacacataccgtaaatttcacatatttaagctcccaaatttcatcaatgaacccaaagtaagggatagaagctacacagggattggcgtcattgacacttgcaaagtgttgagattcagcccttag

SEQ ID NO: 31835 - DNA, 522 bp, Glycine max
  Peptide Sequence Number=SeqID_123520
atggcctcaacaaacttcttatttccagaaggaaattcaatcaatagacttccaatctttaatggagagggttaccactactggaaaacccgaatgcaaatttttattgaggcaataaacttaaatatttggggagccatagaaatagggccttatatacccaccacagtagaaagaatcacaatagatgggagcacaacaagtgaaagcataacattagaaaaacctagagatagatggatgaatgcaaatgaaagcattcaagacatgcaaaagaggttcacacatatagtaaatcatcttgcagccttaaggaaagagtttcaaaatgaagatctcataaacaaagaacacgaaatggaattgttgagattaaatcaacatgaagaaaatgacaagaaaaagaagggaatttctcttaaagcctcatcttcaatccaagaagaaagtgataaggaaattgatctagatgaagatgatgatcttagcctttttgtaaaaaggttcaacaagtttcttaaa

SEQ ID NO: 31836 - DNA, 513 bp, Glycine max
  Peptide Sequence Number=SeqID_123521
atggcagaagtctccacggaggccattgcatccctcgcccaatattatgaccagttgttgaggtgcttcacctttggggacttccagctgtcacccatggtggaagaatttgaagagatcctaggatgtcctctagggggaaggaaaccatacctcttctcagggttctatccctctttagctagaatttctaagatagtccaaatctcggcgcaagaattagaccacagaaaaggggtcctctttccaaatgtggatgggttggtggacctggcagcgatcgacgcttttctcgcctatcatgaccgcaaggaaagcccggttgtcgctatactagacgatctatatgacaccttcgaccgaagatgtgagaagagcagtacaaggattgtttgctgtactccgaccctctatcatgcaaagaaggagtgtctgtcaactggttccctcgatggaaagaaggaagaaccaggattcttatttcgtgcggaagatttccaaatgttcccttga

SEQ ID NO: 31837 - DNA, 315 bp, Glycine max
  Peptide Sequence Number=SeqID_123522
atgacacgcagagacaaaatttggtcattctgcacccttgtgtcatccagaggcggcgggcccgatgacaagcagcggccaatgtggtcattctgcacccttgtgtcatccagaggcggcgggcccgatgacacgcggagataccttacggttatccgcacccttttgtcatccagaggcgacgggcccgatgacaagcagcggccaatgtggtcattctgcacccttcgtcaatcgcggccgacaagcccgttgacatgcggagatttacatcatcttccgcacttacaagatctgtcacaggggatcctctag

SEQ ID NO: 31838 - DNA, 252 bp, Glycine max
  Peptide Sequence Number=SeqID_123523
atgtaccctaaggctcatgagaaccctaaggcctacctttggatctctggcccaacctacttggagtcttttatccgatgcccttgcggggtaggattgcatcattccctccaccttggaaaggatttgacctcaaatcctaaggtttttcatactctgggctccttccctgaacaccttaaggtaaggtctgaaaatccatttcttgggcatcttcccatgaaggaacatggttcctcaccatgtcaatga

SEQ ID NO: 31839 - DNA, 87 bp, Glycine max
  Peptide Sequence Number=SeqID_123524
atggcgatggtggttggctgcaatgacagtgaaggagccataggagaggaagagaaagagactaagagaggaaagttatggaattaa

SEQ ID NO: 31840 - DNA, 174 bp, Glycine max
  Peptide Sequence Number=SeqID_123525
atggtagcggaatggagaaggaagagagagaggagacaccacttcaaggagaagatgagtctagaagaagctcactaccataggaggccatggataagagcttggaggaagaaggagatgactgagcctattaatccaagatcaattccaagattctccactaagtgtgcttag

SEQ ID NO: 31841 - DNA, 673 bp, Glycine max
  Peptide Sequence Number=SeqID_123526
agggctacacgccctcacctttagagcactacacgtcctcacctccagagggctgcatgcccttacctttagaggactgcacctcctcaccttcagaggactgcccgtcctcacctttagaggactgcacgcccttgccttcaaagggcgacacatcctcaactttagtgggctacacgccctagcctttagaggactacacgtcttcgccactagaggacttcacatcctcaccttgagagggctacacgccttcgccttcagagggctgcacaccctcgccttcagagggctgcatgccctcaccttcaaagggcgacacatcctcaacattattgggctacacgcctatgccttcagaggactacacgtcctcgccatcacaggacttcatgtcctcaccttcagagggttgcacgccctcaccttcagaggactgcacgtcctcaccttcagaggattgcacgtcctcaccttcagagagctgcacgccctcgcctttagagggctacacgtcctcacctccaaagggctgcatgccctcacctttagaggactacacgtcctcgccttcagaggattgcacgtcctcaccttcagaggactacacgtcctcagcttcagagggctacacgtcctcgccatcagagggctgcctgcggggatcctctag

SEQ ID NO: 31842 - DNA, 408 bp, Glycine max
  Peptide Sequence Number=SeqID_123527
atgcaatcacagggacttgcactgcctttggagcttaaggttggtccctcaactactcatgttagcacaaaggggagttgtgttgatccctcaccgaccgatccagagacgggtgactcaaacaaatgtgggctgtacatcgaagaaaatccttcccgccaggttgccctaggaagattttatgagggatcaacagttgttcacaacatccctttgttgcatggtcaggtgaagattggtgttgaggaggttaaagatgcaaaggctctcgttcctgtacccactaacgagacagctgtgtctccagcaaagcctccagataggccgaatgccgaggtcgatgatcccctgtatctgatgacattgaccatcccacggcttttcttgaagcctctccaggttatgtag

SEQ ID NO: 31843 - DNA, 969 bp, Glycine max
  Peptide Sequence Number=SeqID_123528
gtcgactctagaggatccccaggaggatattcagcggaatttgaaatcccagaggcttctgacagtaggatgaaaaagaagttacttcagactgtcgacgagagattgaggcagtttaaattagacctcacgagaaaatgggcccttgtagccaatcaggacggtgtggacgacactgtctgtgagaaatatgacataagcaaggaaaaatgggcccaattttgccagactcgtagagacccttcttgggaggatgtgcggaaaaaggcattggccatccagaaacagaacactgccccccatgttttgtctcgtgagggttatgaatatttggagcagaagctcctggctgagaagaccaagaagaagttggaggaagcgttgatggcatcatcgaccctccatcccccggagatgacaactgaggccgcaaaggaaattgctgagagatcgattcctttgaggagcaggcgacacagggatccttcgtcccccatggaccaccctggacgtgtccgtgctgctggagccggggtcaccatcaagcaatacttcggatcggctccacgaacgtctcacagctcatcctccttgcctcctgaagaattgcaacaactgacccagcaaatcagggaccagttagaggagtcgatcacagaaaaagtgactcgacaactcatggcatcgttcagtcagatgcagtcccagattcagtctcatatgcaatctcagggacttgcactacctcctaagcctctggttggtccctcaggtcctcatgtaagcacaaaggggagttgtgttgatcccttaggaaacgatcctgagacaggtgactcaaataggtgcggcttgtacatcaaagcaaatcctaactgcctgattgccttggggagagtttatgagggatccactattgttcataacactcctttgttgcctggccaagtaaaggtgggtgtggaggag

SEQ ID NO: 31844 - DNA, 1014 bp, Glycine max
  Peptide Sequence Number=SeqID_123529
atggccaagttcgatccagaaattgtcctcgaattttatgccaatgcttggccaacagaggagggcgtgcgtgatatgaggtcctgggtgaggggtcagtggatcccgttcgatgcagatgctatcagccagctcctgggatatcctttagtgttggaagagggccaggagtgcgagtatggccagagaaggaaccggtctgatgggttcgatgaggaggccatcgcccagttgctgtgtataccggggcaagattttgcccagactgctgccgggaaacgggtgcggatcatgcgcaccaacatgaccaccctgactcagatatggatgactttgctgctcagcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggaaccctttggacccggataagtccaacagggccctgggatttcccgccttgattacaggactccgccagtcgtttggcgtccccgtcacacctagcaaggtgattcggccacccatcacccgagcttttattgagaagtactacacgcagagacaggtccaaggtgtatgcaccacaggccgcggacgcgccgccaccttcatcaggctggcccagccggattgtttgatacagagcagtatttgcggcatttggttcgccagcaggcggcccacccaccgggcacatgtacaaactcatgattgtctttatcagatgagtcttagcctgcagagccagggctttacttcttttccgtgccctactccggaccagttcagggcagaggtcgcatggcctggagattggcccgaggcccaggcaggagaagcaccagcagaggctcccgacgaggcagatgaggcccgcgaggatgaagagatgaccgatttacttgatttcttgggagggagcggtgccacatga

SEQ ID NO: 31845 - DNA, 387 bp, Glycine max
  Peptide Sequence Number=SeqID_123530
atgagtcttcattcttcatctagtgttaatggtgagggttctactcctacggaccccttaaataatatattagatgagttaagatcccttaagttctggaaagaaaaacaagcagatttaaaagaaaaagaggggtcaagacatagttccatagtagtcaagaggagactcctcttccttcctctagtggaagtgaagagaagtaagggggaatcgaagattcatggggatcctccagtagagtattggaatgatcttaagagtgcccttaggaagaggcatattccctcctactatgaaagggagcttatagacaagctccaaaggcttagacaagggagtatgagtgttgaagaatatagacacaaatggaactactcattttaa

SEQ ID NO: 31846 - DNA, 282 bp, Glycine max
  Peptide Sequence Number=SeqID_123531
atggatggcattgaagagctagatcatagccggtatcaggcaactcaaaggccaacccaagatcagatgaataagatcgcttcctctactggaggggagcggacatgggctaacctgggtctgggatgcaagccaagacctagaagccttcttagtctggactacaatgagtctaaagcgggtagactatcgtacttagagttaggacgaattccagtagctgtgctaaggctagagaggcacaagaactcaacaggagagttaagtcagaagtatccctag

SEQ ID NO: 31847 - DNA, 270 bp, Glycine max
  Peptide Sequence Number=SeqID_123532
atgcggagatctatagcaaatgtgagcccttccgagacatccaatctgctgcaaaaggaggtgaagtttgattttgatgatcggtgcaaggagacagcttttgattgcctcaagcgtgcggtgacaaccacccctatcattcatggacctgattggacagccccatttgagtctaatggggtttggagtccttgtagaagcaagcttcatgatgatgaatcaagtatgaatcaagtagttttgatgatgacaaaaagcccaaaagaatga

SEQ ID NO: 31848 - DNA, 551 bp, Glycine max
  Peptide Sequence Number=SeqID_123533
gaaacgatcctgagaccggtgactctgacaggtgcggcttctacatagaagcagatcctacccgcctggttgccatcgggagagtttatgagggatccactgttgttcataacactcctttgttgcttggccaagtaaaggtgagtgtggaggaggttagagatgcagatgctccaattcctgtacccactgatgaggtttccttagtggggcaggcacttcacaccttccttgcttggccgacacatctggtcaagtctttatcacagcaggtagttgtgtctccgccaaaaccacctccgaagcccgatccggaggtcgatgatccgctttatctgatgacattaaccatcccagagcttttcttgaggccttatcaggttagatgggatgccaccatgttcggggtcgttaatccagatttccccctgtacataaagcacgaagacctctccgaaatcgcacacggtggtcaatgtctcagcatatcaggtcttaatgatgctccacatcctaaatcaaaggctcctgctaggtggattgtcatcaag

SEQ ID NO: 31849 - DNA, 1041 bp, Glycine max
  Peptide Sequence Number=SeqID_123534
gtcgactctagaggatcccccggattgtccactcacgccggggatgatcgtgcgggagaaaactcccggatcctgatgccgcttttaccatgcgccggcgcggcgccgagccggtcccggcttccatggccttctagggttcaagcgcgacctgcagcgcgcgctccagcgacacccgcagcatctcgccgtggccgaactgcgcaaacgcctcgtagcgggcatccgcgccgccttcgcgcaggccttccaccatcgcgcgcacggcaggctgcaggccgacgggtcgcccgtgatgtagcgcgcgaacgtgtccggccgcgtgaacagcacgtgcagcgcgaacaggccgccataggaatgcccccacaggtattcgcgtctgtcgtcgaccgcggcgcggccgcgcaccagcggcttgacccgttcgcgcaagagggccaggaactcgtccgcgccgcctccctcgcggcccagcaccaccggattcggctggcgcgcgccctgctcgaacacgggcggcgtgtagtcataggcgcgcgccaccacgtcgttgcgcgtcggcacgtcgtagcccacggccaccagcaccggcgccccgcccgcgcccaaccgcagcaggtcggcatcggtcagcgtggccagcgccgcgttgccgtcgagcatgtacaacaccgcgctgccgccggccggcgcggcctggcgcggcacggcgatctggatgcggtagtggcgcttgccatcggccgaatcgagccggtacgtttcaaagcgatagaccgtcgacggccggtccgccacggtctcgccgacaagctgcgcgccgcgcgcgaccggcgcgcccgcatcgttcggcgtcggagcctgcgcctgcgcaccggcgctccagagaaccccgctgaacaaggcggcttggcaaaggcggaacaggatacgggagacatcggcttctcgggattgcgcgtgccgcagggcaccagcccgtcggcggaatggaacacggttcggcacgccgcaacggcggcgcctgccgcagcatag

SEQ ID NO: 31850 - DNA, 324 bp, Glycine max
  Peptide Sequence Number=SeqID_123535
atggtttccagaggtatcatcccctttaaaaaacatattgcgacagtagggactaccagcaacaatatgttatcaaagaggaaaactctagatgagggttcactgttatcaagcaagtcggagacccggcatgaccacagattcacctccactccttatgttcccatggacccggtccctagtggagtcgccaactgtcgcaacctaccatttggcgggagggcgatgcaagactcacgggtgcgtcttccaagaaaggaagatgtgcggagtcaccaccaacgtttatttgaggaaaacgtcggaaaaactggaaaggtgtag

SEQ ID NO: 31851 - DNA, 519 bp, Glycine max
  Peptide Sequence Number=SeqID_123536
tacaagggacatttgccccagaaccatctaagatgtatgtcgaaagatgggggcatacgcaaagatgaggaattgttgatacattccttccaagaaagtcttactggggtagttgttacctggtacactaacttggaatcttcccgagtccattcctgggagaacctaatggttgccttcgttaggcggtgtcggtataatggctttggatatgatgcaactacaaaacatacgctattgggtctgaaaagaggaacatttagtcatctgactggacgaaatgagaaaacctatggaggcaaagaagattgggtgaggatgaaggagaagcccatgcatgtgactgccaaattcctaatacagcacaagtcttcccaccaaccaacaatggttattagctcagccaataacaaaccttctccttacccaccgcccaatgtggtactccacaaaggcaaatccctaaactctgagccacaacctctatgtctgtctactgcatttccaatggggaactga

SEQ ID NO: 31852 - DNA, 351 bp, Glycine max
  Peptide Sequence Number=SeqID_123537
atggtgaaagttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtccctccctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 31853 - DNA, 441 bp, Glycine max
  Peptide Sequence Number=SeqID_123538
atgactggaattcgattattcgagttcattgatgctcgtttcgcatggtctgccaaagggggagaaaatggtactcaacttagaaatcagacggtaatttatgtcatcatcaaaaagggggagattgtagatgcaattggctttgatgttttcaccgagatcgtcatgatcgatgggcaattggtcggtaatgcaaaggctttcaagattaaaattacgggccaagacactcttccttatccacatttgattactctgtttttgcgtcattttcaaattccgcttgatgatgaaccttttgttcaagtcaagcgttcctttgcaattggtgctggtgcagtgacctcctttgggtatcgtaaagatcggaatggacaatggctgaagaaggatgcactccctcctcaagatgaacgtactccttcactcccctcaacgtga

SEQ ID NO: 31854 - DNA, 519 bp, Glycine max
  Peptide Sequence Number=SeqID_123539
atgagaaagcgcacgcttcccgaagggagaaaggcggacaggtatccggtaagcggcagggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgagattggcccaaggcccaggcaggggaggcacctgcaggagctcccggtgatgcagaggaggcccgtatggatgaagagatgacagacttgctcggtttcttgggaggaagcggagccatgtga

SEQ ID NO: 31855 - DNA, 204 bp, Glycine max
  Peptide Sequence Number=SeqID_123540
gctaataacattctaatggcttttaatctagcaactggagcatgtggaagcaatgacttccaagattattttgatgatgccaaagaatcaagagttaagcaagttccaaagagtcaggagtcaaaaagcttcaagaatcaagtttcaaagaatcaagattcaagaacaatcaagtttcaagaatcaagattcaagaaccaataa

SEQ ID NO: 31856 - DNA, 461 bp, Glycine max
  Peptide Sequence Number=SeqID_123541
atggtggaagagtttgaagagatcctgggatgccctctagggggaagaaaaccatatctcttctcgggattctatccctccttagctagaatttctaaaatagtcaaaatcttgacacaggaattggaccgcgggaagcaagttgaaaatgaggtggtaggggtaccaaggaaattttcggaagcaaaggcgaaagtcttggcaagtcaagacgaatgggccccgttcatggataccttgcctgtattttactatgagaaattagtgggctacatgccttccagcttcgcggacttggtcttcgccggagaaaggatcgaggtgggtttgaagagggaaaagtttgattacgtctccccgataggtgccaacaataggaggaccggaatagctggggcaaagaagaaagagagagatgcccataccgtcacttcacacatgcatggcccaagccacccacg

SEQ ID NO: 31857 - DNA, 433 bp, Glycine max
  Peptide Sequence Number=SeqID_123542
atgacggtgaaaacctctgacacatgcagctccgggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaacatattgagttaaagttggcctctcatgggaggaaggtagagaaatttggaaggcttgcacgtgaaattgaagggatcgcctttcatgccttcgatgctcttgatgtagaccaagtcatggacttgttagttgagggtaccgagctcgaattcgtaatcatggtcatagctgtttcct

SEQ ID NO: 31858 - DNA, 75 bp, Glycine max
  Peptide Sequence Number=SeqID_123543
aatgatttttcgatattcgatttgaatctaaaaacacaaaaagaattggttttacaggatagaatgaaaacccac

SEQ ID NO: 31859 - DNA, 399 bp, Glycine max
  Peptide Sequence Number=SeqID_123544
atgaagattgttatctctattccactaataaattgtgattttactgaaggaggacattaccaggatagttattatttctattctataaataaatccgactggagacaagagttgaccatgtacaattatcatgagaaaggaagagctcctaatcttgaaagtgtattggcagactttatgacatatcaagctagctctaaaggtgatggctattcaatgcaccagcaggaaactcagtttgaaaaggactattctttggcagattatcaatgggattcagaatggcaaccttattatcacaatgaagcagaagggttgtctaatctggatgacctgttaatgcaattcaagggtacagtagatttaatgcaacaagcatttaaaagagctgagacttag

SEQ ID NO: 31860 - DNA, 333 bp, Glycine max
  Peptide Sequence Number=SeqID_123545
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccagcttctatggagggtgaatctttgagcttcaacgaggggaagaggtgtcatccactagggaataaggagcttcaccaccaacagaatgccttggataagaagcttagagaggaagctccaatggagaaaaataatgagagagaggaagcatga

SEQ ID NO: 31861 - DNA, 331 bp, Glycine max
  Peptide Sequence Number=SeqID_123546
accacctggtgctgagagaccagtggtccgtgtagatcctgctaccggcaaggtcgacggtccccacaggaagaaattaagaacatatttggggattgtggcacgtgataaggtggacgtcacctacgagaactggaaggaggtccctactgctcaaaaggacctgatttgggaggatattcatgcggaatttgaaattccaaaggcttctgatagtaggacgaaaaggaagttacttcagaccgtgggggagagatggagagacccttcttgggagccgaagctcttggctgagaagaccaagaagaagctggaggaagttgtacagtaa

SEQ ID NO: 31862 - DNA, 337 bp, Glycine max
  Peptide Sequence Number=SeqID_123547
ggatacaatgtccagattcatgagctccaccacaaattgtacatcctgcaacctgcaaaatggaagaatgtgaagtttatgcagaatgaagctgagttggcaacttacttagtgtttctattagtgtctctagttgcttggacaacaacttgttttgtgccaacagagcatcttgtgaggaacccttcaaccgaagcagaatttccaacttggcttgcggtttcggtagagaacgaaaaccctaatctgatctttcgttttctttcgaggcttgtatggatgtgtacaagcaaggacaaaaaggaatcttcaagtgacgcgacgaggaatccgtggg

SEQ ID NO: 31863 - DNA, 311 bp, Glycine max
  Peptide Sequence Number=SeqID_123548
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggaaggcagttcgctccaagctggactgtatgcacgaaccccccgttcagtccgaccgctgcgccttatccgtcatgcgccggttaaggctaaactgaaaggacaagttttggtgactgcgctcctccaagccag

SEQ ID NO: 31864 - DNA, 258 bp, Glycine max
  Peptide Sequence Number=SeqID_123549
atgtttgtgtgggagccttacacagcaactgttatatcattgttgcctcccatttgtgtagtcagaagtgtcgcgtggtgcgcggtggtgccactagtttgtttccaagttattgagtggcaccaaccggatagagtattgagacaatttgggatgcagcaaccaattccagagtctcctgcgcaacccttaaacattcatggcataacactaaaagggaaatatgacgaaaattggggcaactgttcgtcccaatga

SEQ ID NO: 31865 - DNA, 618 bp, Glycine max
  Peptide Sequence Number=SeqID_123550
atggagacgtgtttgggagtagaggagttgttacagcggatgatagatcaaggtcgactggaagtcggcagtgaaggaaaagaagagcagcatatatgcatgcagtccacggatgggagcagtgttgcgaagtccaaacccttggtgatatgcttcaccaaaagcgtagcttcgcaaaagcccggacaccccttagtagccaaacctgttcctttcccataccaaagtagccacacagtaccatggagatatacacctccgagggagaaggaagaagaagccatcgacgacagctcgttgtcagctaaagtaacaaatatcacgggattgagtggtgtgacccgtagtggtcgtgtgttcgtgcctccggacctaccagtccaacccgcggacgtcaagggaaaaggaaaagtggtggaggaacaagatggcgaagcaccccacgcttcgaataaagatattccggcaaagggcctcccggagaaaaaggatggtaaaaaggaggtgtcgctagaggaagccagtgagttcctccggataattcagcagagcaaattcaaggttatcgaacagctcaacaaaactcggccagggtctcgctgttggagttacttatga

SEQ ID NO: 31866 - DNA, 438 bp, Glycine max
  Peptide Sequence Number=SeqID_123551
atgaatcgaaaagctggttcgaagtactaccgtgagatcgagacgatgagacgaatgagacgtcgaagaacggttgaaacctttgcgagattcctcacggaaaacgttacggaaacgtttcggaagcgcctcggcttagattttcttcacggaaacaatttttccaagcaaattcaacagagagagaagtgcctaaggggctggaccatttccttcttcccttcctcccctatttatagcaaaataggggaggtggttgccgcccagctcgcccaggcgagctcagctcgcccaggcgagcagggttgcttcctccagaagcaaccgccttctggaggaatcttctggagggcccaaatgggcctgggtgctatttgcacccccatttttactaagtacaccccctctgctgtttttttggtgattcttttttcgtaa

SEQ ID NO: 31867 - DNA, 504 bp, Glycine max
  Peptide Sequence Number=SeqID_123552
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggttgtgaagagggttacaacatatggcgcagttcatgagatcagacaattgcagatgttgttgaggcatctaacaagcaatcttacatttcaagaagcatatgacatgacaggtcgaattcttgggattacagtttgttccccaagaaagcatgaaccacctagatgtcttaactacttgacttcacctcatgttgtaatatggagcgcagttactgcttcttgtgcctttcctggccttttcgaggctcaggaattgatgggtaccgagctcgaattcgtaatcatggtcatagctgtttcctgtgtgaaattgttatccgctcacaattccacacaacatacgagccggaagcataaagtgtaa

SEQ ID NO: 31868 - DNA, 237 bp, Glycine max
  Peptide Sequence Number=SeqID_123553
atggtgctgagcttcttcttgactcatcttctccttgaattggcatatccaatcatcttcttctccattctgctaccattcatcttcaagaagcaaaggaatccattgatgaagaataatcaaggtctacaagctccacatggagctacatcatgtggtatcaagaacatcttcatccaggtgaaagggaagtgtcttttgttcctctatctttttgttctggtcaattcactttaa

SEQ ID NO: 31869 - DNA, 291 bp, Glycine max
  Peptide Sequence Number=SeqID_123554
atggcttttctgtcacaattgaaattgagattcagaacagacattatggagaaaagaaaaaagttcagctcagaggcttcttactccattttcaaagagctttcttctcgttttccactttttcctgcagcattgtctctggttcgtgggggtagcaaggttgagtgcagcggtgaaggtgaagtttccggtgtgaagctttgcggtggtcggtgtcggcaaacaaggtacgcagatggcgtttgtgcgtcgcggacgtacggatggcttccggatcaagttgatccgtaa

SEQ ID NO: 31870 - DNA, 201 bp, Glycine max
  Peptide Sequence Number=SeqID_123555
atgaagggtaggacgtcaacttctagctttcaaatgaacacgcaggggaaacatggggctaagctgaacataaatcactcatggtgtataaaactcacaaggcaagattttctcgaggtcagcgtttttggagaggaagctgggtgtttcggtcttttcctctttgttcatgtggggtgggatattgccagtcaagaatga

SEQ ID NO: 31871 - DNA, 291 bp, Glycine max
  Peptide Sequence Number=SeqID_123556
atggcttacactcacattccggattcaacaagcgattctcctcaaatttcagccagcccgtatcaattagaccttgcaccttacgcttcagagccctacaatgctcaaaggaacgccccggggcttctccgcgacaagcacacgttgcgttcgagtcgtattctcggagaaatggaggttgatgaaccttggctagggttatggctaccattgaattatcaggtggtgttcgtcattggaagtgcggtagacagactttgtggtagatttagggatggcctttgtggataa

SEQ ID NO: 31872 - DNA, 299 bp, Glycine max
  Peptide Sequence Number=SeqID_123557
gatatgtaggggtgcaaatagccccgccccttggcctccgaccaccccaagagatcggtgttcatggaggaagccttaacgtttctgctcgctggttcaaaaacaagatgactcgcttgggcgatggtcgcaacgccttaactttctccccatttgctaaaatcagggaaaagaagtttaagagtcccgaggcgcttccgaaacgtttccgtaacgttttccgtgaggaatctcgcaaaggtttgaaccgttcttcgacgttcttcattcgttcttcatcgttcttcgatcttcaacgg

SEQ ID NO: 31873 - DNA, 346 bp, Glycine max
  Peptide Sequence Number=SeqID_123558
tatgttccaagagtgggctgtcgccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaatgccggaaggtcaaaggaagttggtgacctgatgaattcaggggagccgacgaccgaagccccggtgaacggcggccgtaactataacggtcctaaggtagcgaaattccttgtcgggcactatcccttttcattgcaactctggacaacatga

SEQ ID NO: 31874 - DNA, 321 bp, Glycine max
  Peptide Sequence Number=SeqID_123559
gttctatcaagtcaaggtcaagagcctagggatcaccagtctaaaagagttagggcagttgatgggtcagccccagcgacaagcttttcgtaaaacttacgataaaatctgggacctagccatggtagaagtctccacagaggccattgcctccctcgcccagtattatgatcagccgttgaggtgcttcacctttggggacttccagcttcacccatggagcttggcaggtgaggcaaatggccccgtgatcatgctaggcactcttgcgacttgcttgatcttcggagtgaatcctctttcctttgaaaatgtggatgg

SEQ ID NO: 31875 - DNA, 1446 bp, Glycine max
  Peptide Sequence Number=SeqID_123560
atgaaaaccattgtggcttcttacaacatcactccaaatcaaccaactccaaaggaccctttatggctatccgatagtgaccaaatcggggtcctaggtcatgtatccattctctacatttacagatcagcaaaagaacacaacaacaacaccgttgagaggatgaagaactctcttagcaagcttctatcgtactactatccagtagctggcaggttaaggttgtcaaaaagtggtcgaatggaattggattgcaacgcaaagggagtgacattgcttgaagccgaaaccacaaacacatttgttgattatggagacgacttttcaccgtccgagttcaccgatgaactcattccaaaacttgatgatactcaacaacctatagaggagattcccctactgctggtgcaattaacaaggttccatagtggtggtgattgtgaaggccttgccattggagttcttctatctcatcctttgaccgatgccaccggcatcattgacttcatgaacagatgggcaaagctgtctcggggagaagaactagaccctaatgaaatcccgtttcttgatcgaacactactcaaattcccagacattttgttggagaaaccgagggaagtaaatactagagagattagtaaacttgacaccagtacacttcaacatattccaacatcaaaactgttagatcagtggaagaagcctgtggtgccacaaacaccagaagatgatgggatagataagccaaagaagagaagtggtgcaatgctaaaactcacatcaagccaggtggagaggctaaagaataaggctatggctaataaccatcaatcttcaaaacaagggtcaagacctaattatagcagatttgaagttgttgctgctcatatatggaggtgtgcatctaaggctcttggtgatgacctaactcaagttcggttcagtgttaattttcgcaatagaatgaacccacctctccctcataactattttggcaatgctgtggcaaacgtagccacacctgagggagatatcatatcaaacccattaggttttgctgctcataagataagggaagcatctcatgcagtcacggacgagtttgtaaagtcacaattaaacgttagtcgtttaggccaagtgcaattggataacataagggctttcttcatgcgacaaggacaccgtgtgaatatcccttatgctttgaatcataatgttttgttcctcacaagcttcactaacatgccagtgtatgaatcagattttggttggggaaagccagtgcattttggcttagcaagtagatctccagcagatagggctgcaattcttccaagcccagatggagatggtgttattgtagccttattttttcagacagcacttatgcagcttttcaaaaattacttttatgaggatatgtatttatccttgttatag

SEQ ID NO: 31876 - DNA, 156 bp, Glycine max
  Peptide Sequence Number=SeqID_123561
actcatcttctccttgaagtggcgtctcctctctctcttccttctccattctgttaccattcatcttccaagaagcaaaggaatccattgatgaagaagattctaggtctacaagctccaatggagcttacatcaactaaacccctcaattactag

SEQ ID NO: 31877 - DNA, 541 bp, Glycine max
  Peptide Sequence Number=SeqID_123562
atgggtgatcaagaggagacacaggaacagatgaaagtcgacatgtcggctctgaaagaacaaatggcttctatgatggaggccatgttaggaatgaggcaactcatggagaagaacgtggccaccgctgccgctgtcagaaggaacacactggggcacaacaacaacccccatttgggatacaaccgagcggcttacccttatggattgccacctaattacttgccaccagtcatgcaagatgatgcgggtcatatctcttctcccatccttgaaagggagcctcctcaacagcccgaagaggtccacgaagatcctcaagactatgcccgaagggatgtcgagttctatcccccgatccccgaggggtcggcacccaacacgttgcctcaacccaacctcacggcacatccaatagttttgtccacggaagaaccgcccccggcaactgaagaaaggaggaaactcgatctccttgaggagagattgagggccgtggaaggatttggtgactatccgttcgcagacatgacggatctct

SEQ ID NO: 31878 - DNA, 306 bp, Glycine max
  Peptide Sequence Number=SeqID_123563
atggacaccccaagaaaccagctactctcacatgtctatcctccaaagaagatgaagtcagaatatggcatcaaagatagaaagagcaaaggagaaagaagtggcagagtgatgcactactgtggcaagtattcctgggatactctacataacagccctagagtatataggctattcaattctacatggcaaccagaacagtcaatggaactcaatgtggttgttgatgtagtctccagcaagaaagaagagatgtgggtccaaagaagactgttcagtcttgtgtcaacatcggggacaatgtag

SEQ ID NO: 31879 - DNA, 189 bp, Glycine max
  Peptide Sequence Number=SeqID_123564
taccctcgtctccagaggactatacgtcctcaccttcagagggctacacgtcctcaccttgagaggactacacgtcctcgccttgagaggactacacgtcctcactatcagagggcagcacgccctcacctacaaaggactacatgtcctcgccttgagagggctacacgccctcaccttgggtactag

SEQ ID NO: 31880 - DNA, 369 bp, Glycine max
  Peptide Sequence Number=SeqID_123565
atgatgctaaaggatcaagtgcttctaagttttattcaagacaagaatccaagaaaatcaagatatatgatcaagttgatctctagaatcttaggaagaagtttccaaactgaagaagcaaaaggtttgaccaaggaattctatcctttcaaattgagatttgctctctggattaagagactgagagtccttattgtaaagagggaaattcatgcaacccaaggaagaactggttgtattttgatcgtatgttccttgagtcatgcacggtgcccctcattccccagtgttaagggtgctttgaggtaccaaatcgttgcctttcgtcatgaccttgtaggagggaacctattgggtgagaacttctaa

SEQ ID NO: 31881 - DNA, 765 bp, Glycine max
  Peptide Sequence Number=SeqID_123566
atggcagaatcatccaagaagcgcaaggtttcatccacctccactgcggcacatagaacatcacgtcccggagccaccggagcatcccaggcaccaattccaccatccttgtcatcctctacactgttttcatcttatgaacagcgtatccggaactcctctatctttcaatctcatcaaattcttgatcccaaatatctagacctagaattctttgatggagaaacatttgattgctatcaagtgtttcaaaacactggtttgattccttttatgtcattaaaattaccatatccagagctagtacgagtcttttactcaaatttgaaaattcaggatggaactttaatttttgaggtgcatggtatccctatgattattgatgagtctcttttcttttctctgacacaactacctagtcagggtgcaccttttgagggtacccttgttgaccaatggaagtttgattactccagccatgatgctcgccgcatggtctgcattgaccaagcggatatggccaacagactgcttgtcgggtcattgacatttgattgtcgcatcatgcactatatcattgttagaattttgatgccttgttcttctaatcttgctcaagcctctgaggaggacttgattctgatgtgggatttcttgaccggtcatccaatcgaatgggcccatttgattcattactgcatgcataaggcattacggtctagtgcacctctaccttaccctcagcttgtgactttgtttctttga

SEQ ID NO: 31882 - DNA, 471 bp, Glycine max
  Peptide Sequence Number=SeqID_123567
atgtcttggaagaggacacattacttctcaatgcccaccaagaaaaccatgattatgaggggccaggacatttatagtagccaagatagagctactatttcaccttcttctagtgaaagtgaagaagcaaaaggggaagaatctagtgaagaaatctacccccaagaagaaggacaacctttaatggttaaggacgagtgtaaggaggtaagtgtctcttccaagaggttagttaagatggaaagtcattttgcaataaagacaaacattaaagaaacttcccctcttagacaacctccacatcttctcctttgtaaaaagacacttgttagcactgccatacctcttgggtttgaggttattgctcaagtaaaggagttgttgtataggggtttggttcataagagcttaaatccttgtgctctgttggtgcccaaaataggaataatcaacatgaaaatacataaaaag

SEQ ID NO: 31883 - DNA, 468 bp, Glycine max
  Peptide Sequence Number=SeqID_123568
atggacactctttgctcacacagagtgctcttggatgcaatacgtgacttgacacagagtaggacttacgcttggggcaatactacacttgtgcataagcatgataatttaaatgaggcctcaaagagcaggacgaggttgtttgcaggatatatcagtctgttacagtgttggatctacgagcatttctcgtctattggttccaccatagatgccgatgattatgacgagcggagaccacatgcatgtcgatggacctctggcaaggcattacccgtgtcaacgtatgattacatggagtggttctacatgatttcacatccatttatgactccggcacaaccagaggatcctcctagagtttcgtcgattcagcaatatgacacatttgttgaactagatgtgactcaacaaccagtggtggcagcgacacctgatgaactagacgttgatgtgcatcatccttga

SEQ ID NO: 31884 - DNA, 273 bp, Glycine max
  Peptide Sequence Number=SeqID_123569
atgggggataagcttcatcgtcgagagggaaacagcccggatcaccagctaaggcccctaaatgaccgctcagtgataaaggaggtaggggtgcagagacaaccaggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaaccttgcaaggctaa

SEQ ID NO: 31885 - DNA, 219 bp, Glycine max
  Peptide Sequence Number=SeqID_123570
atgcctataggttggacctcccaaaagagtggagctaatactgaggaggaggaaccaacagatttgagttccaatcctcttcaagggggaggggatgatgcaatcctccctaggaagggaccagtcactagagccatgaataagaggctccaagaggattgggctagagctgctgaagaaggccctagggttttcatgaacctcatggtagatttctaa

SEQ ID NO: 31886 - DNA, 189 bp, Glycine max
  Peptide Sequence Number=SeqID_123571
atggggctaaaggcagaaaccgatcaaggtaaaatggtaacgcggccgcagtttgctacgcgatgtcgtttcctactttcaggtagtggccttaggcctaagttgtattctgaaaagattgggcatgccacattgcccccattcccttgctattcaatcctaaacatgcgcccaccaagtgctcggtga

SEQ ID NO: 31887 - DNA, 288 bp, Glycine max
  Peptide Sequence Number=SeqID_123572
atgttgaagaacggtcgagaatcttcgcgtaattactcacggaacgttacagaaacgttacggaagcgcctcggcttggattttcttcacggaaataattttcctcagcaatttcgagagaatgagaagtgccaagaaggcagaaccccttctcccttcactcctccccctatttatagcaaaataggggaggagcttgccacccagctcggccaggcgagctcagctcgcccaggcgagcaaggttgcttcctccagaagcaacagccttctggaggaagaatctag

SEQ ID NO: 31888 - DNA, 63 bp, Glycine max
  Peptide Sequence Number=SeqID_123573
atgacagcatcgttgtgtaaaggcgtaatgccagagaatcattacgcagggcatagaggggag

SEQ ID NO: 31889 - DNA, 207 bp, Glycine max
  Peptide Sequence Number=SeqID_123574
atgaaccattcgttaaggtcaaacgatcatttgctattggttctggtgttgttgcctccattggataccgaaaggatgtggatggccaatgaggatcttcaggctttcgtcggtgatagttttgatgctatggaatcacgcatcacgcgtcttgaagatgacacgagcttcatttgtcgttgctttgatcctcttgcggatccttag

SEQ ID NO: 31890 - DNA, 378 bp, Glycine max
  Peptide Sequence Number=SeqID_123575
atggattccatgatggaggccatgttgggaatgaggcaactcatggagaaaaacgtggccaccgctgccgttgttagttcggctgccgaagtagacccaactctcctagctaccacgcaccatcctcccccaaacgcagtaggacgagagaagagcacacaggggcacaacaacaactcccatggagggaagggacgatcgcggggtggcggacagagtcatgcccaagtgtactggaaaatgttgaggttctaccctgaccccgtcgaaggggatcgacctcgacacattcctcaagcaggcaacctcacatgtggcacaggaccaatattgctctgtaccttgaacgggagtcaaggaccacttccctgttgctag

SEQ ID NO: 31891 - DNA, 318 bp, Glycine max
  Peptide Sequence Number=SeqID_123576
atgagacaaaatttggtcattctgcaccctttgtcatccagaggcggcgggcccgatgacacgcagagacaaaatttggtcattccgcacccctttgccattcagacacagtcgtgtccgatgagacaaaatttggtcattctgcaccctttgtcatccagaggcggcgggcccgatgacacgcagagacaaaatttggtcattttccgcactcacaagatctgtcatactgactttggagtcacgctgacgggcggaaatacccgagtggttatccgtataaacattcttttgctatctgtaagacagaacgcttga

SEQ ID NO: 31892 - DNA, 360 bp, Glycine max
  Peptide Sequence Number=SeqID_123577
atgctgaagatgggagattcagctaaagttgtgatcaaacaagacatgaagggaagaaggcataaatatgggtttaacaacaatgaacgtgagaaggcacaaaagaaaagggtggtggatgatgaaactgccgacaaacatcagctggatgaaatcatgggttctccacctgcctccactactcctcctcctcttcctcctcctcctccttctcctcctcctcctcctcctacttcggacgcatcggcttcgacgtctgccgtgaagcggacacacaaagcctcacgcctacgatcgttgtccactagaccacctggtgttgagagaccagtggtgcatgttgatcctgctacaggaaag

SEQ ID NO: 31893 - DNA, 159 bp, Glycine max
  Peptide Sequence Number=SeqID_123578
atgaagcctccaatccttccttcacggtttcttcgagattgttgttgtatgaggtttatgttgcttgaagacctgagaaatgtgaatctcggtcatgaatttatatggggtgtagtgatcatgttggatatccctagagggggaaatcgagtgttttaa

SEQ ID NO: 31894 - DNA, 450 bp, Glycine max
  Peptide Sequence Number=SeqID_123579
atgccaggtgccaacttgttggcaatgggttcctcatcagattctacatcttcgaggtcaatgaggtcacctggagcagggagggcttcagcatttggagcggaagatgttggaacatctttatcaacatcaggcacagaaacatttggggtggaagatgttgggacatcttcatcagcttcagggacagacgcatttttcagaatgttgctcacaatactgcggattttcttgtccatctccgtgtctacttccctaggacttgttgcaaggctagggttttcagaaattttcacaccctgttgtcgtttgggaaccagtttttcaggaacaggggctgaaccaggaatcatttgtatgggttggatatggaattcaggttgttcctggattgatggcgctttggtggatgatggggatgatggtacagagggtgaggggatcctctag

SEQ ID NO: 31895 - DNA, 537 bp, Glycine max
  Peptide Sequence Number=SeqID_123580
atgaggacacgtagccctctaaaggtgagggcgtgcagcgctctcaaggcgaggatgtgtagtcctctagaggtgggggcgtgcagccctctgttggcgaggacgtgtagtcctctcaaggtgagggcgtgcagctctctgttggcgaggacgtgtagtcctctcaaggtgagggcgtacagctctctgttgacgaggacatgtagtcctctaaaggtgagggcgtgtagcccttcgaaggtggggacatgcagtcctctgatggcgagggcgtgtagccctctgaaggtgaggacatgcagtcctctgagggcgtgtagccctacgaaggtgaggacatgcagtcctctgatggcgagggcgtgtagccctctgaaggtgaggacgtgtggtcctctaaaggtgagggcgtgcagccctacgaaggtgaggacatgcagtcctctgatggcgagggcggttagtcctatgatggcaaggacgtgcaatcctctgaaggtgagggcatggccccctttgaaaatggggaacatgtag

SEQ ID NO: 31896 - DNA, 507 bp, Glycine max
  Peptide Sequence Number=SeqID_123581
atgtggcgacatctagacgattcatctgccagttgctgcaggcaacatgcatggtctctcgtggtgaaggcgaaagtgacgaatgtctgtttcatctcggggaatcacacggcatggaaacctgccccgcggtggaagagttacttcaacagctcatggactgggggcagctcgaagtgtccaagtacccccccgacagcgcccaagccaacgtcgttttcctatcaaagcaataaggccgttccatggaagtatacccctcccgcttttggagaaagagctgcaaccgaggttttgttagccaaggtgaccaacatcaccggccttagtgacgtaacccgcagttgtcgggtgtttgctccccctcactcggcggaatttccctccaaggggaaagcacccatgatccaagagcccgcagatgtggccaccccctcaaaagaagtggatcccccgatggtaaaaggagctgaaaagaaagaaggtcttcaaggggggatcctctag

SEQ ID NO: 31897 - DNA, 135 bp, Glycine max
  Peptide Sequence Number=SeqID_123582
ttgtgagctatgaattgtacaatcacacgactataagaccctttaagggtgaagagttaatgctaagacccttcaaggacgacgagttaatgttaaaaccctttaagggcgacgagttaatgcgcgaagagtatg

SEQ ID NO: 31898 - DNA, 585 bp, Glycine max
  Peptide Sequence Number=SeqID_123583
atgttgggtcatacgcaggatcgttgcttcaagttgcatggttatcctccaaattataaaaggactagtttttccttagaagtcaagaaacattcttcatcttctgaaccaccacacaaggttgctcaacaagtatctgttgatatgtctgactcaccatcttcctctggtgactcgggttcccaatttcaacttactgcccatcaatatagccaattgatgaatcttttagaaagtcatgctaccaatgttgtcatccctcaaggtgtttcttctgccagtgattctggtgccagcattcatatttcttgttcccttcatcattttcagtcttaccaacttgtttttgataaaattgtcactctgcctaacaatgatgttatacctatcattgccattggttcggagaagccagcttgcaagaggattggtagaggggctctcatccaaggcctttatgtcttagatctcaaggacactcttgattgcaaatttacttttcctgttatcaattctcatacaaattccattccttgtaaaaatgctcatatttggcattctagatctggtcatatctcagataaa

SEQ ID NO: 31899 - DNA, 315 bp, Glycine max
  Peptide Sequence Number=SeqID_123584
atggcttcctatggtgtgagcttgttcttgactcatcttctccttgaagtggcatctctaatcatctttctccctttctccattccacttccattgatctttaagaagaaaaggactccattgatgacgaaaatccaaggcctaaaagctccacatggagctacatcatgtgatacatttgttcacgtattcttgcaattattatggggatcctctagagtcgacctcattgcaggcacaaaatttcgtgctccttctctccctctccctcactcatcttctcttcttcaagctctatccatggctacctatggt

SEQ ID NO: 31900 - DNA, 333 bp, Glycine max
  Peptide Sequence Number=SeqID_123585
atggaatttggtgatattgttgttcattttaacattcttgatgccatgaaacatccatttgaggatcattctgttcttcgtgctgagatacttgatcaaattgttgatgattatatgtttgattttgattctcttcatgagtcagaatgcactaaccatcttgcaagaagtacatacacttctgacttgctttatgaggtacaggctgagggaccttcctcttcttctcctaccttggttcctcccactgttcagctaccatccacaccagagttgaagcccttaccagtaaacctcagtatgcttacttggagacaggaaaagtttcagtga

SEQ ID NO: 31901 - DNA, 645 bp, Glycine max
  Peptide Sequence Number=SeqID_123586
atgaaatcatccaactctagctatggtaggcaacaaactttcttgggaagtacgggcggcccccattatgcgcaaagtcaaaacaagcatgccttcacgccatatggcttgcctcccaatcttatacaccactccaatgtagcgtacactccgcagtggaatgtcaataactccactcctatactcattgagagccgacaaccccaaactgatcatgcacatgtctctcaacccgtgggagagacatatgaaattccccatcacagtctagccgacttcgagccttggctcggatatgccactgaagggcaagcagttggtggtataccccttgaaaacacttcggaaggccctcagtatcacccccagctacacctcttgcattccacaacaagtaaaaaccctcatgctatggcagaaatgggaaagttggatcatctagaggaaaggctcagggccattgaaagaggtgaagattatgcctttgataacctaaaaaagttgttcctagaacccaatatcatcacccctcccaagttcaaggtgttggactttgacaagtacaaggggactacttgccccaagaactatctaaagatgtattatcggagatgggggcatgcgcaaaagatgaggaattactga

SEQ ID NO: 31902 - DNA, 318 bp, Glycine max
  Peptide Sequence Number=SeqID_123587
atggacaagaaaatacgcagcattgtgagtagcatcttgaaagacgcctctgttcctgaagctgatgaagatgtcccaacatcgtccaacccaaatgtttctgtgcctgatgtcaagaaagatgttccaacatcttccgctccaaatgctgaagcactcccttcacccagtgaagagggatcaactgaggaagatgatcaagccgcagaggagatcctcccaagggcaccagaacctgctccaggttggcccgtattggagctgattgctgagaaaggttacaaagcagatgacagggaaaagcacttcccctggtaa

SEQ ID NO: 31903 - DNA, 1041 bp, Glycine max
  Peptide Sequence Number=SeqID_123588
atgggtcaacttcaacagcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctggttctatccctccacgacaagagttgccaaggaaagggcaaaggccttggaaaatcaaggcgaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcgacgcaagaattttttgttgtgcactggctctctatgtgtggctggtttcatacccttttctccaagaaggaaggaagaatcaggattctatcttcatgcgaaggatgtccaaatgttcccttgatggaacaaggggttgtattaattataatcccgtccttgccataagacagcttggctaccccatgagaggagtgccatcagatgaaagcatcacgcctttcatcgcacggggtttcagtgaccacaacgcgagggacagagagcttaggggaagcagtaatgggatcatcggcggctatcataagtggctgagagtccgaacacaaggattggattggctcccaaatctaaagactgtgagagacgatgaggttaaagcttcgaaagaaagtgatgaggtacaagccctaaaggcagatcttaaaagagcccgggtagtcgaagagaagttcaagtccatagccatcaaaggcagcaatagtaagctcaagctccgaagaggtgaacggcaatcatcacgggtcaaaggcatgatcttgaaggacgagctaaaagctttaccttag

SEQ ID NO: 31904 - DNA, 927 bp, Glycine max
  Peptide Sequence Number=SeqID_123589
gcccttggtgacctcagtatgacagagaggtacgcttggggagtggctgctttggtttatatgtacgaccatctgaacgatgcatctatgagccacagccgacagcttggcggttacatcacactgctgcagtgctggatttatgagcactttccctcggtcgcggagtccactgctgatcaggactacggcgaggcttctccacgtgcgtgcaagtggattgcaacgaagaagaccgtgaagagcattcacacgccatcgtacagggagtgcctggaccggctccagattttggatgtctgttggttcccttatggggagcatcgggaggtccgggacttccacgtcagatcatgctattccggtctcttgcgctgggggcctgttgctgtttattaccgactggagaggggcgtgcgacagtttggctacacgcagaccattcctgctcctcctgtcgattcatgggtctcgtatgatgatatacacgacaggtggatgcactacgagaatcatatcgtacctgcaggtgaggtgtgcgttgtgccaggggcgtgttccagtgactacatcgactggttcttccgcatctcccatcctttcatgacaccaggccacgcattagatcctctgcctcatggtcacgccccgcagccccgagtcgtccctcaggccccgcagacggatatccctcgcgtgttggagccaggagcatcgtcgacatctgcggaggagcccagacatgcagtggaagtttgtgatgacattgctgagaggttggagcgccatctgagtctaggggtggtcacgtctggctcatcgacacatgaagtgatcgaagaatgcctcaaattggccaggagtgtgacacaggaccatttagtatacgttaggtgtagacgtaggcgacacactgatcaggcgtag

SEQ ID NO: 31905 - DNA, 54 bp, Glycine max
  Peptide Sequence Number=SeqID_123590
atttcttcacttggattcttcccctttgctatcttcaatgctttcctatgcggg

SEQ ID NO: 31906 - DNA, 365 bp, Glycine max
  Peptide Sequence Number=SeqID_123591
atgaaatggaccactacgaaggtacatcagaagaatcgaaggaagcttaaaaggttcaagaggtacaattactccgtgaagatgaagaacgagaagaacgaagaagaacgtcgaagaacggtaaattttcgcgaagggacctcagcaaaggaaaacccatttttggtgtctcttgctttcagattgcccttctcgactggcgatatcccacctgtcgcaacctactcttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaag

SEQ ID NO: 31907 - DNA, 453 bp, Glycine max
  Peptide Sequence Number=SeqID_123592
atgactagaggcaatccatctgacttacaaccctttgatcctgagatagataggacatttcatagattagttaggcatcattttataccttttgatcattctgagcattccattactagtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatgtgttcttaaaactggactgattcatttgcttccaaagtttcatggccttgcaggtgaagacccgcacaaacatttgaaggaatttcatattgtctgctccaccatgaaaccggggatcctctag

SEQ ID NO: 31908 - DNA, 876 bp, Glycine max
  Peptide Sequence Number=SeqID_123593
atgattcctggtcaagcccctgttcctgaaaaactggttcccaaacgacaacagggagtgaagatttctgaaaaccctagccttgcaacaagtcctagggaagtagacacagagatggataagaagatccgcagtattgtgagtaacattctgaaaaatgcttctgtccctgatgctgataaagatcaaagaggaatcaacagaggaagaggatcaagccacagaggagaccctgcaccacgggcaccagaacctgctccaggtgacctcattgacctagaagaagtagaatctgatgaggaacccattgccaacaagttggcacctggcattgcagaaagattacaaagccgaaagggaaaaacccccattaagaggtctggacgaatcaagactatggcacagaagaagagcactccaatcactcctaccacatccagacggagcaaagttgccatcccttccaagaagaggaaagaaatttcctcatctgattctgatgatgatgtcgaactagatgttcccgacatcaagagggccaagacatcagggaaaaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcaaggctgctggactgctgaaaactgtcactaagttgggagactgctatgaaagtctagtcagggaattcattgtcaacattccctctgacataacaaacagaaagagtgatgagtatcaaagagtgtttgtcagaggaaaatgtgttagattctcccctgct

SEQ ID NO: 31909 - DNA, 528 bp, Glycine max
  Peptide Sequence Number=SeqID_123594
atgggtaacgaagagggagtgcaagaacagatgaaggccaacatgtcgactttaaaagatcagatggcttctatgatggaagccatgttaaaaattcaaaaatcaatagaagacaacgctatggcagccgctaccaacacaactagggaagcggaaccggtgctacagcctgcaatgaactctagccgggacagaagcacgacaggtttcaattggagacttcactccccgtaccgctacagacaatttgagctaagcccctaccttcaaggggcaactccctcctcatgccgactaccctctagaggaagacgacgagggagatgcccatttgggccctttacttcccccaagggagccgacacccatgagttgccctggccaaacataatccaccatgccccgtctcaatccgcacccgttagggaacccgttcccatttcaaaagacaaaggaaagatcaatctgcttgaagagaggttgagagcggtggaagacctcggcaactatcctttctcggagcagtag

SEQ ID NO: 31910 - DNA, 117 bp, Glycine max
  Peptide Sequence Number=SeqID_123595
atggggttgaatcaatttagattttcagcatggtccatgacatctttgtcaagaaatgggtttatgatcccaacatggttggctcatgaggaaaacgcaaagatcatgcatgagtaa

SEQ ID NO: 31911 - DNA, 126 bp, Glycine max
  Peptide Sequence Number=SeqID_123596
atggcttctgttgtctcctcctctgctggtgctggtgctggtggctcctcgatatcaggctcctgggctgcagaggctccaccccctccagaagaagagggatggtctcctggccaggccacctaa

SEQ ID NO: 31912 - DNA, 144 bp, Glycine max
  Peptide Sequence Number=SeqID_123597
atggagcacagggaactaatgttagcctgggttaagttcagaaatgaagcattgttgagagaacatcctaaattactaaaccttaatccctcgtcagaccgaatcaatccaagcttcgtcctcagatccctcttgttggactag

SEQ ID NO: 31913 - DNA, 330 bp, Glycine max
  Peptide Sequence Number=SeqID_123598
atgaaggcccaagtggagaaggatgaaggcccagaggcagagacactatcaagactattaattgttgctgaaggcccaagtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaaccttcgtagcctgtatcaaacgatccgctcctactcaggttcacatcatctggtatcagaggatgcaacgttgtgacccgtaa

SEQ ID NO: 31914 - DNA, 458 bp, Glycine max
  Peptide Sequence Number=SeqID_123599
ttatccagaactacgtaggtctgagttcctcattggaggatacgtaggagcaaaagcctcgcttttgtcgaccacactgctttctgttaccatgatccaagagctggccaatgtggtcatctgcgccctttccggagatgtcagcatcttccggtggagactttctcaagtctcacaagttatccagaactacgtagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacctttgtatcatccagaggcggcgggcccgatgatacgcggagataccttacggttatccgcacccttttgtcatccagaggcggcgggcccgatgacaagcagagaccaa

SEQ ID NO: 31915 - DNA, 333 bp, Glycine max
  Peptide Sequence Number=SeqID_123600
atggaccctccgttggtttgtttacagaggggatcaagacagaacccatatgcgatgcatatgcaaaagacgcaatacgggaattccccagtggagtcgccaactgtcgcaacctacccttcgacgggagggcgacgtgtgactcgcgggatgcgtgttccacgaaaggaatacgcgcggagtcgccaccaacgtttatttgaggaaaacgtcggaaaaaccggaaaagacgcgatctacgaacttttaagtgaaaggctcgagagttgtattttacgcgcggggaaggtattagcaccccacacgtccgtcacaagggacggcagcctttaa

SEQ ID NO: 31916 - DNA, 363 bp, Glycine max
  Peptide Sequence Number=SeqID_123601
atggcaaatatttacaatagacctcctcaacctcgagcagcaaaatgcaaccgattcagtagagcaattatgctctccagcaacagatacaaccctgatggaggaagtcaccatcagatgttcttcaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactggctgtattaccttgctccaaggtccatcacaagctgggatgaccttagagagtattcttag

SEQ ID NO: 31917 - DNA, 426 bp, Glycine max
  Peptide Sequence Number=SeqID_123602
gggcgggatcatcttgagctaccttctggggtagagacagaacatgaacagcagaaaccaatcaaggaacggatgcaagtgaggatggggtcacgaccgactgatcgtcgcccctttctccacactaagcaagcggagaacgtcgctgcaaggcagccccccctagggtcatcctttttcgcattttttgattccgttttgcgcttttgttcatcaccaacaagaatggccccgaggaagcttgcctcaaagaggtccaggaaggacaaggcggccgaaggaactatttccgctccggagtacgacagtcaccgctttaggagcgctgtacaccagcagtgcttcgaggccatcaagggatgggcgccggcggtgggcatcactggttactcccatggccaagttcgatccagaaatagtccttga

SEQ ID NO: 31918 - DNA, 251 bp, Glycine max
  Peptide Sequence Number=SeqID_123603
gcccacttgggccctctggaatattcctccagaaggcggttgcttctggaggaagcaaccctgctcgcctgggcgagctgggcggcaaccacctcccctattttgctataaataggggaggaagtgaagaagaaaaggccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 31919 - DNA, 312 bp, Glycine max
  Peptide Sequence Number=SeqID_123604
atgattcagttccatgagattgagagctttttaaagggtggaatgaatatcttgacggcacacagtcaagagtgggaacaagaattaagttctaactatcaatatgaagaagaaagaactcctaatcttgaaagtgtgtttgacgaattcatggcataccatgccagctcaaaagctaatcaaaactcaatgaaaaatcatgaaattcattttggtaagagctactcaatagaaaactttcacgtgggaccaaagttacaaccttcctatcaaaatgcagcaaaagaggatccaatatggataaattgttga

SEQ ID NO: 31920 - DNA, 638 bp, Glycine max
  Peptide Sequence Number=SeqID_123605
ctcacattcctactaaaaagagtttattggagctaacctcccatgatgcattgttgtcacaaaataagttgttgtctaagcaacttgaggcattgactgaaacactaagatgtaccatctgtgggggagctcatgaatttggacgttgtatccctattgaagaacaacccactcatgaagtcaattacatgggaaatcagcccataaacaattttgacgcaggaggattttctggattccaacatggccagcaatacaatcaacaacagggacaatggaggaaccaccctggtggaccatccacaaggccacaacaacaagggcctagtctctatgatcgcacaacaaagctggaagagactctagctcagttcatgcaggtttctatgtccaaccagaagggcacagagtctgccataaagaatctggaggtccaagtaggacaacttgcaaagcaactggcggatagatcatcaagcagttttacagctaatacagagaaaaatcccaaggaggagtgtaaagatgtgatgactagaagcataatggcaatccatgtggatgagagtgaagctggaaagaagatggaggaacataaacaacaattggcacctaagccagaacttgaaccattatga

SEQ ID NO: 31921 - DNA, 432 bp, Glycine max
  Peptide Sequence Number=SeqID_123606
atggtgagaagtatgggctataagttttatgacccaactttaagatcaatatttgaaacgggaaatgcaagatttcttgaggaagttgagtttgggaaggaagagaacataaggaaagttctctttgaggaaaaacctattattgacagttctcaagtccttatacctattgttgttcaagaaacaactccagtaatagaaaatagtgttcaaactattgttgatgacattgttcaagaacaagacaacgatgaggttcttcctcaaatacctatacaacaacctcaacaatctcaagaagtgccattaaggagatctgatagagagaggagaagtgcaatcgctgatgattatattatctttctccaagaacatgaggatggcattggtttagcagaggatgatccgattaacttgtcaagccatgcgtag

SEQ ID NO: 31922 - DNA, 566 bp, Glycine max
  Peptide Sequence Number=SeqID_123607
atggaagaggcagagaaagagatcttggaaacgtttagaaaagtagagctggccttgaatcagaagatctgtctaccctgttgcaagaagagtttcaacctggagcaattgagcagcctgaagcttattgctgcaaatatttacaatagacctcctcaacctcagcagcaaaatcaaccacagcagaacaattatgacctttccagcaacagatacaaccctggatggaggaatcaccctaacctcagatggtccagccctcagcaacaacaacagcagcctgctccttccttccaaaatgctgctggcccaagcagaccatacattcctccaccaatccaacaacaacaacaaccccagaaacaaccaacagttgaggcccctccacaaccttccctcgaagaacttgtgaggcgaatgactatgcagaacatgcagtttcaacaagagaccagagcctccattcagagcttaaccaatcagatgggacaattagctacccaattgaatcaacacagtcccagaattctgacagctgccttctcaagctgtccaaatcccaaaat

SEQ ID NO: 31923 - DNA, 1009 bp, Glycine max
  Peptide Sequence Number=SeqID_123608
taccagaagagttaggtctagccacggcccacgagcataggatcgcggacgagtatgctcaagtatacgcagaaaaagaggctagaggaagggtgatcgactctttacaccaagaggcaaccatgtggatggatcggtttgctattaccttgaacgggagtcaagaacttccccgcttgttagccaaggccaaggcgatggcggacacctactccgcccccgaagagattcatgggcttctcggctattggaaaaacaccataactaaacgcgccacaaggcatccctatcgcaccagatccaaatctagaacgatgggtgatcaagaggagacacaggaacagatgaaagccgacatgtcggctcttgcgggagaagaacaatcagttggtccccctgatggaaggccatatacgcggcaacattccgctgccgctgtcgagggctaccctcaaatggacggggaagcaccgacggaagaaagcatgtctcctttccttgtgagggatttcggcgcacaaaattccaagactatacaaagaatccataaggcgtgggaagccccgttaaagaaagatcaagagcttagaggcattcgtaatggcatcattggtgggtaccacgaatggctgaaagttcatatacgaggtttagattggctcgccaagttaaaagtcgtcagcaaagagagttttgaaacaccggaagaggacgaagaagtccaagctctcaaaagcgagttaggaaaggcaaaacttgccaaggagaagttcaagttggccgctacacacgttcggaaggagtgtgccgggttacgggaagagaatgcaattactgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaag

SEQ ID NO: 31924 - DNA, 622 bp, Glycine max
  Peptide Sequence Number=SeqID_123609
caacggtgtcatcgacgactatcataagtggttgaaggctaggacgcaagggataacttggctcccgaagctaaaaagtccatgtggggaagaaactaaagtccctgaggagagcaaagaagtgcaagccttgaaagcagagcttgaaagaatgagagtggtcaaggaaaagctaaagatgacagtcaccagggtcaggaaagagtgtgacaagctaagggatgtcaacatgactacgaccgaagcggatgagtcaagggtggagagtatgatattagaggataaattgaaggcttgtcaaaggtcaaagagaagtttgaccgaacagttgagtaggacaaaagagaatatgttgacaatcattgaccagtataaaggaaatctaaaccaagctactagccatgggcagagactagaggatgagtgtcataccctaatttcgtccggggacctttgctcgatgacgtgcgaccattctttggtcctcgtgaggcccacttgggccctccggaatattcctccagaaggcggttgcttctggaggaagcaaccctgctcgcctgggcaagctgagctcgcctgggcgagctgggcggcaaccacctcccctattttgctataa

SEQ ID NO: 31925 - DNA, 417 bp, Glycine max
  Peptide Sequence Number=SeqID_123610
atggctcagagcgagaccgcatggcaatgtctatgcaaaagacctgcttttagcaataccaccaaggtagcttatctctcttgctatggtttcggtatcccctggcaaggaacagtcattgctgcaattctaaacgggctccatctccttgatgctcccatacccgggtctcgccttgtcttcagacttcgtgtggtaggcccgcaaatagtgccttccgagtctgttttatgcggtccaaacctcttgctgaataccttgaccacagttgcaattctgctcaaagaggggagatacccggaggaaagatatggttttcttcccccgagaggacatcctagaatttcctcaaattcttcaatggttggtactaattggaagtctgcgaatgtgaagcacctcaaaggctggtcgtag

SEQ ID NO: 31926 - DNA, 387 bp, Glycine max
  Peptide Sequence Number=SeqID_123611
aagctcctggctgagaagaccaagaagaagctgcaggaagctgcacagtcaggaagcgttgatggcgtcatcgaccctccatccccggtaagacgccacgtgaagtggaagatagcccacacgaagaagacaggggagatgacgactgaggcctcaaaggaaatcgctgagaagattgattcgtttgaggagcacgccacacaaggatcgttcgtcccccatggacgtcaggatgttttggccgctgctattggacgtccagagcaccctggacgtgtccgtgctgctggagctggtgtcaccatcaagcaatactttggatcggctccacgaatgtcccgcaacatttcctccctacctcctgacgaattacagcagctgacctag

SEQ ID NO: 31927 - DNA, 315 bp, Glycine max
  Peptide Sequence Number=SeqID_123612
atgtgggccatcatcgatgagtgcaaagagaagctaaatctagcggcgactcacgagcaaaggctagaggatgagtacgccaagatatcagcagaaagggaagcaagggaaagggttctccttgtcacgggaagccggaagggtgtccataattataatccctgtcctcgccataagagcttgtacactcatgagaggcagtgcgcccccaaatcaagagaagagcatcacgcctttccagctctcgcacggggtttcagtgaccacaacgcaagggtactccgaggagttcgcaaggcatgggatgcggcgtga

SEQ ID NO: 31928 - DNA, 621 bp, Glycine max
  Peptide Sequence Number=SeqID_123613
atgctgcagacccttgtaatcatcgaggagggggagacattatttgcctactctagatttgcactcttgaggcctgatcctcaagatttggctactaagctctgcatcccagggaggggatttaagcttaatgttgatggtcagcctctgaagatcctcaggaagaacatgactacactcgctcagccttggagtattgtttcttactccaacttggtccctacctcccacacttttgacatcacactggatcgggccaagttgatttatggcattattatgaagatggacatgaatctaggctacctcatctccccccagatttctatcattgcccagcatgactcctctagagttggatttccagccttaatcacagctttgtgtaaagctagaggagtcacattagatttcagatctttggagagccttagtcctgccattaacttggcatatataaagaattgttggaatctagatgatccaacagtgacattcagagggccaaggaaggccaggggtaagagatctgaggctccccctacttcagcaacaccagatacttctgctccttgttcatctactttatcatatacttctgatagaagcaggactgaataa

SEQ ID NO: 31929 - DNA, 251 bp, Glycine max
  Peptide Sequence Number=SeqID_123614
gcccacttgggccctccggaatattcctccagaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 31930 - DNA, 297 bp, Glycine max
  Peptide Sequence Number=SeqID_123615
atggcctcttcaagtggagatgctactctatcatctccaaaaatagcaaggctcagggtggagatgattaaacttggtgatcaaatgagaagaatgagttatgaagataaagaaaggatgaagagaatgagaaaggagaatgaggagagtttgggaagaatacataggagtagtaaagctttaaatatgaggggtatgaagaggatgagggaggaaggaggaatgagagatatagggagagaaaaaatcatagaagatatgaaggtagacaaagagaggaaggaactgagggagtga

SEQ ID NO: 31931 - DNA, 117 bp, Glycine max
  Peptide Sequence Number=SeqID_123616
atggaggttgaggaaccatggttggggttatggctaccattgaattatcgagtggatatgggatcaagtggtcttcgtcattggaagtgcggtagacagactttgtggttgatttag

SEQ ID NO: 31932 - DNA, 285 bp, Glycine max
  Peptide Sequence Number=SeqID_123617
atgtcagtgatggtgtcaatgggacgctccttaacattcaaggcaagaaggaaagatggtttgaatactcatcaagatctagttgagaaaggtatacgagcccagttacatccaagcaaagtccttgatcttgtcaagttagatgagctggaaaacaaggctgtcattatattgtgtcagttggagatgtattttccttctgctttcttcgacatctggtcagagaaatcaaatgttgtggtcttttttatttacgttggatgtacctggttgagcgatacatga

SEQ ID NO: 31933 - DNA, 592 bp, Glycine max
  Peptide Sequence Number=SeqID_123618
ttttgagtgtgacaatgacccattgcagttcttgaaatcagaaaacagaagtaaagaaggttcagtaatcaagaaccacaccctttgtggtggagaagaaacaaaaaatgatgaagcaaagttagcaagagaaaaaaagattgaaaaggttatggaggaagaagttgatccatcgataaagagggagaagcacaagaaaagcggagtgacgaatgtgggctgcaaagacgattttcttgataacccaattacagatttgatcaagaaggaagtcgaagctggtgattcaaccaagccacattgttttcaagattcagatttccataaaaagattgttatggtgaaacaaaaatcattcatgaaggtggttggaacaacaatggtgctggaatcttggaatgtcaacttgttgggtgagcctttagcattaaattttgttgcatctatggctgacagcttagccatggagttaaggcaaaaggaatctacaaggggtgcagttgtcttccagcaatcagacaaaactttaggaagtttcagtgtgaaattccagttttcagattccaaccttgaggacaagattgatttttag

SEQ ID NO: 31934 - DNA, 547 bp, Glycine max
  Peptide Sequence Number=SeqID_123619
atggaggccatgaaagagaaaatgaccaaaattatggaagttgtgatgagtatgaaaagaatgatggaggtcaatgcggctacagttgttgccccaagtactgccacaaaaatggagccaactcacccacttggcttcgatcaagtaaatcatccagcctcggatatggtagggcagggaggcgaagcgttaggaagtataggtggcccccattttgtgcaagtccgaaacaagcattccttcccaccgtatggcttgcctcccaactatacgccacccaatgttgcacacactcccgaggagaatgtcgacatctctatacccatgcccattgagggccaacaacctcaatttgatcatgcacatgtctctcaacccatggggaagacacatgaagcacctcgagatcacagtttagcagacttcgaaccttacctcgaatatgccactaaggggcaagcagttggtggtgtacccctgccaaacactttagagggccctcagttttgcccactactacaacccttgcattttgccggtgggaaaa

SEQ ID NO: 31935 - DNA, 399 bp, Glycine max
  misc_feature (5)..(5): n is a, c, g, or t
  Peptide Sequence Number=SeqID_123620
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccggttggagtatgaaaggacactctatgtctgagcaagagcggtcaagtccttgctcagcagcttccaagacgccccctcagcatttagaacaaattcccgccctaggagacatagtttag

SEQ ID NO: 31936 - DNA, 1107 bp, Glycine max
  Peptide Sequence Number=SeqID_123621
ctcaatgggtgatcgcacatgtggcgcaagaaacgcctgcgctggcgcagtctgcccttgaatacacactggatggcgacgaagagttacgcctgttgcaaacaaaccttgccaatgagcatcaggatccgctgcaactggcggagtggcatcagcgattggccgatattgatggttatagtgccgaagccagggccagtgccttgctggctggcttggggttttcccagtcgcaattaagccaacctgtcagtgacttttctggtggctggcgcatgcgtttaaacctggcgcgtgccttgatgtgccgttctgatttgctcctgctggatgagccgaccaaccacttggatattgaggcagtgatttggctcgaaggctggttaaacgcctatcgcggcactttgctgctcatttcgcatgaccgcgagttcctggataacacggtcaaccacattttgcatatcgagcagcagcaactgactttataccgtggcggatatagcgattttgaacggcagcgtgcagaaaaactgaccttgcagcaagccagttaccagaagcagcagcaacagattgcgcatctgcaaaagtatattgaccgttttcgcgctcaggcgaccaaggcgcgtcaggcgcaaagccggatcaaggcattggaacgcatggagcgcatcagtgccgcgcatgtagactcgccgtttaattttggtttccgggatactggcgcatcaccagacccattgctggtgatgaatcatgcgtcgctcggttacacggataagcccctggtcaagctgggacacctggcgatacgcccaggggaacgtataggcttattaggcaagaacggggcgggtaaatctaccctgattaaagcactggcggattctgccaccttgctggcaggtgagcgcgtggaaggcaaggatttgcggattggctattttgcccagcaccaactggagcaactcatcgccagtgactcgccattgcagcatttgcaacggctggaccctttgaccagggagcaagagttgcttgatttcctgggtagttttgatttcaggggcgaaatggccaagacgccttgcgggccattttctg

SEQ ID NO: 31937 - DNA, 459 bp, Glycine max
  Peptide Sequence Number=SeqID_123622
atgaagccgacaagaaaagtcacacgcctaagatcattggctactagactagttggggcagagaaacccttggcccatgtgaatcttgcgaccgagaaagccgacggtccccacagaaagaagttaagaacatgtttggggatcgtcgcttgtgataaggtggatgtggcatacgagaattggaaacaaactgtgagggaacgatggagacaatttaagtttgatttgacatcgaaatgggcatttgaagccgacaaggacagtgccgatgacactgatgtgcggaaaaagtcacatgccattcagaaacaaaacattgcccctcacatgttgtctcgtgggggttatgaatttctagaaaacaagttgatggaggagaagaaaaacaaacaattggaggaacctactaaatctggaagcactgacttcgtcattaatactccatctctcatcagatga

SEQ ID NO: 31938 - DNA, 600 bp, Glycine max
  Peptide Sequence Number=SeqID_123623
atgcgggggtaccttatgattatccgcagcttttgtcaaccagaggcaagcaagcccgttaacacgcagagactaacgtcttcatctgcaccttttgtcaaccaggggcaagcgagcccgttgacacacagagactatggccgtctctgcaccattttgtcatccaaagacagcgagtctgatgacatgtggggggcaagcgagcccattgacacgcagagactaacatcgtcttctgcacctttgtcatccagaggcggcgagtgcgatgacatgcgggggtaccttatggttatccacaccttttgtcatccagagatggcgagtccgatgacaccttatggttatccgcacattttgtcaaccagagacggcgagtctgatgacatgcaagggtaccctatggttatccgcaccttttgtcaaccagaggcaagcaagcccacagccgatttcgatgatatgtcggggtaccttatggttatccgcaccttttgtcaaccagagggaagcaaggccgttaacacgcagagactaacgtcgtcatctgcaccttttgtcaaccatgggcaagcgagtccattgacacgcagagactaa

SEQ ID NO: 31939 - DNA, 306 bp, Glycine max
  Peptide Sequence Number=SeqID_123624
tcatacattgaagagtctttagacgaagatgatagtgttgacggtatatctgatacagacaatgaagtcatcgacatgattcaaccagtaagaattgttcaccccacagaaggtgtagaaggaattcaaaatccattttggaatgatgctttgcattataataatatcaatcctgatggggaggacatttgcggtttggagatgccatcaaattttaatgttgggcaagaattatatgttggcatgaattttgatagtaaagacgcggtcaaaaatgcactgaaacaatatgttatgaaggcatga

SEQ ID NO: 31940 - DNA, 501 bp, Glycine max
  Peptide Sequence Number=SeqID_123625
atgggaacaaatcaaaccggcaagaggttctaccaagtcaagccttccgcaagagcttacggaaagatcttagagttgaccatagcagaggtgtccatagaagccattgcatcactcacccaatactacgaccagcctttgaggtgcttcacattcggagacttccaattagtaccgaccattgaagaatttgaggaaattctaggatgtcctctcgggggaagaaaaccatatctttcatccgggtgtctcccctctttgagcagaattgcacaaggattcagcaagaggtttggaccgcataaaacagactcggaatggcatagcgggcctaccacgggggtacctagaagacaaggcgaggggtatggccaatcaaggagattgggtcccgtttatggatgtgttagctttgctaatttttggggtcgtcctctttccaaacgtggatggtttggtggacctagcagcaatcgacgctttccttgcataccaccataa

SEQ ID NO: 31941 - DNA, 477 bp, Glycine max
  Peptide Sequence Number=SeqID_123626
atgaacttaatcattgttatcaaaaggaaagagcacgctttacggcacccttaccgaactcatgctagagctagagtaatgggtgaagtagaggaggtgcaagagcagatgaaggtcgacagggaggccttgaaagagcaaatggccacaatgatggaggccatgatgagcataaagaagataatggaggtcaatgcggctgcaataacctctaccagcaccattgttgaggtggacctgaccccccctatatggcctcaaacaaataaatcatccaacctcagatatggtaggtctgaaaggccaagagttgggaggtacgggtggccctcatttagtgcgaaaaacaagcatgccttcccaccatatggcttgcctcccaactatacaccaccccaaatgtggcatacactccccagtgaggatgtcaataactccgctcccatactcattgaaagcccgacaacctcaaactaa

SEQ ID NO: 31942 - DNA, 699 bp, Glycine max
  Peptide Sequence Number=SeqID_123627
atggagataagctgtagatttttagtgtcaggaaaatatattgccttgcaaatttgtgatgacgaagacgtcgagacgatgctggaaagttttaaacaacaacaagaaatgtcagttctagaattgtacatagaaaaggatgtggctagaggttcaatgtttcattctgcaaattcccttacatcatgtggaaattatgtatctaacgatgacacacaaccgccaacaaatatgagcaatttaaatcttgacgaagatgatgatcatgatgatgatgattatcttgagtctaactcatacgttgaagagtctttagacgaagatgatagtgttgacggtatatctgatacagacgatgaagtcaccgacattcctcaaccagtaagaattgttcacccagcagaaggtgcacaacgaattgaaaatccattttggaatgatgctttacattataacaatatcaactggagttatcctgatgaggaggacatttgtggtttggagatgccgtcgacctttaatgttggccaagaattatatgttggcatggaatttgatagtaaagatgcggtcaagaatgcactcaaacaatatgttatgaaggtgcatcaaagtttcaaagttgttgaaagcaaatcgaacaagcatggtcagagaagatccatcaataaaaatttcgttgattcaagagaggattaa

SEQ ID NO: 31943 - DNA, 255 bp, Glycine max
  Peptide Sequence Number=SeqID_123628
ttggtgtcgcaacctacccttttgcgggcgagtgaggcgaggctcacgggtgcaccttccataggaggaaaatgcgcagagtcgccaccaacgtttattgaaaggaaaatgttaaaaaaaccaaaggaaaccgatcatgaagcatattccagattcgggagttatctttacgtcgacaaaagcggggctcttgctcctacgtaccctccatcgaagaggaaatcagacctacgtagttctttcaaaaggcagtga

SEQ ID NO: 31944 - DNA, 693 bp, Glycine max
  Peptide Sequence Number=SeqID_123629
atgagccagcgagggttagaagcgctattacgtcctaaatccattgccgttatcggcgcatccatgaaaccggatcgggcaggctatctgatgatgcgcaacctgctcgcgggaggatttaatggccccgtcatgcccgtcacgccggcttataaggccgttcagggggtgctggcatggccagatgtgcagagcctgccttttgtgccggacctcgccgtgctgtgtacgaatgcgaaacgcaatctggaactgctggaagcacttggcaagaaagggtgtaaaacctgcattattctctcgtctccacctgaacagcaacccgaactgctcgcctacgccagccgctaccagatgcgtatccttggcccgaatagcctgggcctgctcgccccctggcaggggttgaatgccagtttctccccggtaccgatccgcaaaggcaaactggcgtttatctcgcagtcggctgcagtatcgaacactatcctcgactgggcgcaacagcgcgaaatggggttctcctacttcattgccctgggcgacagcctggatatcgacgttgatgagcttctggatttcctggctcgtgacagcaaaaccagcgcgatactcctttatcttgagcatctgagcgacgcccgtcgttttgtatcggcttcacgaagtgcttcgcgcaataagccgatcctg

SEQ ID NO: 31945 - DNA, 384 bp, Glycine max
  Peptide Sequence Number=SeqID_123630
atggcccgagttatgttggggaacggttacgaacccagaatgggttcaggcaaagacaacggcggcataactagcctgataaatgccaaaggaaatcgtgcgaaagaagcatcgcgggaaggaagagcggtggtcaaagctcgcgttggagacaagaaaggtggcaaaaaggaggtgtcgcgatatggaagcagtgatgttcctccgagtaattgcatgagcgaattcaggtatcgaaccatgctaacaaaactccatgcattgggtctcagctggaaattgggagttactcatggagctccgaacgcctcatcgggctcttacgcaacgagcataagtaaacctttacggttcttagaagaggcctctatagttaggccctag

SEQ ID NO: 31946 - DNA, 752 bp, Glycine max
  Peptide Sequence Number=SeqID_123631
atattgatgtttctgagcatcaaattgccaaggaaatcactgccaaacgagtccagcattggccaaggaaagggaagctttcagcagggaagctaagtgtgaagtatgccattctgcacaggattggagctgcaaactgggttcccaccaatcatacttccactgttgccacaggtttgggtaaatttctgtatgctgttggaaccaaatccaaatttaattttggaaactatatctttgatcaaactgttaagcattcagaatcttttgctatcaaattacccattgccttccctactgtattgtgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgccttgattgctgaactcaaggacacatgcaaggtgctggaagcaaccatcaaagccaacacagagaagaagatggagctggaacggatgatcacaaggctctcagaaagtggcattgatgatggtgaagcagctgaggaagaagaagatccagctgagcaagacgaggcagctgagagaaggagagcagctgagagagagaagctgctgagagagagatgcagcagaagagacagatcagatgatgattctgaggccaccccatga

SEQ ID NO: 31947 - DNA, 216 bp, Glycine max
  Peptide Sequence Number=SeqID_123632
atgttgcaagacagaacagttgcgtccattcttgaggaggagactcatttttctgatttattatcacctaattcaccatcatcaagggaattcgctaatcaaaattctgaagttgttactgtcgcaacatgcccttttgcgggcatgcgaggtcgacaaaagcggggcttttgctcctacataccctccatcgaagaggaagtcagacctacgtag

SEQ ID NO: 31948 - DNA, 263 bp, Glycine max
  Peptide Sequence Number=SeqID_123633
ccgcagtgtcgtctacaagcttcaatgttaatgtcacatcagataatgtcaaaaactgtatcaaattatggagatcgtggtatggtatttcgcataaatcggctaaaccgtttcgattcaaggtgcttcaaaattgggatgatatagtggatttgtgtgctaaagatagaccaccgaaaaaaatggatggtaaagttgatgatgaagatattcaagaagtattacgtgaggcagctttgatactagatcttaatagacaataa

SEQ ID NO: 31949 - DNA, 183 bp, Glycine max
  Peptide Sequence Number=SeqID_123634
atgaaatacccaaggttgtataggatatctcttcagcagcataaactcattcagcaggtgggaagtttcaatgactcctcatgggaatggaacctctcatggagaaggttttctggaagaaatttgtcagattacaatccggcgacatatagcagattgttggaagtgggaagcagagcctaa

SEQ ID NO: 31950 - DNA, 324 bp, Glycine max
  Peptide Sequence Number=SeqID_123635
atggaaaaatggaagtctcaagagttgaaacaaataggggatgtgtcgactccaaaacaattcatattggaggcgttgcgagaggccggtgtgattaagtgtggcggtaataaggaagattcatgcttgatacatccaggggtgttgcatgatgtggaaagatgcccaatagctaaggagttactgcagggactaataagtaggggtcaaattgaaatccacaatgcaaaaaaagaggaaggagagggatattaccactcagatacctcgaggtttctagccctctgtaggaaagacgccagcacccttcccttaaaagagtga

SEQ ID NO: 31951 - DNA, 810 bp, Glycine max
  Peptide Sequence Number=SeqID_123636
atgaattcattgcctagcactgttcatgtgtcctccaccatcgagtctggagccctgcgaattcattgcctagcgctgttcgccaattctccattctccacttttattcggagacccatgaattcattgcctagcgctgttcatgtgtcctccaccatcgagtctggagtcccgcgaattcattgcctagcgctgttcgccaattctccattctccacttttattcgaagacccatgaattcattgcctagcgctgtccatgtgtcctccaccatcgagtccggagtcccgcgaattcattgcctagcgctgttcgccaattctccattctccacttttattcgaagacccatgaattcattgcctagcgctgtccatgtgtcctccaccatcgagtctggagtcccgcgaattcattgcctagcgttgttcgccaattctccattctccacttttattcggagacccatgaattcattgcctagcgctgttcatgtgtcctccaccatcgagtctggagccccgcgaattcattgcctagcgctgttcgccaattctccattctccacttttattcggagacccatgaattcattgtctagcgctgttcatgtgtcctccatcatcgagtctggagccccgagaattcattgcctagcgctgttcgccaattctccattctccactttaattcggagacccatgaattcattgcctagcgctgttcatgtgtcctccatcatcgagtttggagccccgagaattcattgcctagcgctgtccgccaatttctccattctacacttttag

SEQ ID NO: 31952 - DNA, 702 bp, Glycine max
  Peptide Sequence Number=SeqID_123637
atgcctgggggtacaccagtctggcattctgatttagaatatatgacattagataacatgtttgggttcattgaagcatatgtagaatgcccaaaaagtataaagaaaccatttcttccctatcgggataataaggatggcactcttatctttcctacaggcacctttgttggggtttactatagtgaggagctcaagtatgctagagacataggctacactataataccaatttgtggatacctcttcgaggagatggaaagtccattcaaggactacattaattctctctttgaaagcagatccaatgctaaaaagaagggaaataacgccctatcttttgtatataaattactaatgaactcattatatggtagatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtatag

SEQ ID NO: 31953 - DNA, 751 bp, Glycine max
  Peptide Sequence Number=SeqID_123638
acctactgatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacagcaaagagagatcaacagaggaagcatgatcaagcgacaaaggagacaccctgcaccaagggcaccagaacctgcttccaggtgacctcattgacctggaagaagtcgaatctgatgcaaggaaccattgcacaggttggcacctggcattgcggaaagccacttcaaacagaggaagggaagaaacccctgctgatcaaaggctctcggagaatcattgactatggaagcagcaggaagaagagtactccaatcactcgctgcccatccagaagaagcaaggttgctaggaagagaaaggaagagaattcctcagattcagatgatgattcgaacccccctagagtctcgactctaagagggccaagaaatctggaagaaaggtgcctggaaatgttcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgttggactactga

SEQ ID NO: 31954 - DNA, 321 bp, Glycine max
  Peptide Sequence Number=SeqID_123639
atgtcaatccttaccctcggaagcgaaaaaagaagagaaggaaaatttccaatcaaagagaaaaaaagagaaggaaaatttccaatcaaagagaaagcaaaaaatgagagaaggaaaatttccaatcaaagaaaaaagagaggaaaggaaattcccaaccaaagaatgggagaaagtaaaaaggaaggaaagaaaggtcctgatcaaggatcgaaagaaaacagaagaaatgtgcagaaaggtctttggaccagacaatatctgaaaaatatagaattgtcaccaaatgaacaaaaagaaggaaaggaaaccacgacctaa

SEQ ID NO: 31955 - DNA, 317 bp, Glycine max
  Peptide Sequence Number=SeqID_123640
atgcagcacctgtatgaaagtcagtaccatcccgttaaggactggttttgttgttcatatgtcaagggctggcccccgtcaattcctttgagtttcggtcttgcgaccgtactccccaggcggagtgtttcacgcgttagctgggcccctgatccacgtagaccaagggcgaacactcatcgtttacggcatggactaccagggtatctaatcccgttcgctccccatgctttcgcactccagcgtcgagcattccaccagtttttggcgactttcactttcaacccgattcaccggctacgtgccctttacgccca

SEQ ID NO: 31956 - DNA, 1467 bp, Glycine max
  Peptide Sequence Number=SeqID_123641
atggaacctctccaaatgcaagccttccgcaagacttacggaaagatcttagatttgaccatagcagagatatccatagaggccattgtgtcactcacccaatactacgaccagcctttgagatgcttcacgttcggagacttccaattggtaccgaccattgaagaatttgaggagattctaggatgtcctctcgggggaagaaaaccatatcttttctccgggtgtatcccctctttgagcagaattgcaactgtggtcaaagattcagcaagaggtttggaccgtgtaaaacaaactcgaaacggcatagcgggcctaccacggaagtacctagaagacaaggcgagggatatggcaaatcaagaagagtgggtcccgtttatggatgtgttagcattgctaatctttggggtcgtcctctttcctaacgtagatggtttggtggacctagccgccatcgacgctttccttgcataccaccatagcaaggaaagcccggtggtagctgtcttggcagatttatttgacacatttgaccgaaggtgcgagaagagtagcgcacggatcatctgttgcttgcccgctctctgtgtttggttggtttcacacctgttcccgctagacacgagacacccgtgtccgcttcaaagttatcgctcatgcaccgaaaaaggaagagtcgattgggatcaacatttggctgggatagggggcagcgcgatcaattggtttcctcgttggaaagaaggcaaggaaggagttcttttctcgtgtggggactaccctaatattccattgatagggactagggggtgtattaattataatcccgcactcgccataagacaactagggtaccccatgaggggagcgccaaccgaagaaagtctctcgcctttccttgcgaggaatctaggcgcgcaaagtctcaaggcgatacaaagagtccactgggcatggagaagtccattaaggaaagatcaagaacttaggggcatccgtaatggcatcattggtggttaccatgaatggctgaatgttcatatacgaggtctagattggctcgccaagttaaaagtcgtcagcgaagaaagtttcgaagcaccggaagaggacgaagaagtccaagctctcaaaagcgagttaggaaagatgaaacttgccaaggagaggttcaaattagccgctacacacatccggaaggaatgtgccggattacgggaagagaatgcaactaccgcaagagcccttgaacaagagaccaagagggctcgcaaggaagagtatggtcgtaacaaatttcgcggagctctgtggggtagcaacaatgaactcaagctgcgaagggaagagagggaccagtcgcgagcacatagcatggtcttgaaagaggagttagttgcctgttcaaggtccaaaaggagcttgtctcagcgtttatgcagacggagaccaacatgctag

SEQ ID NO: 31957 - DNA, 162 bp, Glycine max
  Peptide Sequence Number=SeqID_123642
atggcagtactttgtccgactaggagcttttcatctggacacttttctgctagtggagcaaggttcaatgttcaccagaattctttgactcctgtcatgtgtctggaacagccgctatctaggtaccaatcttccttagctgatgctctaagtgaggtatga

SEQ ID NO: 31958 - DNA, 210 bp, Glycine max
  Peptide Sequence Number=SeqID_123643
atgtgggcctttcataccggccgtcaacttgactgggcacatctgtacaagtttgatgccataggaaaggaattgcaagtcggcagcaaaaggttcgatgccaggaacaggatcaccaaagttgaagaagatgtctctttctccgaaatttactctgcttatgatccagaggatgtaatccgttaccaccgcctccaaaactcgatttag

SEQ ID NO: 31959 - DNA, 633 bp, Glycine max
  Peptide Sequence Number=SeqID_123644
atgagcgcaaatgcggagagcactaacccgcagcaaccggccaacaagaaaggcaaacgtaaaagtgcccttcttctgttgaccttgctctttattattattgccgtggcatatgggatctattggtttttagtattgcgtcatgctgaagagacagacgacgcctacgtggcagggaaccaggtacagattatggcgcaggtgtcgggcagcgtgacgaaagtctgggctgacaataccgactttgtgcaaaaaggcgatgtgttggtcaccctcgatccgactgacgcgcagcaggcatttgagaaagcccagaccgcgctggcctccagcgttcgtcagacccgccagctgatgatcaacagcaaacagctgcaggccaatatcgacgtgcagaaaacggcactcgcacaggcgcagagcgacctcaaccgccgcgtaccgctcggcaccgccaacctgattggccgtgaagagctgcaacacgcccgcgatgccgttgccagcgctcaggcacagctggatgtggcgattcaacagtacaatgccaaccaggcaatggtgctgggcaccagccttgaaaaccagcccgccgtgcagcagcggcgactgaagtgcgtaacgcatggctag

SEQ ID NO: 31960 - DNA, 393 bp, Glycine max
  Peptide Sequence Number=SeqID_123645
atgaaaagagaaaaacatgtctcttatagtagtcatgactcttgcaagagtttaagtgaagaacttagcgactattatagagggcgtcatagttcacatactaaacatcactcccaaagaagagaaaaggatagaaggcctcaagaggttaacattagcctcccatatttccacggaaaagataatgttgaggcctacttagattgggaaatgaaggttgaacaactttttgcttgccatcatattagcgatcagagagaaaagttcccatttacccttttttttttagctttcggttattgcttgtctctattgtttccttgcttgagtattggatgccatatcttgaagaagtccttgagtcagaagcaaaggcaatccctcctactataa

SEQ ID NO: 31961 - DNA, 288 bp, Glycine max
  Peptide Sequence Number=SeqID_123646
atggcagtggaatggagaaggaagagagggaagagacgccactttaaggagaagatgagtctagaagaagctcaccaccatagcaggccatggataagagcttggaggaagaaggagatgaatgaagggagaggaagagaagagcatgaatttttgtgccctaaaagagctctgaaatctgaattcatcccactaatccaagatcaagtccaagattctccactagtgtgcttaggtgttatgaggcatgtaaagcacgaaggacatgcacaaagtgtgactatatga

SEQ ID NO: 31962 - DNA, 371 bp, Glycine max
  Peptide Sequence Number=SeqID_123647
atggaagcaaggaagaagaagaagggtttcagaagcagagaagaagaaaggtttcggggtttaggaagcaaagaagatgaagggcgtgacacgtgtcccactctgcctagaaagatggaattaatgatgggtaatggagatcgaggcgacggttacacagtgaacgttcgaagcgtattacagagcaagagcctggtcaggacctgctcgaatcgaaaagagaggagagtctttaagaaggaattcccaggttcaaaggagtatttacgaagtacaaagctaagacaagaaagaggacttcgagctattgggcaattcgaactggtgtatggacgagtcgaagtcgaggcagcaagaattctggacttagc

SEQ ID NO: 31963 - DNA, 138 bp, Glycine max
  Peptide Sequence Number=SeqID_123648
aacacttcaagattcaagaggaaagttgatttcaagaatcaagattcaagatttcaagaatcaagattcaagagatcaagattcaagactcaagattcaagaatcaagagaagacttaatcaagataagtatgaaaag

SEQ ID NO: 31964 - DNA, 525 bp, Glycine max
  Peptide Sequence Number=SeqID_123649
atgggtgaagtagaggagtgcggctacaatagccgctaccagcaccattgctggggtggacctgacccccccatatggcctcaaccaaataaatcatccaaccttagatatggtaggtctggaaggcaaagagtaggaaggtacgggcgaccctcatttagtgcaaaaaacaagcatgccttcccaccatatggcttgcctcccaactatacaccacccaatgtggcatacactcctagtgaggatgtcaataactccgctcccatactcattgaaagccaacaacctcaatctgatcatgcacatgtctctcaacccatgggggagacacatgaaacgccccaccacaatctagccgacttcgagccttgcctcggatttgccactgaagggcaagcaattggtgatatacccctgcaaaacactttggagagccctcggtatcacccacaaccacacctcttgcattccacaacaagtaaggggcttgaatctttcaaagaatatgtgcaaaaaggggcttga

SEQ ID NO: 31965 - DNA, 405 bp, Glycine max
  Peptide Sequence Number=SeqID_123650
atgatacgcggagataccttatggttattcgcacccttttgtcatccagaggcggcgggcccgatgacaagcagagaccaagtttggtcattctgcacccatgatacgcggagataccttacggttatccgcacccctttgccattcagacacagtcgtgtccgatggcacgcagagaccaagtttggtcattctgcacccatgatacgcggagataccttacggttatccgcacccttttgtcatccagaggcggcggtcccgatgacaagcagagaccaagtttggtcattctgcacccatgatacgcggagataccttacggttatccgcacccctttgccattcagacacagtcgtgtccgatggcacgcagagaccaagtttggtcattctgcaccatga

SEQ ID NO: 31966 - DNA, 315 bp, Glycine max
  Peptide Sequence Number=SeqID_123651
gctgaggaaccttcttcttctcctaccctggttcctcccactattcggccaccacccacaccagagttgaagcccttacctgcaaccctcaaatatgcttacttggaggacaaggaaaaatttccagtgatcatctctgcctcccttgctgctgagaaagaggagaaattccacagcggagactcaaaccccgtcattctagatgtagtgaaaaaggaagtgaccaagctcttacaagctggaatcatctatcccatttctgacagccagtggaacagctggcgagtctgcattgattataggaggctgaatcag

SEQ ID NO: 31967 - DNA, 216 bp, Glycine max
  Peptide Sequence Number=SeqID_123652
atgtgggccgtcatcgatgagtgcaaagagaagctaaatctagcggcgactcacgagcaaaggctagaggatgagtacgccagatatcagcagaaagcgaagcaagggagagggagtcaagaacttccccgattgctagccaaggccaaagcaatggcggacactactccgcccccaagaagatccacggacttctcagctattgtcaacatatga

SEQ ID NO: 31968 - DNA, 662 bp, Glycine max
  Peptide Sequence Number=SeqID_123653
caccggaagaagacgaagaagtccaagctctcaaaaacgagttaggaaaggcgaaacttgccaaggagaagttcaagttagccgctacacacatccggaaggaatgtgccggattacgggaagagaatgcaactaccgcaagagcccttgagcaagagaccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagttgcctgttcaaggtccaaaaagagcttgtctcagcgtttatgcgagacggagaccaacatgctagctatcatcgccaagtaccaagaagagttaggtctagccacggcccacaagcatagggtcgtggacgagtatgcccaagtatacgcggaaaaagaggctagaggaagggtgatcgactctttacaccaagaggcaaccatgtggatggatcggttggctcttaccttgaacgggagtcaagaacttccccgattgttagccaaggccaaggcgatggcagacacctactccgccccgaagagattcatgggcttctcggctatgtcagcatatgatagacttaatggcccacataattag

SEQ ID NO: 31969 - DNA, 729 bp, Glycine max
  Peptide Sequence Number=SeqID_123654
atgacacttccttttgtacaaaagatgaatacaggcggatatgatggaaaaggtgttcaggtaattaaaaatgaagaagatcttcaaaatttatggaaggagccttctgtgatcgaaaagcttgttgatatcgataaagaattgtctgtgattgttgcaagaaatgaaaaaggggagaccaagacttttcccgttacagaaatggtggctgatcctaagttaaatttattagattttaatatttgtccggtttttttacacgaaaacacccaaaagcaaattgatgtaattacggaaaagtttctgaatgcaataaactctcccgggctttttgccatagaactgtttttggataaggctggaaaagtatgggtaaatgagactgcgccgagacttcataactcagggcaccaaagccaggaaggaaacgcgaattcacaatttgagcaaatgtaccgtgtcgttaagaaccttccattagcggatacggaaagtctaggttatagtggaatgcttaaccttgtaggagcagaaggatattcaggaaaagtaatttatgaaggaatggaagaagtcctgaaattgcctaaaacttatgttcacttatatggaaaaacggaaaccaaaccgggaaggaaaatggggcacattaatgtgctggctgactccaaagaagaattgatggaaaagctcatcaaagtaaaggctatggtaagagtaatagcttaa

SEQ ID NO: 31970 - DNA, 258 bp, Glycine max
  Peptide Sequence Number=SeqID_123655
atgtctccttatcgggttgtctttggcaaggcacgtcatcttcctgtagagatagagcacaaagcctactgggctgtaaagacctgcaacttctctattgatcaagctggagaggaaattgagatcaaaagtgaatccacagataagggcttcaaggtcaatggacaccggatgaaaccattcctcataaatccctccttagtggatgtggtagtggaggagacctccttacttcaccctatttttcttctgccatga

SEQ ID NO: 31971 - DNA, 243 bp, Glycine max
  Peptide Sequence Number=SeqID_123656
atgaaggctcgggtgatcggcggtcgaatcaccttactaggtgcgacgggaaccccgaatgactggcagaggcacgtgatcaacgctggaaatcccagggccctgttagacttatttgggtctagggggtgcctgcgatcaactgagccacatggacgctcatccgtgtcaggatggcatacaccagctgacacttcggcagagggaggtcggagttatgatcgctgggcaggatgttgctga

SEQ ID NO: 31972 - DNA, 261 bp, Glycine max
  Peptide Sequence Number=SeqID_123657
atgggtgccaagtacctcgaagtggtcaaacaagggtcgcatcccaacaacggatggtccccggacaaaattaggacgcgaaatgaccataatttgtctctggattttgtcggacatgatcgagcctgggcggcgagacacaaaatgaccataatttgtctctgtgtgccaccggacacgatcgcctctggatggcgaaaaggtgtgtggaatgaccataatttgtctccgcccacctctcaacttgctatttttgaatga

SEQ ID NO: 31973 - DNA, 1293 bp, Glycine max
  Peptide Sequence Number=SeqID_123658
atgcttgtttcgagggttccgaagggagcaaacaaggttcaaggaccgaccgcaagtactctcggacgaaatttgggtatgacacacgccctcgccttcagaggactgcacgtcctcaccttcagaggactacacgtcctcgccttaaaggactacacgtcctcaccttcaaagggctatatgccctcgccttcagagggctacacgccctcgccagagctacacgccctcccctttagaaggctacacaccctcaccttcagagggctacacgccctcaccattagaggactacatgttctcgccttcagagggctgcacgccctcgccttcagagggctacacgcctttgcctttagaggactacacgtcctcgccttcagagggctacacgccctcaccttcagaggcctacacgccctcgccttaaggactacgtgtcctccccttgagagggctacacgccctcgccttcagaggactacacgtgctccgcttcagaggactacatgtgctccccttcagaggactacacgtcctcaccttcaaaggactgcatgccctcgcctccagaggactacacgttctggccttttgggtactagtaccctcacctttagaggaccacacgtcttcaccttagagggaggactacacgtcctcgccttcagagggctgcacgccttcaccttcagagagctacacgccctcgcctttagaggactccacgtcctcaccttcagagtactgcatgttctcaccttcggagggctacacgtcctcgccttcagagggttgcacaccttcaccttcagagaggtacacaccctcaccttcagaggactccacgtcctcgccttcaaaggactgcatgtcctcgccattaaggggctacacgtcctcgccttcagaggactacacgtcctcgccttcttagggctacacgccctcgccttaagaggactacacgtcctcgccttcagcgggctgcacgccctcgccttcagaaggctgcacaccctcgccttcagagggctacatgccctcgcctttagaggactacacgtcctcgccttcagagggctacgtgtccttaccttggagggctgcacgccctcgccttttgaggactacacgccctcgccttcaaagggctacacgtcctcaccttcagagggttacgcgccctcgccttcagaggactacattcctcgccttcataggactacccgaccttgccttcagagggctgcacgtcctcactttcagagggctccacatctgcccctttag

SEQ ID NO: 31974 - DNA, 652 bp, Glycine max
  Peptide Sequence Number=SeqID_123659
atgcctaaaagcactttggagaattaccattcaatgcttcccactaaagccgagttcaatggtggttcgtgcttcgacgacactcgccgagagctgtctgttggggcgcccgtggatccactcagtaggagttgtgccctctacactccaccaaaagttaaaattcgtagtggaggggcatttggtcatcgtgtcaggcgaggaagacatcttggtgagcttcccatcctctatgccttatgtggaagccgcagaagaatcgttagaaaccgcttccagtcttttgaggtggtcagcatttcctccgtggactccttctctgggcagccttgcctgtccgatgcagcagtaatgatggcccgagttatgttagggaacggttacgaacccggaatgggtttaggcaaggacaacggcggcataactagcctgataaatgccaaaggaaatcgtgggaagtatggtttaggctataagcccactcaggcggatatgaaaagaagcatcgcgggaaggaagagcagtggtcaaagctcgcattggagacaagaaagtgagggaagcccgccctgccacataagtagaagctttataagcgcgggtctgggagacaaaggtcaagtggtcgcgatatgcgaagatgatgtttcga

SEQ ID NO: 31975 - DNA, 573 bp, Glycine max
  Peptide Sequence Number=SeqID_123660
atgagaggccctctcaaagatgttaacctccttgagggctacatgccctcaccttgtaaggactacacatcctcgccttcgaggtacttgcacgtcctcaccttgagaggactaaacgtccatcgccttgagaggactacatgtcctcaccatcagagggctgcacgccctcacctccagaggactacacgtcctcgccttgagagggctataagtcctcgaccttgggtactagttaccctcaccatcagagggctgcacgccctcaccatcagaggactacacgtcctctcgactacacgtcctcgccttgagaggactacacgtcctcaccatcagagggctgcacgccctcaccatcagaggactacatgtcctcgccttgagagggctacacgtcctcaccttgggactattaccctcaccatcaaaggactacatgtcctcgccttgagagggctacacgtcctcaccatcatagggctgcacgccctcacctttagaggactacatgtcctcgccttgagagggctacacgccctcaccttgggtactagttaccctcaccgttga

SEQ ID NO: 31976 - DNA, 488 bp, Glycine max
  Peptide Sequence Number=SeqID_123661
atgtcgcgggggtcaggagacctttgggacgtcaggcaagctcctggcagtcaacagataaaaggaacaaagaccacaaagcaaggaggcttgtggtggctggccagctgtgaattttgtgtgatatgtggattatggcctctggtaatcgattaccaagggtgggtaatcgattacaggcttaaaaatgaagacaggaggctaagatggcctctggtaatcgattaccaagggtgtaatcgattaccaggcttgaaacgaagtcaggaaactaagggagctctgagggatgggtcactggtaatcgattaccagatcgtgatggcggcacagctaatccatgatcgagtggagatggagtgcctagagggagcttgggagaccctcgaaggcaacacgaggtgtcgatttcggggcaccattcgattcacggctacttctttggtgcatccagatgaaccagcacggacgcttcagcgcactgtgga

SEQ ID NO: 31977 - DNA, 564 bp, Glycine max
  Peptide Sequence Number=SeqID_123662
atgagtcttcattcttcttctagtgttaatggaaggcataggtcacatcttagaccttactcccataggagagaaaaggaaagaaatcctcaagaggctaacattaacctcccatacttccatgggaaggataatgtagaggctaactcagattgggaaataagggtagagcaacaacttaaaaggaagtcgacttcaaaatcttatgactctcactcttatccaaagaaagaccaaggtcaaggcatcttaggggtgacaccttctaagctcaaagatgataaggggaagacaatagaaaagcaaccccttaaggttagtatgcaagagaagactagctccatgaagttctttaaatgtcttggaagaggacacattacttctcaatgccccaccaagaaaaccatgattatgaggggccaagacatttatagtagccaagatgaggctactacttcaccttcctctagtgaaagtgaagaagcaaaaggggaagaatctagtgaagagatctaccccccagaagaaggacaaccttttatagttaaggagaagtgtaaggag

SEQ ID NO: 31978 - DNA, 135 bp, Glycine max
  Peptide Sequence Number=SeqID_123663
atgaagtgcttcttagatccaatagctcttaaggtggttggccccttgcttcttgacttccaaattctcagggatggcccaatcctcctttccaattcccatatggcaactcacttcatcataggatacatgtaa

SEQ ID NO: 31979 - DNA, 189 bp, Glycine max
  Peptide Sequence Number=SeqID_123664
atgccaacgtcatcacgtaggctcggcggctcctcaccagaattacacttcctacaccctgctgctgtcattttgctcccacgaacaatgttcgtgatcatcacaggaaatagcctaagcgtgtccacacgacacgctcacttagggaactgtgctgagtttgttgagaccacctggttgtgcacgtaa

SEQ ID NO: 31980 - DNA, 424 bp, Glycine max
  Peptide Sequence Number=SeqID_123665
tctcttcgtgctatcaggcttttcgtcttacagatagaaaaaaagttttatacggataaccactcgggtatctccgctcgtcagcgtgactcaaaagtcagtatgacagatcttgtgagcgcggaagatgacgaagacgacgttagtctctgcgtgttatcaggcttttcatcttacagatgcaaaaaggtttatacggataaccactcgggtatttccggccgtcagcgtgactcaaaagtcagtatgacagatcttgtgagcgcggaagatgacgcttttcgtcttacagatagcaaaaaggtttatacggataaccactcgggtatctccgcccgtcagcgtgactcaaaagtcagtttgacagatcttgtaagcgcggaagatgacaatggcaaaaagttttatacggataaccactcgg

SEQ ID NO: 31981 - DNA, 216 bp, Glycine max
  Peptide Sequence Number=SeqID_123666
atgtcccatgctgtcaaggacaatcgagggaaatgggccccgaactacgaagggccttttgttgtgaagagggcttttccggaggagccctggtgcttaccaacatggatggcgaagagctaccttcacccggatttcccgtctgttgtatctcttgatcgtcttgagctaccttctggggtgaggacaaaacatggacagcagaaaccaatcaag

SEQ ID NO: 31982 - DNA, 339 bp, Glycine max
  Peptide Sequence Number=SeqID_123667
atgattcaaagttttgaacaacaacaagaaatgtctgtcatagaattatgtgttgaagttgatgttgcgggtgcttctgcaattaatttgacaaattcattgttatcatgcggaaataatatgtctcacaatgaatcgggtagtgcaacagttggaacaaattcagaagaagattttgatgatgatgattatttaatatctaattcatacgctgaggactcactagatgaggatgaggatattaatgaaatgtctgacacagatgatgaagctgtccgtttgatcgaaccacttacagttgtgcaatcgggagaaggtggaagtcagactccattttag

SEQ ID NO: 31983 - DNA, 555 bp, Glycine max
  Peptide Sequence Number=SeqID_123668
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaagattctatcttcatgcgaaggatgtccaaatgttcccttgatgggaacaaggggttgtattaattataatctcgttctcgccataagacagcttggctaccccatgagaggagcgccattagacgaaagcatcacgcctttcatcacacgaggttttagtgaccacaacgcgagggtacttcaaggagtcgcaaggcatgggatgcggcgtgaagaaaggacagagagcttaggggaagcaactgtgagagacaatgaggttaaagcttcggaagaaagtgatgaggtacaagccctaaagcaaagcttgaaagagcccggggcagcaatagtgagctcaaactccgaagaggtgaaaggaatcatcacgggtcaaaggcatgatctggaaggacgagctaaaggcttgccttag

SEQ ID NO: 31984 - DNA, 333 bp, Glycine max
  Peptide Sequence Number=SeqID_123669
atgcaaggtttaaagatctcagaagcaagatgcgaacaattagataatggaggatgcggctttcaaaagccaatgaaccggcaagaagtcttccggtcatatccgcttggtcggtgcaaaccaatcggcgggcatcatgcacagaaaaatcaaacttccaatcgtcaatcagtgcaccttcaaatgaaatccatatcaatgaattatggatcaataatggaacgagacgaaaagagatttgtgtaccgtatccgctgttcctcagatgaaaacaatgatccagagggaatagaggaaggaatcggtgtttcctatgacccggaatgccgttga

SEQ ID NO: 31985 - DNA, 306 bp, Glycine max
  Peptide Sequence Number=SeqID_123670
atgacacgcggagataccttacggttatccgcacccttgtgtcatccagaggcggcgggcccgatgacaagcggagtaccttacggcaatttggaaaatccgggaacgacaagtcatacgcggagataccttacggttatccgcacccttgtgtcatccagaggcggcgggcccgatgatatgcggagataccttacggttttccgcacccttgtgtcatccagaggctgtgggcccgatgatacgcggagataccttacggttatccgcacccttttgtcatccagaggcggcggggcccgatga

SEQ ID NO: 31986 - DNA, 179 bp, Glycine max
  Peptide Sequence Number=SeqID_123671
atgagcctcagcctgcagagccagggttttacttctttccgtgccctactccgaaccagttcagggcagaggtcacatggcctggagattggcctaaggcccgggcaggagaggcaccagcagaggctcctgacgaagcagatgagggagcggggccacatgattgggagatcccttga

SEQ ID NO: 31987 - DNA, 180 bp, Glycine max
  Peptide Sequence Number=SeqID_123672
atgccatatcctgagggtggaaatcctgcatcatgtctagagaatagcttgatattgtctgaacttaattacaacaatgatgaggctagattagaattcaaaaatctttttctatcgatgacaggtggcatgttttttctatatggatatggaggtacagggcaaaaaatcaaattgtga

SEQ ID NO: 31988 - DNA, 198 bp, Glycine max
  Peptide Sequence Number=SeqID_123673
atggaggatatagaggaagcaaaagaacatcacctagatgaagatgctctgataccacatgacgtagctccatgtggagcttgtaggccttggttggatcttcttcatcaatggagtcctttgcttcttaaagataaatggaagcggaatggagaaggaagaaagatgattggagacaccacttcaaggagaagatga

SEQ ID NO: 31989 - DNA, 342 bp, Glycine max
  Peptide Sequence Number=SeqID_123674
atgaggggcatcgtgcatgagcctcaagatggacccttgggtactagtaccctcgtcttcagagggctgctcgccctcgtcttcaaaggactacacgttctcaccatcaaagggctgcatgcccacgccatcagaggactacccatcctcaccatcagagggctacacgccctcaccttcatagggttacacgccctcaccttccgaggactacatgtcctcaccttcagagggctacacgacctcgccttcagaggacaacacgtcctcgccttcgccttcgtagggctacacgcccatacctttagaggactacacgtcttcgccttcagaggactacac

SEQ ID NO: 31990 - DNA, 860 bp, Glycine max
  Peptide Sequence Number=SeqID_123675
atggaaaaagagtatgcctggtggatggatggcgtcgacgccctgcaacccgggcaagccaacaaacgcgtggtgaagctggatgatggcgctatcctcaatcgctactgggatgaccgcgatacgccgcgcccggaatcctggcttgatgatgtgaatactgccaaaagtaacccgaaccgtcctgcgaccgagatctaccgtgatttgcgttccgctgcggcctcgggctgggactttagctcccgctggatggatgacccgcaaaagctcgccactatccggaccaccagcatcgtgcccgtggatctgaacgccctgatgttcaaaatggaaaaactgctggcgcgggcaagccaggagagtggcgatgccgccagcgcgagcaaatatgaagcgctggcaacggcacgtcagaaagccatcgagagccacctgtggaatgataaagagggctggtacgctgattacgatctgaagagcaagaaggtacgtaatcagcttaccgccgcggccctgttcccgctttacgtgaaggccgcggcgcaggatcgtgccgataaagtcgcagcggcaaccgcatcgcgcctgctacaaccgggtgggattgcgaccaccaccgtcaacagcggccagcaatgggatgcgccaaacggctgggctccgctacagtgggtggccacggaaggattacagaattacggacaagataaggtcgcgatggacgtgacctggcgcttcctgaagaacgttcagcatacgtacgaccgcgaaaagaaactggtcgagaagtatgacgtgtcgactaccggtactggcggcggcggtggagagtatccgcttcaggatggcttcggctg

SEQ ID NO: 31991 - DNA, 258 bp, Glycine max
  Peptide Sequence Number=SeqID_123676
acttatcaaggtaatccttgtggcgtctatcctgacttatcttccttcaccggaagtggcgtctacccagacttatcttccttcactggaagtggcgtctacccagacttatcttccttcattggaagtggcgtctacccagacttatcttccttaaccggaagtggcgtctacccagacttatcttccttcactggaagtggcgtctaccctgacttatcttccttcattggaagtgcgtcatccaaaccttcgtag

SEQ ID NO: 31992 - DNA, 177 bp, Glycine max
  Peptide Sequence Number=SeqID_123677
atggaatatctaagctctgattccattgataaatcagaaactagtgagaattcgtatttccaatcaattactactgaattccttaattcattgaaaacgtccggtaaaaacattggcatggctgtttatattcccaagaatgtcaatgtctccttcacaatcaccctggccgtttaa

SEQ ID NO: 31993 - DNA, 475 bp, Glycine max
  Peptide Sequence Number=SeqID_123678
atgtctaaggccaagctcactcgtttcacaagtgaccctgtgaggattgctgctttctgcttcaagaacctgaagaaaactcaggttcttgatgctgacatttcttctgctgttgtcttcactgttagactagaaagttcatgtttttgcgttgttgtgtttctaatgcagaagaatgacaagattttgcaagaaatggatggtgtatcctatagagtgctgggctatcttcttcttggcactatcagaatattctcccgaaaggttgaatatgtgcttgaggactgcaacgaggttctcctcaaaatcagcaaatttgtcatccacaaagaaggcttaatacctgtggaaaccttgcgtatgcctattaccataccagaaaggtttgagttggatgcttttgagttggatggacttgaagatgctggcagaggccatactgctcctccagaagaaattacgcttggagacaaag

SEQ ID NO: 31994 - DNA, 138 bp, Glycine max
  Peptide Sequence Number=SeqID_123679
atggcctatggtaccgggaaaaacacaagaaagaagccaaaggaattaagcagaatatcctctgaatccaaattacttgttgacttggataattacgtgcctgagattttgcacaaaaagaatattacgatagtttga

SEQ ID NO: 31995 - DNA, 516 bp, Glycine max
  Peptide Sequence Number=SeqID_123680
gatgtacaatttgtggtggatatgatgaatctgaatgttgtatccctaatgaagaacaagtcacacatgaagtcaattatatggggaaccagcccaaaaacaattttaatgcagggacaatggaggaaccaccctaggaatcaattcaatagagaccaggggggatcatccataaggtcgcaaccacaagggcctagtctctatgattacaccacaaagctggaagagactctagctcaatttatgcaggtttctatgtctaaccaaaagagcacagagtcttgctataaagaatttggaggtccaagccgtcaagaagcttttagtgctaacactgagaaaaatccaaaggaagaatgtaaagctgtcatgaaaaggagcagaatgacaaaccatgtggatgaaagaaaagctgagaagaagatggaggaacataaacaacagttggctgttaaactggcactggaaccggttgatgatttagttgaacttgaagaaattgttgaggaagcataa

SEQ ID NO: 31996 - DNA, 558 bp, Glycine max
  Peptide Sequence Number=SeqID_123681
gtcgactctagaggatccccttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 31997 - DNA, 246 bp, Glycine max
  Peptide Sequence Number=SeqID_123682
atgggttatggagaaagaggggcaggaggtgttattccaccaaatgcatggttagttttcgatgttgagcttagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31998 - DNA, 216 bp, Glycine max
  Peptide Sequence Number=SeqID_123683
atggaaaaagatcccatgaaggctctccaactcctagatgctacaagtgtgtcataccctaatttcgtctggggaccattgtttgtcggcatgcgacctttgtttgaccacctcaaaatgtttaacacccatcgttgtagaatctgtaaagttccaagatgtttcgggaagaaaccggtcaaaaacacgaaaacaggagtgtatttagcaaagtga

SEQ ID NO: 31999 - DNA, 414 bp, Glycine max
  Peptide Sequence Number=SeqID_123684
atggacgaagatgagtggatgtatgaaataatgtctggacaagcggatatagattatgaaaatgcagaagcatgtggtgcaaatgaaccacatgttgattgtttcaatgcattcaatacttctcaggttataatgttaatgtatttgagtgccaagaggatgttttttgatgggctcgatccattactcatgaaaacggatttgtggcggagtggcgagtataggtgtaggaaaaaagaatttatcagaagagacactgggactaggaaatgtaggtgtcccttcaagctttgttacaagccagtgattggaggaaaaggctggatggtgaagttgatttgtggagtgcataatcatgaattggccaagtcattagttggacatccatatgcggggcgattgactaaagcttaa

SEQ ID NO: 32000 - DNA, 515 bp, Glycine max
  Peptide Sequence Number=SeqID_123685
atggctacctcaccaaaagaaacttccgcttctggttcacccgctgtaccatcatctccgcaccaggaacaaccggaattcaacattcaacccatacaaataattcctggtcaagcttcagtccctgagaaactgattcccagaagacaacagggggtgaagattgctgaaaaccctagccctgcaacaagtcctaggaaagtagacacggagatggacaagaaaatccgcggtattgtgagtagcattctgaaggatgcttctgtgcctgatgctgagaaagatgtcccaacatcgtccaacccaaatgattctgtgcctgatgtcaagaaagatgttccaacatcctccgctccaaatgctgaagccctcccttcacccagtgaagaggaatcatcaaaagaagaggatcaagcctcagaggagacccctgcaccacaggcaccagaacctgctccaggtgacctcattgacttagaagaagtcgaatctgatgaagaacccattgccaacag

SEQ ID NO: 32001 - DNA, 438 bp, Glycine max
  Peptide Sequence Number=SeqID_123686
atggcacctaccaggcaccctctggacccggataagtccaacagggccctgggatttcccgccttgatcacaggactctgccagtcgttcggcgtccccgtctcacctagcaaggtgattcggccgcccatcacccaagcttttattgagaagtattgcacgcagagacaggtccagggtgatgcaccacaggccgcggacgcgccgccacctcatcaggctggtccagccggatcgtttgatacggagcagtatttgtggcatttgatgagtctcagcctgcagagccagggctttacatcttttccatgccctactccggaccagttcagggcagagatcgcatggcctggaaattggcctgaggcccgggcaggagaggcaccagcagaggctcccgacgaggcagatgaggcccgtacgaggacgaggagatga

SEQ ID NO: 32002 - DNA, 369 bp, Glycine max
  Peptide Sequence Number=SeqID_123687
atgacattgctacttagcaatattctgcccagcgaccgcaatgccaatctccccctgcaaaagtatcagttggtctgtgtcgtcccgacatggggatcgcacccacaaagacacctagtggacctgaagaagtccaacagggccctggggtttccagctctggttacgggcctctatcggccctatagggcgctcgtccccccagcaagctcatgccatcatgacataggtaaggattgtgcccgcaagacacctagtggacccgaagaaggccaacagtgtcttggagttgccagctctaaatacgggtctctatcagttcaagggagtgcctgttgcccccagcaagggcatcaggccccctactaa

SEQ ID NO: 32003 - DNA, 276 bp, Glycine max
  Peptide Sequence Number=SeqID_123688
atgtccttaccttcagagggctacacgccctcgccttcagaggactgcatgtccttaccttcagagggctacacgccctcgccatcagagaactgcacgtcctcaccttgggtactaattaccctcaccatcagaggactacatgtcctcgccttgagagggctacacgtcctcaccatcagagggctgcacgccctcacctttagaggactacatgtcctcgccttgagagggctacacgccctcaccttgggtactagttaccctcaccgttga

SEQ ID NO: 32004 - DNA, 270 bp, Glycine max
  Peptide Sequence Number=SeqID_123689
atgggtattttaagaaatcaagatatttgtcgcaacatgcccttttgcgggcgagcgaggcgaggctcacgggagcgttttccaaaggaggaaaatgtgcgaagtcgccaccaacgtttatttgtggaaaacatcggaaaaaaccgaaggaaaccggtcaaaaagaatattccaagtttgggagttgtatttacgtttgaggaaggtcgacaaaagcggggctcttgctcctacgtaccctccctcgaagaggaaatcagacctacgtag

SEQ ID NO: 32005 - DNA, 259 bp, Glycine max
  Peptide Sequence Number=SeqID_123690
atggcttccatgacggatgccatgctaggaatgaggcaactaatggagaagaacgcggccaccgctgtcgctgttagtttggctgccaaagcagacccaactctcccagctatcgcgcaccaccctatcctagacatggtaggacaagaaagaagcacactggggcacatcagcaacccctatctgggatacaaccgagtggcttacccttatggattgccacctaattacacaccaccagtcatacgtgatgacgcgg

SEQ ID NO: 32006 - DNA, 194 bp, Glycine max
  Peptide Sequence Number=SeqID_123691
atgttttgtgctcaatttccactggaagatgacatgcctttcaaagacaacccgataaggagacattccatatgggtgctttgtaggcagtccgatgtgcccaagacatcatcaggggctctagacctgcagcaatcaatggggcaaaacacaccaaatgattataatgatggatggctcaaattctcacaaag

SEQ ID NO: 32007 - DNA, 384 bp, Glycine max
  Peptide Sequence Number=SeqID_123692
atggcttacacccacattccggattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaatggaatttggggtgaaccctacaggctttttgctgcaaaattcctttttgttggtgtttttttttttgtttgtgctaaaagtggtcttcgtcattggaagtgcggtagacagactttgtggttgatttag

SEQ ID NO: 32008 - DNA, 114 bp, Glycine max
  Peptide Sequence Number=SeqID_123693
atgacattaggtgctgaattcaatgtggaaagcttaacatgtagagattggaacacatcattcgaaagtatcccaaaaggtgcaagaaagaaaagaactacctatatagcatga

SEQ ID NO: 32009 - DNA, 327 bp, Glycine max
  Peptide Sequence Number=SeqID_123694
atggctagtttatcgtattatcacgaggaattgggatcttccacgggcaatttagttcatctggacttggagattgaagctacattaagaaggaacagagccgagaggaaaagaaaattactgcaagacaggacaatagtgtccattcttgaggaagaaactcatttttttaattcttcatcatctgattcaccatcatcaagggaatctgcgacctatttaccagaagccgtttccatggcggatgaacaccagcagagagttacccttgaggactattcaagaagttcagtgccgcaattctttacaagcattgcacgtcatgaa

SEQ ID NO: 32010 - DNA, 414 bp, Glycine max
  Peptide Sequence Number=SeqID_123695
atgcatgacaatctgtacattgtgctggccttacgtgacatgaattcaaattttgatcatattcgtgatcaaattctgactggtcaagaagttccttcaatggatagtctcatgacacgtcttcttcgtgttcccaccccaaggaagattggaaactcacttaagcattttgaatctttagcaatggtgtctactagaggaagaggggatcgtgggaattgtggaggacgtcgtggtggtggtggtagaaacacaaactcagaccttcgatgctcacattgtaagaagtggggccacacccaagacaaatgctactacataattggctggcctgataaaacagcaaatgtcaccaaatcagaaacacttgatcctaagttttatgaagaggagtataaagaatgccttcgatag

SEQ ID NO: 32011 - DNA, 439 bp, Glycine max
  Peptide Sequence Number=SeqID_123696
atgaaagatgtgggctgcgcacctcaaagctttgcagatttggtctttgccagtgaagggatcactgtgggtccgaaaaaaggcaaatttgatcatcctactaggacgactgagaaaactggggcaaataaagagggtgagaaagagggagaaacccatgctgtgactgccattcctatacggccaagtttcccaccaacccaacaatgtcattactcagccaataacaaacctccttacccaccacccacgagaaagcctgtagaattcaccccaattccagtgtcctatgctgacttgctcccatatctacttgataattcaatggtagcccttaaccctagccaaggttccatcaacctccatttctctggagaatacgactcaaacgcaacgtgtgcttgtcatggagaaaccccggggcgttccattgagcatg

SEQ ID NO: 32012 - DNA, 552 bp, Glycine max
  Peptide Sequence Number=SeqID_123697
atgatagagaaggattcagcagaagtggacaggcttgccaaactaaaagcaagcagaatgaaagaacttgtttttaagaagaggtcagagttagaggaaatatgcagattgactcatattgaaccagatccaagtattgtggccgagaaagctagtgcattaatagattctggattggtggatccttttgagctattagccaaaatcgaagaacagatcattaaggcaaaaaatgaagttttgagtagaaaagaagtaacagataggattgataagtggtttgctgcatgtgaagaggagaattggcttgacaaatataatcaagatgacaaccgttacagtgttgggcaatgcaatcacattaatcttaaacgtgcagaacacgctagaataactataggcaaaattccagggttttggagatttttagggtttagggtttttttgggtttggggtttggggtttggggttcggggtttggggtttggggttcagggttcggggttcggggttcaaggttcggggttcaggggtcagggtttagggtttag

SEQ ID NO: 32013 - DNA, 687 bp, Glycine max
  Peptide Sequence Number=SeqID_123698
atggcgaacttgaaacttgttcctcatgcaaacccccaactcagcatattacatgcacgtgtcaacaccccgaaactccacatttctatgaaacatcaccgccactacttcaaccccacaccatgtgcaagtccacgcaaccacaacacacaccccacaacaccatggcggggaaggtggcagcggcattctgaacctcatcccggagatgtccctcacgggttcccaactcctagctctcctcgccggcgttccccttggtgcaatgctgctcctcctctccggcatctcgctcatcgccagcctcttggggctggcggtggcgacgccgctcttcatcttcttcagcccgctgctggtccccgccgccttcgccataggaatggcggtgaccgcggtgctggcggcgggggcgtgcgggctggcggggctcgtgttgttctcgtgggtggtgaactatctccggcagatgccacgggggacgacgatgatgacggtgctgccggagcaagcgaagcggcacgtggcggacatggcggagtacgtggggcagaagacgaaggaggttgggcaagacattcagacaagggcacatcatgcccagggaacaacaaggatgacagtgcattgagttatcatgagacaagaaaatggtttcaatttatatcgcttatgtatgacttgtga

SEQ ID NO: 32014 - DNA, 894 bp, Glycine max
  Peptide Sequence Number=SeqID_123699
atggagtggttgggattggggccttttctcattgttgtaaagtgccttttctttggtgatgtttcttctaagagagatccatcaacatacttaagttatgtatttgccatatatgattattaccaaaagaagtattgcatctatgaaaagggagaaaatccttgtaaggttaagttgcctcttattgtgaatactcctggctgggtgaaaggtgttggttacgatgtattagtggacatgttgaaatatatttctccaacacatgtagttaagataagcatagccagtgaaaagaagaatctacctgctggagaattctggttagatggagaacacgatgaaacaattaacctaattgagataaattctgctcatcaggactcattaaatagatcgttgcttgttcagaaggatgcacgtctcctacgtgatctacgaataatggcttatttcaaacagtgcttttctagtgattcaaatatttctacaatcaaggaacttgctcatgccttggcctctcactgtccttatgaagttcccattgcaagcataaagattcgacatcttcattgtgaggtcccaagctccgaaatattcttcagtttgaatgctaccattgttggcttagctgttgattctgaaggacctgaaaatttaccttggtgtcttggtcttgggattgtgaggggaattgacacagtcaaaggtgtgctttatgtcattactcctgtaccacataattctctcgaaaaagtcaacgtcttgctacagggttatatccaaattccatcttgtttattgcaggcaagttattgctttcataacgagcaaagtgccgcctgtgagaggcaaacaaagactaccaacatgatgaagccgtcccttgagacataa

SEQ ID NO: 32015 - DNA, 2073 bp, Glycine max
  Peptide Sequence Number=SeqID_123700
atggtgaaattttacgaggttgaatttgagctgacgtgcattttttttgagttttgtgcagaggtagggattcgcgctcctgctttctcagactgggtttggcatgattttaggcttgtgtgtttgattagcttagttttgtgtgatgctaatactcttacttctgtgcttgggcagcctaattatcttttattctgcgaagtaactgagagattgaagatgggaggagatgattctggtttggagagtgacaattttgattggaacactgaagatgagcttgaaattcagaactataactcgtcgtcttcatgtttaacccttcctaatggagatgctgttactggctctggagagctactaatgtcctattctctcccccttcaggcaagctcgtctgcagttttggctaattccaaggtgcttgatcacttcgtcagcatgggattttctagagaaatggtttctaaagtaattcaggaatatggtgaggaaaatgaagataaactacttgaagaacttctcacatacaaggctctagaaagttcttcccgtccacagcagcgaattgagccagatccttgttcttcagagaatgcagggagttcttgggatgatttctcagatactgatattttttctgatgatgaagaaattgcaaaaactatgtctgagaatgatgataccttacggtctttggtgaaaatggggtacaagcaggtggaggctttaattgccatagaaagattaggcccaaacgcctcacttgaagaattggtagattttataggtgttgctcaaatggcaaaggctgaagatgctcttctgcctcctcaagaaaagttacaatacaatgactatgctaagtccaataaacgaagattatatgattatgaagtgctgggaaggaaaaagcctaggggatgtgagaagaaaatcctcaatgaagatgacgaggatgctgaagctcttcatcttccaaatccgatgattgggtttggtgtacctacagagtcaagcttcataacacacagaaggcttccagaagatgccattgggcctccttacttctattacgagaatgtagccttagcaccaaaaggtgtttggcaaacaatttcaagattcttgtatgatgttgaacctgagtttgtagattcgaagtttttctgtgctgcagccaggaaaaggggatatattcacaatctccccatccaaaataggttcccacttctaccacttccaccgcgcacaatacatgaggcttttcccctaacaaagaaatggtggccctcatgggatattaggaccaagcttaattgtttgcaaacatgtattggcagtgcaaaactaacagaaagaattaggaaagctgtagaaatctatgatgaagatccacctgaaagtgtacagaagtatgttcttcatcagtgtaggaaatggaatttggtttgggtgggaagaaataaggttgctccattagagcctgatgaagtagaaacgctgttgggcttcccaaggaaccacaccagaggaggtgggataagtaggactgacagatacaagtcacttggtaattcattccagaaccctatggcaacattcaatctatgttgtgagaccttagcaaaggctttggttgacactgtggcataccacttgtcagttctgaaggagatgtatcctaatggtatcaatcttctttctctcttttctggaattggtggggcggaggtagctcttcatcggcttggcatccctctcaagaatgttgtgtctgttgaaaaatcggaagttaataggaatattgttagaagttggtgggagcaaacaaaccagaaaggtaatctatatgatatggatgatgtaagggagctagacggtgatcgcttggaacagctgatgagcacatttggtggttttgatctaattgttggtggcagtccatgtaataacctggctggtagcaacagggtcagccgggatggactggagggaaaagaatcttctctcttctttgattattttaggattctagacttggtaaaaaatatgtcggccaaatatcgatga

SEQ ID NO: 32016 - DNA, 711 bp, Glycine max
  Peptide Sequence Number=SeqID_123701
atgaagaattatatgaatatgaaactaaacagcattgcattggtcattggcattgcattttctgtgtggtcttcaagctgcacagctgcacgagtcagccactggaggaaactcaaagctgcctatgctacaacttttaatgtgttagactatggtgctaaaggtgatggacatgcagatgatacaaaggcctttgaagatgcatgggcagctgcttgtaaggtggagggttcaacaatggttgttccatctgattctgtatttttggtgaaaccaatctctttctcaggccctaattgtgagccaaacattgtttttcagcttaacaagataacaatcaaaggtaaaggtgtcattgatggtcaaggctctgtttggtggaatgactctcccacttacaatccgacaaaagtgatggtggaaagcagtggaagacttccaagcacaagaccaacagtaacagtactccttgagcaaaatcacactttaacccttctttattacgattatatactggcacttaggttctatggaagtgatgagtcacaggtctatgatataaatgtttcatcacctggtgatagccccaaaactgatggaattcacttacaaaactcccaaggtgtggtcatctatagcagcacacttgcttctggtaagcataatcctgaaagaaatcaaaatcttaaatgtatcatttcatcatcttga

SEQ ID NO: 32017 - DNA, 663 bp, Glycine max
  Peptide Sequence Number=SeqID_123702
atggggttgtcgttcacgaagctgttcagcaggttgtttgcgaagaaggaaatgaggattctgatggtaggtctcgatgctgctggtaagacaaccatcttgtacaagctcaagcttggagaaatcgtcaccaccatccccaccatcggatttaatgttgagactgtggagtacaagaacatcagcttcactgtgtgggatgttggtggtcaggacaagatccgtcctctgtggaggcattatttccagaacactcagggtctcatttttgtggttgatagcaatgatagggatcgagtggttgaggcaagggatgagttgcacaggatgttgaatgagtctccccacagggctgcttcccattcccaaggttttgaatgtgttctagtcctacgggatgaacttagagatgctgttttgcttgtttttgccaacaagcaagatcttcctaatgcaatgaatgctgcagaaataactgacaagcttggacttcattcactccgtcaacgccactggtatatccaaagcacttgtgcaacttctggagagggtctctatgagggtttggactggctttctaacaacattgccagcaagataatagaattgggagaagatgagagtgtaaggaagaatacgagtaatagaaaattggaagcatga

SEQ ID NO: 32018 - DNA, 423 bp, Glycine max
  Peptide Sequence Number=SeqID_123703
atgataatcctcctagaagaaactaagaaacccaaaaaagcccgagcaatcgagaaaggcacaatgcatgaggaacctgtgccatatcttggcagtaaacaggggcaagtctgctactgggcaagcacattactaagaaaggtggtggagttgttgaccagtgctgcagatggtgctaaatcttcaattgatgctagtgataggctaatattatatattgaaatagctcgtctatatggaagtcttggataccagagaaaagctgcattcttctcaaggcagattgcacggttatgtctgcagcaaggaaatagattggctgcaattagtgccatgcaagttttgacaatgagcacagaagcttatcatgttcaaagtagatcatcagtctctgatcattctttgcacaatgtgagttcataa

SEQ ID NO: 32019 - DNA, 78 bp, Glycine max
  Peptide Sequence Number=SeqID_123704
atgaagcatatgttaaaggaatgggtcacgtgtcctcttcgacgggacgggagtggctggttacaaaaatgtaactag

SEQ ID NO: 32020 - DNA, 2442 bp, Glycine max
  Peptide Sequence Number=SeqID_123705
atgggcacggatgaaagtgacagcatggttctaggttcagagcaggagaaggaggttagggaagttcttgggggtttgaggagtgaggagggtagttgtggggttactgtgaatggggatgggttttctagcattgaaagcgaagggttgtgttgtgatggggtcgttgactttgtcgtcgagaatagtagtgtcttggagaccaaggtttcagttctgagtgaaaacgattgtcaagttttggctgattctgaggtgaatggggtgccgtcttggttaggaatgcaagaaagtgatatggatgcggtgttttccggtgatggtgctgagaagttggactttggttatggttctgagaagctggactatatgtttgcttctgagagtacagttcctgaggctgctgttttgagtgtgaaccgttcggtagaggttggtggagaagatggaagaggagggaagagtgaagagacaggaacatttgaagattgtgatgggggcattgtcgctgttggttctgagagtagagtggcagaggcttctgtttcgagtgttgaaggtttggtaggggttagcacagaagacagaagaggagggatgaaggaagaggaaggaatagatgaaaattgtgatgaggatgccgtcgctactgcttcggagagtagagcagctgaagctgctgtcttgagtgtggataatttggtacgagttgttggggaagatggatcagttgaggggataaatgaagaggatggaaaagatgtagattgtgatgggaacattgtggctgttgcttctgagagtagagaagcagaagcttctattttgagtgtggatagtttgatagggattggtggggaagtcgtaagagatgggggcgaaagtgaagaggtagaaaaagatgaagattgtaatgggaacattctgactcttgaatccgagagtagagttgcagaagctgctgatttgattgtggacagttcagtaggtcttggtggggaagataaaacagagaggggtgaaagtgaagaggaagaaaaagatgaagattgtggtgggaacattgtgactatagaggttccagttgcagagacaagtgagaacatggatgtagatgtggaggacttgagtgttgaagttgagagtcatccttcgtggcatggccggatttatgatccatctgatgaatcttactttgcattgaggctgaaacaaaagaacagacttctggttgcctactttgggaatggaacctttgcatggtgtcaaccgtcacaattaaagccttttggggataactttgatgatatggttaaacagaatagctccatcgattttgccagtgctgtgcaagaagctgtaaatgagtttggaaggcttctgcatttgaagttgagtcatccatttgttgctaagaaaactggtcctgagtccagtctccctttggcgaaaaactctggcatcaaggaaggagttcttgtacctgaaaatgccatagagagacttgattttctaattgaaccagcagaattactttcttatgtgaaacaaatttcgcaaattattgagtttggaagtattctggagcttgagatattaaaggctcagctttctgcatattatctgtcaaaagggggttataaattagctgattatatggatccccagccgattcctggagttgaagatagtgtcatggatgaaacagttgctggagatgatggtaaaagtactgtggaagcaccaacccaagggccatttgatgaactgggtcattctccagggctttcagggagcatatcgaaccctgttagaaagcagaaaagcattgccgaaattatgggggaggacaaagatgttcatacagcaaatagggagctggatgcaactgttgaaatggtgaatgcaattgggtcaaatgttggaaagaagagaaaaggtagtgaggatggaatggcatctaaacctgttcaaaagaaaatggagttgcttctagatgctgatggagatgtgtcatgtgctaaaaatgatggcaatggtgatgagggaaacagcgacgttggctcattgctgcagtcaaaagagaagaaagaagcttttgatgaagggaagagcgaagaacgaaatgagaagggtaatttgtcaagagaaaggaagagaagcaagtacttgtcccctcctttcactattccaaccagggggcaaagggaggtatacttagaaccggaatctcttaaagtatccagaaaagctaaagtatcacagcgaagggcaggggatgctggcctgagttctcttccagtttacaaggggaggttttttgatggctcaagttatcaaacacgagaagatgatgggaaaaatattgtggatccaaacaaaatccagctcctgtggcggaagttctgtctcaagtcctcaatgcagctattagtccactaa

SEQ ID NO: 32021 - DNA, 540 bp, Glycine max
  Peptide Sequence Number=SeqID_123706
atgaataaaaagagacagagaaaagaaagatatgcctatggagatggttcaggggacagtacattgagaataatgaagaagaagaagaatcagagtgaggagaagaatccacgtggcaggttcgagaaggaggaggagggtggcggggaaaagataaagtgttcgaccaagcattgtggttcatgctgcggcggctacgtggctgattgtgtggcagtgtgttgctgcccttgcgcagtgctgcattgttgtgctatggctattgtcaaggggccttctcttgtggggagaaagtgtttagggttgggaaagaagaacaagaacaagaacaccaagaaaaaggggtgtgaagatgatgttgttgttgttgttgttgagaggaacaagaacaacaacattgaaagagttcaaagggctgtgagggaaatggacaatatcactgtcaatgctggatttgatgcagagaaggtttggaaggagctctatcagatcggtcatatggattttgggagggtttctagttcctcacatgatgattaa

SEQ ID NO: 32022 - DNA, 258 bp, Glycine max
  Peptide Sequence Number=SeqID_123707
atgtcacttccaaaattggtgttctggattacaaatatgctgcgaaataacactttcagaatggatattccggaagcttactccacaattctagataaaccattctggaaacccatttccctttcgtatagcccatttcggaagcttaactccagttcagtgatggcgttgggtttgggacgaaaaagaagaaagagggaaggaagggtgtcttgcggtggtgcagaggatgacagggagtgggttgggagtgcttag

SEQ ID NO: 32023 - DNA, 2244 bp, Glycine max
  Peptide Sequence Number=SeqID_123708
atggcagcagaatttgttggtggtgctcttctttctgctgtccttcaggttgcatttgtcaggctcgcttctcctaaagttctagacttctttcgtgcaagaaaacttgatgagacgctgctggacaggttgaacacaaagctgctgttcatcgatgctcttgctgatgatgcagaacataagcagttcagagatccacatgatttcttggatgaaatagattatgaactctccaaatgtgaagtggaagatcaatctgagtctcaaaccttcgcttgcaaggctactaattctgatgttggatcaggaagtaaagtgtcacagaaattgccatcaacttctttggtggttgaaagtgttatttatggcagagatgatgacagagaaatgatccttaattggctcacatctgaaactgacagctatcagtatttactattgtgggcatgggtggattgggaggctgattttcatatcaaagcttgggtctgtgtttcggatgattttaatgttttcaggttgacaaaaataattcttgaggcaatcactaaatcaaaagataatagcagagagctagaaatgattcatgggagattgaaagaaaaattaacagggaagagatttcttctcgttttggatgatgtttggaatgaaagacgagaagaatgggagtctgtgcaaactcctcttaatcatggtgctccgggaagtagaattcttgtcaccacacgctgtgaagaagttgtttgtatcatgcggtctaataaagtgtatcacctaaagcaattacaagaagatcattgctggcaagtttttgtaaaacatgcattccaagatgatcattctatattgaatgctgagttgaaggagattggtacaaagatagttcaaaagtgcaaaggattgcctctagccttgaaatcaattggaagtcttttacacacagcaaagtcatctatttcggaatgggaaagtctatcaccaccttccgtctcatctcaagatgtgcttagcttgttgtgccttatttcccaaagattacgagtttgtcaaggaacatctataattctgctgtggatggctgaaaattttatgcaatgccctcaacagagcaagtgtccagaagaagttggagaaagatacttcaatgatctattatcaagtttacatgatgctaaaaggttgcgtacatttatgccagcaagtcgggaaatgatgtttgctgatgatccttggaagtgcaagatgtcattacatgaattgttctccaagtttaagttcttgcgcgccttatctttgtctggttgttctgactttagagaggtgcctgactctgtaggcgaactaatacatctccgttcgttagacttttcacttagtggcataaaaatattacccgaatcaacatgtttgctctataacttgcaaacactgaagctgaactattgtcgcaatttggaggagctgccctcaaatttgcataaactctccaatttgcattgccttaaatttgtatacactatagtgagaaagatgccaatgcatttgggaaaactgaagaatcttcaagtattgagtattttttttgccggcaaaagtagcaagttcagtactaagcagctaggggaactcaatcttcatggaaagctattaattggggagctgcagaatattgtgaatccatcggatgcattagcagcagatttgaaaaataaaacacaccttgtgaaactagagttagaatggaattcaaaccatagccctgatgatccaaggaaagaaagggaaaatttgaaatcattgcctaaactcatgcatatcctccttccgtctcttactgacctaacgatatggggttatccacatgtagagatgtttccagatggaggtttgccaccaaatctgaaaagggtgaatctcttaagttccaaacttatcgcctcactgaaaagggcattgggagacaacgccagtcttgaaaacttgggtatattcaaagactggattaagaagaaccacaagttccaaattgtggatgcaccaatcctcataagtctaactcttcatcaggcgctaagcgagcaactaactgcaggcgctgagcgtggcgttaagcacgaagcgcacgatctgaacgcgctaagcgcgaggtatggcgctgagcgcgactacgaaggcccgcctaaaaagccaacgatgtacaatgagcttcaagagttatcaatgcaaaggaatttattccag

SEQ ID NO: 32024 - DNA, 279 bp, Glycine max
  Peptide Sequence Number=SeqID_123709
atgtcaacctcttccataaacgggtggtgcctctcttccatctccccagccaaaacctctctcaggaaggccacattacgcccttccgtcttcgcaacccttaacactccttcttctccttcctcttcatcttccttcccctctctcattcaagacaggcctgtttttgctgcccctgcccccatcatcaccccaactgtgggacacaaaattctcataaactttgcacttttggatcacaatatgtgtttgagttgtcaccatgacttagctagttga

SEQ ID NO: 32025 - DNA, 693 bp, Glycine max
  Peptide Sequence Number=SeqID_123710
atgaccttccttgtcccaaacaaagccagacccggatccctgtggaacctccaacacgtccaatgtgaacgcatcctgcctaaacacgaaacccccaacattgagacaaatcaaaaggacaacagagggagtgttttcctggaagaggcgaacggtggcgagttcatcggactggagcttcctgggggaggtgacgacgaaggcggcggcggagtcggcgtcagagaggaggagagtgaaggagagggcgagagaggtgcagagaaggagaagggatttgggaatggtgagtttggggaagagaggtattattggaagtgttggatttggggggcgaaggaggaagagggtgggagtgtagagatggagggatttggaaaggaagaacgagagaatgaagaagaagaagaagggaagagtgtggaaatgagtgaaaaggtggccattgttttggttggagtgaccaaggatgatgccatagaaaggattgaatgtctcaaggttcaaaaactcaattttgctctccccaactttgtgctaaccatgaacctgatccaggcatcaaagggcatgtgtctatgtacatatgatcttgttgacttcgtgcttggtacaagtgtgttgttatgcgtttctgacatgtcaaagatgcaatgtactacctggtttgtcgctaggcttggtcataactaa

SEQ ID NO: 32026 - DNA, 405 bp, Glycine max
  Peptide Sequence Number=SeqID_123711
atggctgttcaaagacgggttttccttggttttctaagaatgtgtacattcatctacaagtcttttttaatgtcgtacatatattatagtcatgaatggttaagtgaagattcaaatagaattcctcctcaccaagatggagaacttactcgtgaaagattgaaatgtttcaaaaggtattttgatgatgataatgaaagaagacaagtgaatatagagtttgcaaacttttatggtggaagaaaagactttgatgatattgactctttaagggatagaagtctaatggaggcaaagtcttggtggctagcagtgttattaaaaagtggttatggcggcggtacggcgttgcggaatttcagaaaaacgccaccaaatagcagtggcgttgcggaattgcgataa

SEQ ID NO: 32027 - DNA, 549 bp, Glycine max
  Peptide Sequence Number=SeqID_123712
atggagcgcgcgaacaccggattcacaacgaaaccctacgtagaaggtagaactgttgctgctgcgtttcttttacttacactcactcaattgaaacttgaaaccctagaagagaagaacgatgtggaagtggttgttctgtcgagagccagcgccgccgccgatgccgccgacggtggtgctggtgccgccgctcttcgacttccctcccctcgccgcgcgcaaccgcatgctccaccccatctacgacgtcgttttcggcaagctcgccatcacctccctcttccaggactactttcaccaggccaggcacttgaccacccgaatcatgctcaagccgatcgacaatcctcacgtcgatgtcatcgcaaccgtcctcttgatcacaagccggaagaaagtattgccggagatgcgttgtttcgctggcaaagcttgttgagttgttttttgtttgctttggtgggtgcagtgatgttaatgatcctcacacgcttatggacctttatgtatccacgtccgatccgtaagtacctcttactcgaatga

SEQ ID NO: 32028 - DNA, 441 bp, Glycine max
  Peptide Sequence Number=SeqID_123713
atgcatgtaattgatcacctaatgcagatgcgaaatgattcggttgtggctgcagcgcttaatcctgcagattctaagagggctcttggggttttgaaggacactgactctcccttacctagtgttccggggtgcgatgttgctggtgtggtggtcaaagtgggaagtgaagtaagcaaattcaaggttggggatgaggtttatgctgctagccttcctttagccatcatcactgcttatcaaggatttgaaaaagttgagttttctgctggcaaatctatacttgttctggggggtactggtggagttgaatcccttgttatccaggctttgaccatcgtgattgagttgctgattgcggttgatgagagtttgacttacaagacctggccacgagccattcctgcaaatatttcattgataaagacatggcaatgttag

SEQ ID NO: 32029 - DNA, 699 bp, Glycine max
  Peptide Sequence Number=SeqID_123714
atgccaggttttcatttgatcccactcagaaattgggtctggatattgcctcttgcatccttacaagggctccattgggacaagatgctgaaggaaaaccaaaatttgttatacgcccggtacttgcatccgaatcttcaggtatatcctgaagggaaaatgagccagcattttgcaagcttaaaaccgggtgatgttgttgaagtgaaaggccccattgaaaagctcagatatactcctaatatgaagaagcatattggcatgattgctggaggcacaggaattactcctatgcttcaggtaattgaagctatattgaagaatcctgatgacaaaactcagatatctttactttatgctaatgtctccccggatgacatactgcttaaacaaaagcttgacattctagcaacaagccacccaaacttaaagatattctacactgtagataatccaacaaaaaattggagaggaggtgcggggtacatatcaaaggatattgttgtgaaaggcttacccggccctagtgatgatactcttatacttgtgtgtggaccccctggtatgatgaaagcaatatctggagaaaaggccaaggactggacacagggagaggtttctggcgtcctaaaagaggctggatacactgaacaaatgttgtctagcatggaagtcaataatgggcatctgtgggggtaa

SEQ ID NO: 32030 - DNA, 489 bp, Glycine max
  Peptide Sequence Number=SeqID_123715
atgagctggtctgggggagattggatgtgtggtgtttgcgaacacataaatttcaagaagagggaagcatgccagagttgtggataccccaagtatgggggacctgacccttcaacctacagatacaacaggactgaagctttgccaggggactggttttgcaactgtggagctcacaactatgcgaatcgatcaagctgctacagatgtggctcaatgaaagatgattactcttcaggatatggcaacaactctggaggatatggatctgacactttccccccaggatggaagactggagactggctttgcccaagttcaatgaagagcctgcatttaattatgtctacaaacaccaactacatatcacctatatgtccaactagtccaagtaaaaacggggttaacctcacactagatgattggtgcaattgtctttatgtattttatgatggttggtacaattgcttaatttcaccgatcatctag

SEQ ID NO: 32031 - DNA, 444 bp, Glycine max
  Peptide Sequence Number=SeqID_123716
atgcagagatctcgaaggtggagaatggattcttgtagaagaactctgaagatctttgcacaatctttgaaaaaaaataaaaaattacaaatagaacaatcaacaaaccaacaaccaacccgcgggaagaagaaaaaaacaatagaagaaggaaaaaaaataccttccttgagtggatgttgggcattgcgggaaggaggaagaagggggagagggagggggaggtggagtcgcagaaggaagaagaagggggaggttgtggtggagaaggaagaaggggaagggaaaaaagtgaaaaataaaactaagtgggggatggagagagtggagcatgggggaaagatgaagaggcagggagaaggaaagagtggaaaaaaaaagaagaaaggagaaagtgatacgtcgggggaaggagagtggacattaaggaaggagaaagattga

SEQ ID NO: 32032 - DNA, 609 bp, Glycine max
  Peptide Sequence Number=SeqID_123717
atgagtaaccagacaagggaaattcagttatatgtttcaaatgagtttgtggtgaagaaagcgagaaataatctgaatggccatagcagtgtttttccggcgcaaggcatcggtgttgtcgatgacgatatcggcgggatcgacggggaggaagcggggggagtgctggagcaatccttcgtcggacaaggaggcttcgagaagctgagagacgagagtgaagagaaagagaacgagaacgacgccgggatgagggtcgagggaggaatagagttgggagaagtgaagaagatgatggatggaggacatgacggaggggtaattggggaagtggatgaggagggagaaggcgtggcggctgaggaggtccatgtagagagtgtaggcggaggggtggaggcggcgaagagggaggacgcgggaggagaggagggagagggcaaggaagggagggaggaggcggagggacatggctttctcgaggaacttccaggtgatgggaaggtgattgtcgaagcagatgtgggagaccaggcggtgggccagctcgatggaagggagggagacgccgccggagttgagggcggagctgacctggatggaccatag

SEQ ID NO: 32033 - DNA, 1749 bp, Glycine max
  Peptide Sequence Number=SeqID_123718
atggatggctcagcctcaaagcctggtcacacaacaagaggagttggtttggttaaagcttctgttaacttatatggcaacaggattgaagatgtcaatagtcctttgctgaaaaaatatttctcaacgaagcaatcttctaaagcaaaagaactccacagagcaagcaaggatatggttcggtacaaagagaccaaacgggtagcagaatctgcaaaagctcaagcagaagctaagctttccaatgccaaacagacagtgaaagaccttttctctatgattggggaatctagctacaaggcaaaagcccgaatgcgagatgtggcaccactaaaggagtatgggaaaccaagcaagaatgatgatgataatgagtattcacaagttatgagagaattggaacatgctaaacgggaatttttccaacttaagcttgatgtggcttctgttttggaggagaaacagcgagcagaaaaggaaatcgaagcatcgagatccagcatgctgtccttctcaagagtagcacaaaaactgaggaaggagattgaggaagccagtgaagaacaagtggtggttgaattggctagaatggacgctttgaatgaaatgagagacattgaagctcttgaaaatacaaggaacagattgaaagaggccattgaagagataaatgagtcaaaagagcttgaaatgaaattggccacgacattgtctgatattgatatgttgaagaatgagttgaactttgttaagaaaagggttgaaagaggtgagagcatggagcatgtggaaggagaatcaagagatgttggtgttttagagactgcaacagaagaaatagaggcagcaaagaaggacttagcttccattagagaacaaggttttaagtttatggcctctatggatgttacaagaaatgagctgaagcatgtgaatacagccacggttcatttaaagaacactgaatcgaaaatgggtgcaaaagttcgaaacctcagttacaagctcttgagagcgaaatctaaattagaagcggtgtctgctgcagaggaaaaggccaaatcaatagtcagtaacttgtcccaaactcttgataagctcaagtccgaaacagaagcagcgaaaaaagaaaaagagatcataaatggagaggttgcagccaccaaagaagatattaaaaaggccttgttggagataaaggtgagtgaggaaggatttgaaggcgcgaggcaggagcttgaagcagtgaaatcatcagaagctatagccttagagaagctgaagattcttacagagaatgtcatgagcatgagggagagaattagtttaacaaagcctagttccataattatcatctcaaagtttgaatatgagtatttgagaaaccatgcaaggaaggcaaatgaaattgctgagaagaaagttgaagcggcaaaggcgtgggttgaagctgtgagggccagtgagaaggagataatgatgaagactaagatagctgctgctgaggcaagagaaaagagagaatcaaagaagggagacaagtatgagtatccatcaagaacaaggccaaagagcatgacgccttcttcaaggggatcatctaagtttcagaaggcttcttcacctcgtcctgtcagtcctttcattgttaagaagaagaaaaaagttataccaaattggaccaagattttcagagggaagaaaaaccaccagcagtacgtagcagctgggaaattagtaactttatga

SEQ ID NO: 32034 - DNA, 1914 bp, Glycine max
  Peptide Sequence Number=SeqID_123719
atgttctaccttcagttgaatcttttgaatggatcgttgtcccgggcaatgtcaacttccaaaggtaggagcatgcgcagcaaggtggaaaggcgaatgcagaaagagtctggtaagactttaagggagattcgcagagcgaaaaagttgaagaagaaactcatgactgaggaggagaggctcatttacaatctcaaaagagccaagaagaaagtggcattgcttctacagaaactcaagaagtatgagctaccggagctgcctcctcctcgacatgatccagaactcttaacacctgaacagcttcaggcgtataaaaaaattggattcaggaataagaactatgtcccagttggtgttcgtggtgtctttggaggagttgttcaaaatatgcatctccattggaagtttcacgagaccgtgcaagtttgttgtgacaacttccccaaggaaaaaataaaagaaatggcttcaatgcttgcaagattgagtggtgggattgtgataaatgttcataatgtgaaaacaatcattatgtttcgtggcagaaattatcgccaacccaaaaatttgatacctattaacacccttacaaagaggaagctattgttaggcttgactgctcaaatctgttgcctcttttttttccctttgaaaattcatcatttctgtccctggttatgtacctactatacaaagaacttggtgttggaggaggctcttttcaaggccagatttgagcaagctcttgagtctcagaagctaaacataaagaaaatagaacagcagcttcggcggatgggagtaaatcctgaggatccagctgccatggccagcatccagagagttgcttccacattcttcaatgccatcgaccagaaagaaggaagcccttatgtcttccgtgaaggcaagcagtcaataatagaacctgctgaaggttttgaagagtcagagcctacagctgatagtgatcaggaagagctagatcggttcattgctgagatagaggatgcggcagataaagaatatgaagctgaagaggcaaaagaaaaagaagagtttggcagaattagatactggaacaaagaagaatttggtggaagataccgaagatcagattcttctagaaatgatgaccatgatgttgaggctagaggctcaagggtttggaatactacacatcctaagcgtcatgctatcgatagtgatgatgaagagaatgctcattctgacaatgatgatgatgatgatgatgaggaggaggagtggcatttcaataatattgcagatgctagtgatcttgacagcaattctgatgaatctgatggaactagaggtaagttcaaggaaagtaggaggaaaagagagaagcagaataatcctggtatcggtcgggccagagatgacgaaagttcaaatagacatgcaggagctaactttaggaggaatatggccataaaagattccgaatcagaaggcatgctcagtgatgttgaaaatgcaatgtgggagtctgaggatgaggagcaagagaataatgactcaggacatttgagaaagttcagtggtaactacaggagtagtagcagtgatgatgagtatgcacatcaaacaatgagtaacaagaagagtggtgtgagggatcatgagagtaaggttggtggttctgctcaatatcacgatagttttgatgcaccaaacagtgtgagagggatgcatgcagttaacaaaattgattctgaatccgtagatgaattcagcagttcagaaaactggctgtggccttcagatgctgaggagactggggactaccctacaaatcaaaatagtaataatgtgatcaaaagtgatatccctaagactaagaggagaacaccaaaagagacagatgaggcatgggacagtgactag

SEQ ID NO: 32035 - DNA, 483 bp, Glycine max
  Peptide Sequence Number=SeqID_123720
atggaatcctcctcctcctcaagccatcaagaaggtttcatgggctattgcggtttcaataccaacatgatagtggaattgcttggtatctttaacggtctcaacattgctaaggctgctagtttttgcactgttgcttgcgagacaaattctcaaatagcgttgcagatgatctctcaagcggagtggcccctttccgcgatggagagccttgttgcggggtggattgaagtagccatggttatcaaaatcacactcgagcaagttaggatagaattgcgagtctgcatcgagtttgcgagtttgttgttccctcactctatcccgcaacggtgggattgtgaaagcgaaggcaaggtgcgcatgcgtggtgcccgcagccacatgcgtggtggccgtggcgacggtgaagtgtgtggctgcaacaagccaacaacggtgaagggagtctccgcaacggtgagtgcgatggcccgagactag

SEQ ID NO: 32036 - DNA, 366 bp, Glycine max
  Peptide Sequence Number=SeqID_123721
atggatgaatgtaccataaattttcttccagtgatggtagaaggaaaggactctggggagaatgttatgggagaaaggcataggttgagaagaggccttcaacatcatgccgacaagttccttaacgtttccaatgaagaaacgataaggggggcctctgatcccttgcttggagaaatggccttcaatttttctgggtcgccaccagagcaagacagtgagcttgaggaggaagagaaggagcatgaagtggcttggctttttaatactagaaagaaggacatggacaaagagagagaaagaggagttaaccaaggccaacggcgtaggggccgccactggaattctaagggtcaacgaatgtga

SEQ ID NO: 32037 - DNA, 2562 bp, Glycine max
  Peptide Sequence Number=SeqID_123722
atggaaagcaaatgcacaaaaggaagcaacattgaagaaaagataggctctgataccatcttagaaggtagtttggggcctaactcaaccccaaaagctagctcatggggtgagacaattattgctagtgtctttgcaaatggtaatactgtgatttgtgaagcacggagttttttaagggtgggagttccatctactgtcacattgcatgtacagagtgaacaacttgggattggccgcaaattgccaatttatccgttatttcctgagggaactttgtcttctttctatgagctatgtaaaaattaccagtggagtattgaagatgaaaagaccactgaaatggagtattgcaaactacacaaaacttgtgctgctagtaatggaactgctaattatcaactatctgattatctgccttgcatttatcaccaagctgtcacaattgttttccttatctccacaattatcaaccgagtctatcataatactcaactctatccgcatatctcaaccttaactaagcctgctaccaaagtattgagcttcaaggtggcagagaccttgcatgaggatagtatccagttgactgcttcagcaggaagtcaagttaatagttattttgatgacaatgaccttggttttattaatgtcttgtatggaagatctgcaggcaagaccaatgttgctgtctctttctcatgtgaactttcaacttctgggtcaaggacacagtcaaggttttacagttcatctttatcagttacagtgattcctgatcttcccctggctttgggagtccccataacctggattcttcctccctattatacaatgacaagccctttgccttcatcatcagaatcccattctcagaatgatagtcggaatcgcagaggaaccattagctattctttattgagaagtttggagaaaaatgaagctctgcaaaaagatgctatattcattgatgcggatagaattaaaacaaccaaaagtaacaatcttgcttgcattcaagctaaagatcgtacaactggaagaacagagattgcttcttgtgtcaaggttgctgaggtgactcaaattagaatagccagtaaggaggttctgctcaatataattaaccttgccgttggtgcagaacttgatcttccaacaagcttttatgatgctctaggaaatcctttccatgaagcatacaatgcagtacctttttatgctgaaactaactaccctgatgttctctgcgtaaacaaaacagctgatggaaaaggcaatgtccatatcaaggcaattcagcatggtaaagctcttgtgcgtgtagcaattagtgaagatctgcaaaaatcagattatgtgctgattagagtgggtgcccatatatatcctcaaaatccagttcttcacataggaagtcctcttaacctaagcataaaaggtttgagtgatacaatttctggacagtggtttaccacaaatggaagtgtaatatcagttgatacattatctgggatggccaaagctattggggaaggttcagcacaagtatctttccattacggaagattgagactacaaacaacaattacagtgttgaaaggaaattatatttttgtgaatgctccaaaagagacgttaactaatgtcccgtacccttcaaaaggatacaacttctccgtgaaattcagtgaatcccttggtgcacctggagaaaagaagagaattttattcaattgtagagtagatccactatttgtggggtatgtgaagccatggctggatcaggactctggcaactcatattgcttatttttcccttactcaccagagcatttggtgcactcagtacctaagttagaaggcatgaggccagatgtatcactctccatttctgcttcccttgaacacgaacatgtttctggatctgcttcagcactttttattggaggattttctataatggagatgagcaagaattcgatgcagctgaatttgacgccaggctctaacaaaacttgcattactgtcttgggaaatactgatgttgaaattcactggcatcaccgagacttgattatgatcagtctcatccataaagaagattttggcattcgagggtttgcacggtatgaggtcaaattgcttaaagccaagagattcaaagatagaatcatcatcactctcccagctaatggccagagtgtggagatagacatcaaccatgaacccgaggaaacagcatcatccagcgtaaccataaataaggccttctgggcaagcatcctggggtatttgctgctgttgattttatcaattgctatcatcacacgtttcttggacagaccagagagatctcagcaaacaagttcttcagttactactactccaagcattgcagcgcccacaactcctgacagaagcaccccatcatctgttgtaaatgactcctctcctcgaacacctcaaccatttgtagactatgtaaggaaaacgatcgatgaaactccatattataagcgagaagggagaagaaggattaatccacagaacacgttttag

SEQ ID NO: 32038 - DNA, 2799 bp, Glycine max
  Peptide Sequence Number=SeqID_123723
atggtgaacatggccttgttactgagttttctggtgacggcgacggtactggcgtcgtcgtctcacgctgcttctagtggtcctcacattgccgacgttaacatactcttgccgccgaaaatgaccttccctgtcgattataggctccaaggaagtgacggttgcttccaatggtcatgggatcatcatgatattctgtctgttgagccagagtataattcaagcagcaagtgctcgactagtgcaaggataagatccattgccccttatagtggtcggaaggaaactgctgtttatgctgcggatttgcagactggaattgtgattcgctgcaaagtcttcattgacaacatatcaagaatacagatatttcataattctattaaacttgatttagaggggcttgccacactacgtgtccgtgcctttgacagtgaagaaaatgtattttcctcattagttggcttacagtttatgtggagccttatgcctgaagccaacggattaccttgtcaccttgttaatgttccgctaaaggattccccccttagtgattgtggaggactgtgtggtaacttagatatacaaataaaacttgaagacaatggtgtattttcagatctgtttgtagtaaagggaattgagattggtcatgagattgtgtcagtgcatctgctcgagccacagttaaagaatttggctgatgagattgttcttactgttgctgaagctatgtcacttgatcctccatcaccagtctttgtccttgttggtgcagtcattccctacacccttaaagtcatccggggaaatgttcctcaagtggtcaccttaccctcagcacatcaccaatggtctgtctcaaatgcttcggttgctcaggttgactcaaaaacagggctagcatatgcatggaacttgggaatggcagctgttattgttgaagatactaggattgctggccatgtacaagtgtcttcactaaatgtggtcctaccagcttctttatgtttgtatatatcacctttatctagttctggtgatccagtggaaggaatcaaatctattgctctaacgacccgttggtatgttgtatctggccatcagtatcttatccagataaaggtttttgcacatgatcatgatgcgcaagagatttatattacagagaatgacgatgttaaggtgtatgataatgattctggtcactggaaaacattttgggtttcaaatgatattgctgtaaaacatggctggcggaattctaaaatcttgaaggcttattcaccaggacttgaaaaattgacagcttctttgagctatcctggtggggctgatgacaaaaaggagattatcaaagctgtgcaagaagtcatggtttgtgatcgagtaaagtacaccttgggcaatgaaagtggaatcatcttactgccctggtctcctggtgtttatcaggaggtggagttaaaggctataggaggttgtgcaaaaacagtgagtgactacaaatggctatcttcggacttgtctactgtatctgtgtcagcttttggtgttgtccaggcaaaaaaacctggtaaagctactatcaaagtgttatctgtatatgattcactaaattatgatgagcccaaatctgttcctatgttatatgctgtggtatttgactgtaagaatgttgttttgtcaggagtagtaatgtggtatgtgttaagcttaagcatattggctggggatgtccttgttgaagtctccattccttcttctatggttatgcttcacaattttcccgtagaaactgttgttggatcgcatcttcaagctgccgtgacaatgaaagcagcaaatggtgcctttttctatagatgtgatgcctttaattctttgataaagtggaaagctggaagtgagtcttttgtaattgtcaatgcaactcaggagttgttatacttggaaacagtgccaaatactcaattccagtcatcagttgatggctctccttgttcgtggacatatgtatatgcttctaatcctggtcaagctgtgatccacgccatattttctaaagaagatcaccactacagtcttggtcctggtgtattaaaagcatcttcacgtattgtggcatatctaccccttattgtgcgtcaggcaggtgatggaaaccaatttggtggttactggcttgatttggttcaagccgaaagtaacaagcagtctcatagcttagaggagttatatcttgtacctggtacaagtttagacatagtacttgttggtggacctgaatggtgggacaatggtgttgatttcattgaaactgtagaagttttggatgaagggaatgctctggctgaagatggagttctagtgcatcggaaacttcttttcagacgtggaaatttggtcggggatgaccatcctctgccatcagtagctgaagtttggctgtcagtaacatgcaacattccttcttctattgtacttatagctgatgaaccagtgaatgaacgaagaattattaaagcagcagctcaagctgaacgtagttcaggtagacttcgtgatacccctgttattgtggcaaatgggcgctctattcgtgtatctgcagttggtatcagtgattcgggagaggcttatgcaaattcatcttctctcagtttgaggtgggaacttggcagttgcgagggactggcatattgggattatgcttttgatatagtgaagtctaacagttgggagagatttctggtcttgcaaaatgaatcaggattggtactgaaagattcttattaa

SEQ ID NO: 32039 - DNA, 498 bp, Glycine max
  Peptide Sequence Number=SeqID_123724
atggaagaaggatactctaccaacaaacaacccatgtttagaggtgtgaagtacgattactggaaggagcagaagatagctcattttaagtccattcacatcgacctatgggatgtgaacttaccggttgaagaacgaagaacgatgaagaatcttcacgaaattgctcacggaaacgtcttggcagcgagaaaagagggaggtggttgccggttacttccaccagaaggcaccgccttctgtcggaaccccatggaaggtccgagtgggcctgaatgttgtggaactttaccgattgtgcaacaatgcttcctttcgatttctggaatgttgcggaacttcacggattacctaacaatgggtgttaagtacctcgagggtacatcctttgtggtacaagtagagggtacatctcttgtggatcagttcaagtggacggattttacaaggttgaaaagaaatctcaaggaccgcaggtcgcttggggactcgatgtag

SEQ ID NO: 32040 - DNA, 264 bp, Glycine max
  Peptide Sequence Number=SeqID_123725
atggggattcaaatagcaaccagacccacttgggccttccaggatgttcctccagaaggcggttgcttctggaggaaccaacctagctcgcctgggcaagctggaaaatccaagccgaggcacttccgtaacgtttccatgggtgatttcgcaaagattttcaaccgttcttcgacgttcttcgttcgttcttcgtcgttcttcggtcttcaaccggtccaacgccttaaaaggaccgccttccaagtaaaaagaatcgcttga

SEQ ID NO: 32041 - DNA, 243 bp, Glycine max
  Peptide Sequence Number=SeqID_123726
atggctacctcacctaaagatactgcagctcctggctcaccctctgtaccatcatctccgcaccaggaacaaccagaattcaacatccaacccatacaaataattcctggtcaagcttctgtccctgagaaactagttcccagaagacaacagggagtgaagatttctgaaaaccctagccttgcaacaagtcctagggaagtagacccggagatggataagagatccgcatattgtgagtag

SEQ ID NO: 32042 - DNA, 321 bp, Glycine max
  Peptide Sequence Number=SeqID_123727
atggatgtcaaagcggatggtaactatggttatagggcaatagctgccttattgggtatgggtgaagaatcatggtcattggtgcgcaaccatttgcataaagaactgacaagttggtcggaagagtatattgacctgcttggtggcatagagagatttgaagaattaaagcgttccctacttgttgacggattatctatggtgcgttaccatggacaagtggataaatattacagacatgagatatgtcattgcttcatgatacaacatgatcgttgtttctctttcacgaccacaaagcatgacattttttcctcgtag

SEQ ID NO: 32043 - DNA, 858 bp, Glycine max
  Peptide Sequence Number=SeqID_123728
atgggatcaagtcaaaagccttcgtttaaaaagaggttctatcaagtcaaaatcaagagcttagaggtcactagtttacgagaggttgggcaattaatgggtcaacttcaacggcaagccttccgcaagcctatggacttccagctagtgctgactgtgaaagagtttgaagaaatccggggatgcccactgggaggaaggaagccatatcttttctctgggttctatccctccacgacagagttgccaggaaaggcaaaggccttggaaatcaaggcaaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagtggcgcaagaattgtttgttgtgcacttgctctctatgtgtggctggtttcacacctttttctccaagaaggtaggcccgtctatccgctacaaggtcaccgctcgtgcgtcgaaaaaggaaaggcgaattgggaccaactcttggctagcatggaggggcgtctgttaatttgttccctcgctagaaggaaggaagaatcaggattctatcttcatgcgaaggatgagtgccgtcagacgaaagcatcacgcctttcatcgcacggggtttcagtgaccccaatgcgagggtactctaaggagttcacaaggcatgtgatgtggtgtgaagaaaggatagagagcttaggggaagcagtaatgggagcatcggcggctatcataagtggctga

SEQ ID NO: 32044 - DNA, 168 bp, Glycine max
  Peptide Sequence Number=SeqID_123729
atggatcgaagttggatgaacgaaagtcgcatgagccctgcatataaggaagatgttgatgcaatcctccctaggaagggaccagtcactagagccatgagcaagaggctccaagaggattgggctagagctgctgaagaaggccctagggttctcatgaacctcagg

SEQ ID NO: 32045 - DNA, 600 bp, Glycine max
  Peptide Sequence Number=SeqID_123730
gaaagaacacgctttacgacgcctttacgaacccgtgctagagtaatgggtgaagtggaagaggtgcaagagcaagtgaaggctgacacggaggccttaaaagagcaaatggccacaatgatggaggccatgatgagcataaaggagataatggaggtcaatgcggttgcaatagccgctaccagcaccattgccgagtgcaaaaacaagcatgccttcccaccatatgacttgcctcccaactatacaccacccaatgtggcatacactcccagtgaggatgtcaataactccgctcccatactctttgaaagccgacaacctcaaactgatcatgcacatgtctctcaaaccatgggggagacacatgaaattccccaccacaatctagccgacttcgagccttgcctcggatatgccactgaagggcaagcagttggtgaggaaaggctaaaggtcgttgaagaaagtggaggttatgcctttgctaacctagaagagttgttcctggtacccaatgtcgtcacccctcccaagttcaaggtgtcggactttgacaagtacaaggagactacttgccccaagaaccgtctaaaagat

SEQ ID NO: 32046 - DNA, 276 bp, Glycine max
  Peptide Sequence Number=SeqID_123731
atggcaaaatacttggatgtattagaaataccaagaggtgcacatgtgcaatttttggtaccccaaaatgctttgagtatgcatgaatggccccgaggaagcttgcctcaaagaggtccaggaaggacaaggcggcagaaggaactagttccgccccggagtatgatagtcaccactttaggagcattgcggtgcaccagcagcgcttcgaagccatcaaggggtggtcgtttctccgggagcgacgcgtccagctcaggacgacgagtatactga

SEQ ID NO: 32047 - DNA, 266 bp, Glycine max
  Peptide Sequence Number=SeqID_123732
ggttaccttatggttaccgcacctttcatcgaccaggggcaaacaagcccgttgacacgaggaggctgacatcgtcttctgcaccttttgtcatccagggacggcaagtttttactctcgtcgtccggaaacattcaagtccaacgacgcgcgagattcttctctgctggctagggacgatcgagtgcaatggcgaagggaagtgtcgcggttctgctggcagggatattgactggccggatgacgttccgctcgaaggaaattag

SEQ ID NO: 32048 - DNA, 711 bp, Glycine max
  Peptide Sequence Number=SeqID_123733
atggttcaactgatttctgataccatctattgtttgcagggatcgcacccacaagacacccagtggacccggaaaagtccaacagggccctggggtttccagctctggttacgggcctctatcagtcctatagggtgcccgtaccccccccggcaaggttatgtcatcatagggatcgcgcctgcaagacacccagtggacccgaagaagtccaacagggtcttggagttgtcaagctctaattacggcaagggcatcaggccccctactgatcgagctttcatcaagaagtgctgcgtccccaggcaggcgcagggcgaaacaccacagcagcattgggatggtcggcagcgggaaacagacgcaccgccatcacctctagagttcacctctgggctcatccacaaaaaggtggacccttgggtactagtacctatcacctttagaggactatatgtcctcgccatcagaggactgcacatcctcgcctatagagggctgcatgccctcgcctttagagggctacgcatcctcattttcattcctgggccaccccctgatattggagggcgaccaactgtgcgagcacatctagagagggagcctatcatgcatctactttgcataccggggcaagatttcacccgtgccgctcaaaagatgagtgcgatcatgcgcaccaacatgaccactctacatggatatggatga

SEQ ID NO: 32049 - DNA, 744 bp, Glycine max
  Peptide Sequence Number=SeqID_123734
atgagggcgtgcaaccctctgatggcgaagacgtgtagtcctatgaaggggaggtcgttaagccctctaaaggcgagtatgtgtagtcctctgaaggtgagggcctatagccctacgaaggcgagggcttgtagccctctgaaggggaggacgtgtagtcctctaaaggtgaggacgtgtatccctctgaaggcgaggacgtgtagtcctctgaaagtgagggcgtgtagtcctctgaaggggaggacgtgtagccctctgaaggcgaggacgtgtagccctctgatggcgaggacgtgtagtcctctgaaggtgaggacgtgcagtcctttcaaggcgaggacatgtagtcctatgaaggcgaggacgtctagacctctaaaggcgagggcaggcaaccctatgaaggctagggcatgtagtcctctgaagatgtggatttgcagtcctctaaaggggaggaccgacagtcctctaaaggcgagcaggtgtagccctatgaaggtgaggacgtgtagccctctgaagggcaggctgtgtagccctctgaaggcgagtatgtgtagtcctctgaaggtcagggcatgtagccctacgaatgcgagggcttgtagccctctgaaggggaggacgtgtagtcctctaaaggtgaggacgcgtatccctctaaaggcgagcacgtgtagccctctgatggcgaggacgtgtagtcctctgaaggcttgggcgtgtagccctcataag

SEQ ID NO: 32050 - DNA, 162 bp, Glycine max
  Peptide Sequence Number=SeqID_123735
atgacgactctttgcaaatccagaagaaaggaaatccgaacatttccagaaggattacctaaagtgcaagtcttgagattccttaccatgcaaaccataagcccaaatgagaagtttgtttttcatgggaaatggagtgaaagctccagtggaaacagttga

SEQ ID NO: 32051 - DNA, 711 bp, Glycine max
  Peptide Sequence Number=SeqID_123736
atggcgcaccatggcctcgttctccggcgcaccgcaaatgtataccgactatctgacgattgccggcaacgttggctgaagtttgccatgaccggcggaggccggtcagactgcatcatcacgcccgcgcagggttggtgtgcggttgtggctggcccggcacctcaacgcctggccagcccactgttcgcctccgttgccggattagctcacgcgcgccgctgccgggctgttcagcgcggccagcagcgttgccgagtccgccactgcgccaaaaataccgccctgcatatgaatcatgctgagcgccgcctcatgatgcttcaactccgtcgccgcgcagcagtcgctcagcaccagacattcaaagccgcgatcgttggcttcgcgcagtgtggtatgcacgcaaacgtcggtgagcccttgccgggtttatcaataatcacttcatccggtagcgggcgtagctcgggaatgatttcccagcctggctcaccgcgcaccagaatgcgaccacagggccctggtgcaccaattccgcctgcatccgccgcgatcgccagcgcttgttggccggcagatcgctcaggtccggacgatggccttcacggtgtcaacataaccgcccttaccgcagaagtcggtttgcatatcaatcaccagcagcgcggtattttgcaccgtgcagttgccgtcaacggccacggatag

SEQ ID NO: 32052 - DNA, 369 bp, Glycine max
  Peptide Sequence Number=SeqID_123737
atgccaatcgccccctgtagatgtatcggttgggatcgcacccacaaagacacccagtggactcggagaagtccaacagggccttggggtttccagctttggttacgggcctctgtcagccctatagggtgcccgttcccccagcgaggtcatgccatcgtgacatatgaatggcacccacaaagacacccagtggacccgaagaagtccaacagggccctggggtttccagctctggttacgggcctctatagtcctacagggtgcctgttccccttggcaaggtcacgtcatcatagggatcgcgcctgcaagacacctagtggacccgaagaagtccaacagggtcttggagttgtcaagctctaa

SEQ ID NO: 32053 - DNA, 696 bp, Glycine max
  Peptide Sequence Number=SeqID_123738
atggcttctaggaaaagaaagacaccctctacacctacccaagtcaaatttgatagatccagattcacttcccaagaggcttgggaaagatacacagatgttattgtgcctaggaagcttttgcctgagaggaacgtggatgaggaattgactgatttcattgacgacaacatcgatgttgccattgtgaaagagttctatgccaacctctatgaccccgaggaaaaatcacctaagcaggtgagggtgagaggtcagtttattaagtttgataaggacactcttaacactttcttgaagacctttgttattatggaagagggggaatcactctgtgcttattctagatttgcactcctgaggcctgatcctcaggagttagctgccaagctctgtatcccagggaggggattcgagcttaatgttgatgggcagcctttgaagattctaaggaagaacatgacctcgctcgctcagacatggagcgttctttctttttctaacctcattcctaccttccacacatctgatgtgactttggatagagccaaattgatttacggcatcattatgaagatggatatgaacctggggtacctcatctcccatcagatctccctcatagcacaacatgacacatccaaacttggattccctcccttgatcacagctttatgtaaggccgggggagtttag

SEQ ID NO: 32054 - DNA, 198 bp, Glycine max
  Peptide Sequence Number=SeqID_123739
atgacattaggtgctgaattcaatgtggaaagcttaacatgtagagattggaacacatcatcgaaagtatcccaaaaggaatgtgttcggttctgtgcaagaaagaaaaggactacctatataagcatgaagtttagccgcttcaagaagctgggacttggctttgatatgcttatgaaggatagggacacaggctag

SEQ ID NO: 32055 - DNA, 243 bp, Glycine max
  Peptide Sequence Number=SeqID_123740
atgtttcagttgtatgtagcttgtgtcttcttcacagatagggcatgcacgatgacccttaacactgtaaccactcaaattcccatatgttggaaagtcattaatgtggctagtccaagtgatgcaatcctccctaggaagggaccagtcactagagccatgagcaagaggctccaagaggattgggctagagctgttgaagaaggccctagggttctcatgaacctcagggtagatttctga

SEQ ID NO: 32056 - DNA, 303 bp, Glycine max
  Peptide Sequence Number=SeqID_123741
atgaccgatcgatgtttaaaaaagatgaatcaccggatgacgccgatcagacatttaataatgcttaactttgcggcattcagagcagattgtactgagagtgcaccattgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaaatattattcaggcgattga

SEQ ID NO: 32057 - DNA, 513 bp, Glycine max
  Peptide Sequence Number=SeqID_123742
atggcttctccacctgcctcccctcctcctcctcctccttctcctcttgctgctcctaccgacgcatcagcttccccgtctatcgtgaagcagacacgcaaagcctcatgcctacgatcgttgtctactagaccacctggtgctgagagaccagtggtgcatgttgatcctgctaccggcaaggccgacggtccccacaggaagaaattaagaacatatttggggattgtggcgcgtgataaggtggacgtcacctacgatcactggaaggaggtccctactgctcagaaggacttgatttgggaggatattcaggcggaatttgaaatcccagaggcttctgacaccgatcaggatggtgtggaggacactgtctgtgagaaatacgtcatcagcaaggaaaaattggcccagttttgccagactcacagagacccttcttgggagaagctcctggctgagaagacgaagaagaagctggaggaagttgcacagtcaggaagcgttgatggc

SEQ ID NO: 32058 - DNA, 732 bp, Glycine max
  Peptide Sequence Number=SeqID_123743
atgctaaacttcgtcgctcgaacgacttatgacaacgacacctttatgacagcactggacgccgcacagcccaacaaattgcatcagcgtgtcaatctgggaacacgcctcgtttttctcatcgccggtttaagcatgtctgcgtgggcgccgctggtgccgtttgccagccagcgtctccagctgacgggcgcgtcgctgggcggcctgctgctgtgtctcggcattggttcactggcggcaatgccggtgaccggtgcgctggtggcacgctttggctgccgtcgcgtgatgctgtgctccacgctggtggtgctggcagtactgccgctgctggcaacgctggatgtgatgtggttgatggccgccacgctgatggtgttcggtgccgggctcggcatgctggatgtggccatgaatgtgcaggcggttgaggttgagaaagcggcggccaagccgatgatgtccggtttccacggtttcttcagccttggcggtattctcggcgccggcgcggtcagcctgttacttggtgcggcgcctgcatcagcccgatcaaccctggctggtgatcccgcgcggctgggtcgccttcctcggttgcctgtgctttattctgttccttgcggaaggcgcggtactcgactggagcgccctgctgctgctgcaaagtccgggcatgagcgtggcgcacgccggtcctgggttacgccatcttctccatcgccatga

SEQ ID NO: 32059 - DNA, 945 bp, Glycine max
  Peptide Sequence Number=SeqID_123744
atggcagcgctggctgagcttttccgcctttacgctggcgggcgtggcgctggagggcagcctgccgcctgccaccacatccccgcagcaggcggcaaaggccagacgctggcgcaacgcgccaccatcggcaccaaagtgccagttttcattgccgtagctgcggaaccagttgccgctgtcatcgcgccactcataggcaaaacgcaccgccagcttatcgtggtgccacgcccacaactctttaatcaaccgataatccagctcgcgggcccatttgcgctgcagaaatgtcacgacgtccgcgcggccgttaacgaattcgctgcgattgcgccagcggacaatcctgtctacccccgaaaacaggaattttttcttatgctcgcacccctgctgtttgatgccagcgccagcgcacgtgaccgcatcctgctcagcgcgcaacagctgttttatgcgcaaggcatccgtgctaccggcatcgataaagtgattgccgcggctggcgtaaccaaagtgaccttctaccgccacttcccggccaaaaatgacttaattctggcgtttctgcagcagcgtcatcagcgctggatgagcggctttcgcagcgcgctggcgcagcagcctgccatcaacgtggcgctgccggctgcgttactgagctggtttcaggaggaggatttccgcggctgtgcgtttattaatagcgcggcagaactggctgataccctgccggaagcgagcgcactgattcgccagcacaagcgtgagatggcggccgccattgccgaaagactcagcacagcgcagcaggataaaaccgggcagatcgtgttgctggtagatggcgcaatcgtgcaggttcagatgggggaagcggcgcagcaggtgacggcaacgctgcaggcggcgctgaacgcgctgctggagagcagagcgtga

SEQ ID NO: 32060 - DNA, 1827 bp, Glycine max
  Peptide Sequence Number=SeqID_123745
tggcagaactggctcaatggtcagaaaggcggcgcgccatggttctcatggatcgcgctcaacggcgtgacggtaaccggcgacagcaccaaagcgcgccagcgcagctatatgcgccaggcgacaggcgtggatgaacaaatcgcaacggtgctgcatacgctgcagcagaatgatgcgctgaagaataccgtggtggtgatcacggcgcagcgcgccattaccttcgacaacagcgataatccgggcaaccgcgcgacgctgcaggtgccgctggtggtgcactggccgaataccccggcgcagagcatcgatcgcctgaccgatcagcaggatgtgatgaccacgctgatgcagcgcctgctgcacgtgcgcaccaatccggttaactattcacagggtgaagatctgtttgccgcgcagcgcagccataactgggtcgccagcagtgaagatggcaaactggtggtgactacgccaacggtgacgctggtgctcagcaacaacggtaactacagcgcgtacgatgcccagggcaaagagctgaaagatcataaacctcagctggcgctactgttgcagttaagctgccggcatattgcaatcgccaacggaaccagtagtataaccctccacgttcggcacgtagcgcagcctggtagcgcactgtcatggggtgtcaggggtcggagcgctcagaagcgttgccaggtccagtatttgcatccagttgtcctgggaaaatctttgctaacgtgcacatggggccgcaaccacagacgtaacggatggcagaggtttaagatgacggcaccattgaccgcgccagacgcggcttcaattcgtcacccactgcgactggccctgaccgttattgttcagggatcgtgcaaaatcctgcagcataaaatctcgcatcatacttcattcatgctgcgaatcaggatgcggaagaactcctgcactcaggcatcagcaaagtggagctggcgtatgatattggcagcgatgatttcttccgcctggcgagccactgatgaagagcttcgctatcccgccaaatcgctaacccgcagcagccttttcggcttgctctgcccgcggctgactgccgaaacgcccctgccgctgcccgcttgtggtttcatcaccgccgctggccacaccgctgaatcgctgtcgctggcgtggtgccgctttgatcggcaacagtggcacgccgctttacctgcgcagtggcaattgccgctgccgtccgcgctacagcaggcagccagcaaacgcaaaattgaatatctcgccagccgctggctggtgcggcaacagctggcgcagctgggaatcactgattttgtgctgcacaacgcgccggatcgctcaccgtgctggccggcaggcatccgtgcttcactgtcgcacagccatgactgcgtggtgatggccgcgacgcgcgaggcattgtatgtgggcattgatgttgagcaggtgatggcagaggaaaccgcgcaggacacggcggaactgctgatgaacgcgcaggagcgcgcgctgcttgagggccagccgctgccctttgcgcaggcggcaacgctgctgttttcgctgaaagagagtctttataaggcgctatggccgcggctgcatcagcccatggcgtttcatcaggctgtgctgatcgatatcgacctgccgcagcagcgcgcgcggttgcagctgtgtcaggatttcagcgcggaatttacccgcagcaccgtgctggacgcacgcttctggctgcagccgacgcgcgtggtcacactgctcactcacccggcctgcacgcaataa

SEQ ID NO: 32061 - DNA, 804 bp, Glycine max
  Peptide Sequence Number=SeqID_123746
atgacaataactcctcaacaattgatcgcgttgctaccgctgttaatcgtcggattgacggtggtggttgtgatgctgtccattgcgtggcgacgcaaccactttgttaatgccacgctgacggtcatcggtcttaacctcgcgctgctgtcgctgtggtttgtgggccacgtgggcgccatggatgtcacgccgctgctgcgcgtggatggctattcgatgttctataccgcgctggtgatgctggcgagtctggcaacctgcacctttgcttatccgtggctggccggtttcccggacaacaaagatgagttctatctgctggtgctgatcgcggcgctgggcgggatcgtgctggccagcgccaaccatctggcggcgctgttcatcggtatcgaactgctgtcgctgccgctgtttggtctcatcggctacgccttccgtcagaagcgctcgctggaagcggcgctgaagtacatgattctgtcggctgcggcctcctcgttcctgatcttcggtattgcgctggtctacgccgattccggcagcctgagctttgtgcagctcggcaagagcctgaatgacagcatgattcagcagccgctgctgctggtcgggctgggcatgatgatcatcggtcttggctttaagctgtcgctggtgccgttccatctgtggacgccagacgtttatcagggcgcgccggctccggtctcgaccttcctcgccaccgccagcaaaatcgctatctttgcggtcatcatgcgtctgttcatgtacgcaccggtaaccgacagtgaagcg

SEQ ID NO: 32062 - DNA, 1182 bp, Glycine max
  Peptide Sequence Number=SeqID_123747
atgctctcaacgggcgatgaagtgttacatgggcagattgtcgataccaacgccgcgtggctggccgatgtgctgtttcagcacggcctgccgatgaccagtcgcagtacggtcggcgatgcgatgagctcgctggttgaagcgctacagagccgcagtcagattgccgatgtgctgatcgtgaacggcggtctcgggccgaccagcgacgatctcagcgcgcaggcagcggccaccgccagcggcagcgaactggtgctgcagcaggcgtggctggagaagatggaagcctggtttgccagccgcgggcggctcatggcacccagtaatcgcaagcaggcggagattccggccaatgccgagttgatcgataacccggtcggcaccgcctgtgggtttgccctgcagcttaatcgctgctggatattctttacccccggcgtgccgtcagaattcaaagtgatggttgagcagcagattattccgcgtcttaaggcgcgttttacgttgccagaacccccactgtgcctgcgtctgaccacctttggtcgcggcgagagcgatatcgccgcggagcttgaaccgctgccgctgccggaaggtgtcgtgatgggctaccgttcgtcgatgcccatcattgagatcaaactgaccggcccggccagccagcgcgtggcgatggagcaggtgtggcagcaggttaagttactgctggccgagtgcaccatttttgaaggctttgaaggattgccggccgtgctggcgcgggaactgcacgatcgcggcttccgccttgctctgagcgaacaatacacggccgggttgctgcactggcagctggccgccgcacaggtgccgcttagcgccgctgagctgctgccggctcgtgaggagtcgctggaagcgcaggttactcgcacgcgtcagttggccgctcagcagggcacagtgctggccttgtcggttggcgatctgcaggaaggggaagtgtcgattgcgctgcacaccccggaagccagctggggccagcgggtgaaatttacacacgggcggcacaatctggaaacccggcagaaagtggtagcgatgatggcgatgaatatgctgcgccgctggctgcacggcagtgaagtcagtaccggtcacggctggattgatgttctggagacggtgaagagctaa

SEQ ID NO: 32063 - DNA, 1900 bp, Glycine max
  Peptide Sequence Number=SeqID_123748
atgaaccaaagtctgctcgttacgaaacgcgatggccgccaggagcgcatcgacctcgataagattcaccgggtgctggactgggcagctgaagggctgaacaatgtctccgtctcgcaggttgagttgcgttcgcacatccagttttacgatggcatcaaaacctcggacattcacgagaccatcatcaaagcggctgccgatttgatctcccgtgacgcgcctgattaccagtacctggctgcgcgtctggcgatcttccacctgcgtaaaaaagcgtacggtcagtttgagccaccgaagctgtacgaccaggtagtaaaaatggtcgagatgggtaaatacgatcgccatctgctggaagactacagcaccgaagagttcgagcagatggacggcttcatcgaccactggcgcgacatgaacttctcctacgcggcggtgaagcagctggaaggcaaatatctggtgcagaaccgcgtcagcggtgaaatctacgagagcgcccagttcctgtatattctggtcgccgcctgcctgttctccggctatccgcgcgatacgcgtatggattacatcaagcgtttctacgatgcgatctccacgttcaagatctcgctgcctacgcctatcatgtccggcgtgcgcaccccgacccgtcagttcagctcctgcgtactgatcgagtgcggcgacagcctggattccatcaacgccacctccagcgctattgtgaaatatgtgtcacagcgtgccggcatcggcatcaacgcgggccgcattcgtgcgctcggcagcccgatccgcggcggtgaagcgttccacaccggctgtatcccgttctataagcacttccagacggcggtgaaatcctgctcgcagggcggcgtgcgcggcggtgcggcaacgctgttctacccgatgtggcatctggaagtggaaagcctgctggtgttgaaaaacaaccgcggcgtcgaaggcaaccgcgtgcgtcacatggattacggcgtgcagatcaacaagctgatgtacactcgcctgctgaaaggcgaagacatcaccctgttcagcccgtccgacgtgccaggcctgtatgacgcgttcttcgccgatcaggatgagtttgagcgtctgtataccaaatatgagaaggacgacagcatccgcaagcagcgcgtgaaagccgtcgacctgttctcgctgatgatgcaggaacgtgcctcaaccggccgtatctacgtgcagaacgttgaccactgcaacacccacagcccgttcgatccggccattgcgccagtgcgtcagtctaacctgtgcctggagattgcgctgccgaccaaaccgctggaagacgtcaacgacgaaagcggcgagatcgcgctgtgcaccctgtccgcctttaacctcggcgcgattgaaagcctggacgatctggaagagctggcgacgctggcagtacgcgcgctggatgccctgctcgattaccaggattacccgattccggcggcgaaacgcggtgcaatgggccgccgtaccctgggtattggcgtgatcaactacgcctattacctggcgaaacacggtgtgcgctactctgacggcagcgccaacaacctgacgcacaaaacctttgaagccattcagtactggctgctgaaagcctccaacgaactggcgaaagagcaaggtgcctgcccgtggtttaaagagaccacttattcgcagggcattctgccgatcgatacctataaaaaggatctcgacagcgtatgtaatgagccgctgcaccttgactgggaagcgctgcgtgagtcgattaaaacccacggcctgcgcaactccacgctgtctgcactgatgccgtctgagacctcttcgcagatttcgaacgccaccaacg

SEQ ID NO: 32064 - DNA, 1798 bp, Glycine max
  Peptide Sequence Number=SeqID_123749
atgtactggattaccaacagcagccagccaggcatcggcaacttctacatggtggtgccggtttacgtcgccaacaaactgcaggcgctgctcggcgtggaacagaacattcgcctggatgaatttattcagcccggcgggctgccgctggtggccaccatcaccgatgaaaactatcgtccgctgatcagctcacgacgcggcggacccggttattcgctggacgatctgccggataacagcacctggtttggttatcttgacggctatcgtcagctggtgctgaaaaagccgctgccgccgtccagcctcaatgtggtgtggtcgctgtcgaccgatgtgctgatggatcagctcaagctgatgctgatcaacgcgctgctgctcaatattctcagcgcgctgattctgtttaccctggcatgggtgttcgaacgccgcatgttcctgccggcggaagacaacgcccaccggctggaggagcacgagcagttcaaccgcaagattgtcgcgtcagcgccggtcggcatctgtattttgcgtaccagcgatggcaccaacatcctcagtaatgaactggcgcataactatctgacgctgctgacgcaggaagatcgcctgcggctgaacgaaatcatcggcggccagcaggttaattttgtcgatatgctgaccggcagtaacacgaacctgcaaatcagctttgtgcattcgcgctaccgcaacgagaacgtggcgatttgcgtgctggtcgacgtctcggcgcgcgtgcgcatggagcagtcgctgcaggagatggcccacgccgccgagcaggccagccagtccaagtcgatgtttcttgctaccgtcagtcacgaactgcgtacgccgctgtacggcattatcggtaacctcgatctgctgcagaccaaatcgctgccgaaaggcgtggattcgctggtcacggcgatgaacaactcatccagcctgttgctgaaaatcatcagcgatattctcgacttctcgaagatcgagtccgagcagctgaagattgagccgcgtcccttctcgccgcgtgaggtggtcaaccatattgccagcaactatctgtcgctggtggtgcgcaagcgcctgacgctgtatgtgtttatcgagaacgatgtgccgctggcgctggatggcgatccgctgcgcctgcagcaggtgatctccaacctcttgaacaacgccatcaaattcacccacaccggctgcattatcctgcacgcctatgtcaaagaggggtatctggcgtttcgcgtgcgcgacaccggcgtgggaatcccggcaaaagagatcacgcgcctgttcgacccgttcttccaggtcggctccggcgtgcagcgtaatttccagggcaccgggctgggactggcgatctgtgaaaagctcatcaacatgatggatggcgacatcgaagtcgactctgaaccgggcatgggcagccagttcgtggtgcgtattccgatctacgccggacagcaacccgcgccgccgctgctggatggtctgcaggaaaaagccatctggctcgacctgcgcaacgactatctggcggccttcctgctgcgtctgctccagcagcagggcatccaggttgcgcactatcaggggcgggctggggcggacgatgtgatgatctgcgatcaccacgacgcgccagcgcagacggtacgcgcgcgcatccgaaacgacgccgggacagtgggtgcacagcagcgcgacgctgcacgatctgccgctgctgctgggccggatttatcgcatgccatcgaca

SEQ ID NO: 32065 - DNA, 1254 bp, Glycine max
  Peptide Sequence Number=SeqID_123750
atggtgacgcagctggtgcagctcagccagcgcgatgacgacgagagcgtgctggatctgctggatgagagtcagggtctggcgcggctggtggacgatatcgtcctgctcaaccggctggaagcccacgactggtcgccggatgcgggcgtgtttaacctgcaggatctgctggatgagattgcgctggagagcctgccgctactgcggcgcaaagggctgacgctggtggtcaacaatcagctggccaacgacgagatgcgctttggcgatcgtcgcgcgctgcgtaaagtcctgaccacgctgatgcactacgcgctcaccaccacgcagtggggcaagatttccctcgatatcaaagccagcgacagcaaagctaacagcgtgctgttccagctggtggataccggctcaggcctgaccggcgacgagctggccaacgtcgatttcccttacctcggcgaaaccacgcaggatcgttacggtcaggcgtccggcatggcgtttttcctgtgtaagcagctgtgcaaacagatgggcggccagctggagattatcgccaaaccggatatcggcacgcgctacaacattcagctgccgctggcgctggagcagcagagcgagcaggaagagaaactgctggaaggcgtgacggcgctggtggatatcgcggtcgaagacgtacacaaaattgtctgccgccacctcgagaactggggggcaaattgcctgacctcggacgaacgcctgtccggacaggagcgtgatgtgctggtgacggacgacccggcacgccttcacggctgggcgctgttgctggcgggtgacgaaatggggcatcacgccctcaacgaccagcaattccgggtcaatttcaatctcagcaatgcgctgcttgatgcgctgctggccctgattgagaagcaactggctcacgattcgatagaggagagcgacgacgatgaggctgccacgccgctgctgagcggcggctatttccagctgtttacggagacagtaccgccagatgtgaagagactgtatactgagtcggcggagaaggactatccctcgcttgctcagacagcgcatcgcctgaaaggcgtgtttgccatgctcaatttactgccgggtaaacagctttgtgaagagttagaacagcacattaaactgtgcgacgatttaaccattaaaaataccaccagtgaaattgacgcgtacgtcaaccaactgctgcagcaaggtaaccaataa

SEQ ID NO: 32066 - DNA, 494 bp, Glycine max
  Peptide Sequence Number=SeqID_123751
gtcgactctagaggatccccggttatccacagaatcaggggataacgcaggaaagaacatgactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttgcagattacgcgcagaaaaaaggatctcaagaagatcctttgatcttttctacggggtctgacgctcagtggaacgaaaactcac

SEQ ID NO: 32067 - DNA, 386 bp, Glycine max
  Peptide Sequence Number=SeqID_123752
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatcccctgataagcagaggccaatgtggtcatctgcaccctttccggagatgtcaacgtctcccgtcgggaaacctgtcgtgccagctgcattaatgaatcggccaacgcgcggggagaggcggtttgcgtattgggcgctcttccgcttcctcgctcactga

SEQ ID NO: 32068 - DNA, 303 bp, Glycine max
  Peptide Sequence Number=SeqID_123753
atgggtgaagtagaagaggtgcaagagcaaacgaaggccgacacggaggccttgaaagagaaaatggccacaatgatggaggccatgatgagcataaaggagataatggaggtcagtgcggcttaccgaacctgtgctagagctagagtaatgggtgaagtagaggaggtgcaagagcagatgaaggccgacatggaggccatgaaggagaaaatggccacaatggtggaggccatgatgagcatgaagaagataatggaagccaatacggttgcagttgctgctactagcgcagttgctaag

SEQ ID NO: 32069 - DNA, 531 bp, Glycine max
  Peptide Sequence Number=SeqID_123754
atgagtcatcattcatatagtgttaatggcgagggtactagtcataaggacactctatctagaatcttacatgagttgagttccctcaagttatggaaagaaaaactagaaagaaaagaaaaaggaaaagagaggaaagaccaagctcaaggcatcttaggggtgacaccttctaagcccaaagatgataaggggaagacaatagaaaggcaaccccttaaggctagtatgcaagagaagactagatttataaagtgctccaaatgtcttggaagaggacacattacttctcaatgccccaccaagaaaaccatgattatgaggggacaagacatttatagtagccaagatgaggctactacttctccttcctctagtgaaagtgaagaagcaaaaggggaaaaacctagtgaagagatctacccacaagaagaaggacaacctttaatggttaaggaggagtgtaaggaggcaagtgtctcctccaagaggttagctaaaaaggaaagacattttggtgggatcctctag

SEQ ID NO: 32070 - DNA, 228 bp, Glycine max
  Peptide Sequence Number=SeqID_123755
atagcttaccccgctttcacgggaagggtcgcttcgctcggggagtggaggggaaggagaggacaggggatgcggaagcaaattaccccgatcaaggaagcgaaaacaagaactcttaatcagaaccagcgttttctgctttctttcaaaggggtagtgaaaaaggcgaaggatgaggcctcacgttcagacactgcctttggttcattaccgttgagaaggcagtag

SEQ ID NO: 32071 - DNA, 540 bp, Glycine max
  Peptide Sequence Number=SeqID_123756
atggcgcctaccaggcaccctttggatccagataagtccaacagggccctgggatttcccgcactgatcacaggactctgccaatcgttcggagtccccgtggcacctaccaaggtgattcagccgcccatcacccgggcttttattgagaagtactgcacccagagacaggctcaggggaatgctccaccggccgcgggcgcgccaccaccacctcatcaggctggcccggctgggtcatttgacatggagcagtatttacggcatttggttcgccagcaggcagccaaccatcgggcacatgtgcagacccatgattgtctataccagatgagcctcagcatgcagagccagggcttcgcttctttttcatgccctactccagaccagttcagggcagaggtcgcatggcccggggattggcccgaggcccaagcaggagaggcgcccccggaagttcccggggatggagaggaggcccacgaggacgaggagatggccgatttgcttaacttcttgggagggagtggagctacatga

SEQ ID NO: 32072 - DNA, 735 bp, Glycine max
  Peptide Sequence Number=SeqID_123757
atgtgggatgctaccttgtttggcctatttaatgaaaaatttcccttgtacataaagcatgaagatctgtctgaaattgcacatggtggtcaatgtctcagcatatctgttatacagttgtggattctgcatatgactgagacaagtatgcgagctgggaatatcgatgtgtatggattcctcgagccacagtctatccagagatctggccaatcacaatttgaatcagaaaattacattaagaactggatgcaaaattcaaaacgagatgtgtacctaggagcctacttgaatggtataataacatatattggtctcccactgcagtgcacattggcaaatggtcgtcatttgcctaaggaaaatgttgtcatttggttttgttcgttgcataataagccagacaactacctcaaaggcataattaataggtcagtgttgttttttaatatatttgcattagcattagtcagtgctttgaaaggacttgacgatactcaacaaagtaaatccaagactcctgctaggtggattgttgttaaatgtaatagacaaaaaggaagcactgagtgtgggtattacgtcatgcattggatgtcaactataatcttaggaaatttccagaataattgggaaatgtatttcactgatcctagaccactggaaccagaaagattgaaggcacttcgcaaccagtgggcaaagtactatttgaaagtgaaaaatgaaacttag

SEQ ID NO: 32073 - DNA, 357 bp, Glycine max
  Peptide Sequence Number=SeqID_123758
atgccttatgtggaagccgcagaagaatcgttagaaaccgctttccagtcttttgaggtgggtctaagaggccccccgagtctatgttgggaacccgccgacgcaagggaaaaggaaaagtgtggaggaacagatggcgaagcaccccaactgcttcgaataaagatattccagcaaaggggcccccggaaaaatggaggagtagaaaggaggtgtctagaggaagctaagcgaattccttcggataattcagcagagcgaattcgggaaggttatcgaacagtcaacaaaaccccggctcagaggtctcgctgttggagacaagaaatgagcttcgagcctcgctctgccatatag

SEQ ID NO: 32074 - DNA, 129 bp, Glycine max
  Peptide Sequence Number=SeqID_123759
atgtcggctgaaaaatataagtctcggctttacaacgaccgatgccgggaaatgttcgatcggcgtcacccagtgattgcttcttttttagacctcgatcggctaatgtttttcttgccgagtaaatga

SEQ ID NO: 32075 - DNA, 273 bp, Glycine max
  Peptide Sequence Number=SeqID_123760
atgggtgaagtagaggaggtgcaaatgaaggccgagatggaggccatgaaagagcaaatggccacaatgatggaggccatgatgagcatgaagaagataatggaagccaatgcggttgcaattgccgctaccatcgttgttgctaaggcaaagatttgggaagtacgggcggcccctgttatgcgcaaattcaaaacaagcatgccttcccaccatatggcttgccccccaactatacaccacccaatatggcatacaatggggatcctctag

SEQ ID NO: 32076 - DNA, 228 bp, Glycine max
  Peptide Sequence Number=SeqID_123761
aggtatcattccttcgaaaaacatattgcggcagtagggactaccaacaacaatatgttatcaaagagaaaaactctagatgagggttcactgttatcaagcaagtcggagacccagcatgaccacagattcacttccactccttatgatcccatggactcgggtataaggccccttttcaactcaccgtgtgtgcaaaaaggtattggtgttgtgtgcatcaaatga

SEQ ID NO: 32077 - DNA, 297 bp, Glycine max
  Peptide Sequence Number=SeqID_123762
atggggttgaatcaatttagatttttcaacatggttcatgacatcttggtcaaggtgaaactggaagtaacaaggacatcaacagtcctaaatgtgtttggcacttggttcaaccccataacccagggaaaggcaattttgatcgccaatacttcaacaacatttcatagggatgaaagactcaggaatacgcatactatgcatgaagaatgtaattatcaaatcgagaaatgggtttatgatcccaacatggttggctcatggtgcctaacacatgcaactaagaatgtagtgtga

SEQ ID NO: 32078 - DNA, 888 bp, Glycine max
  Peptide Sequence Number=SeqID_123763
gaaggaaaggagggagttctcttctcatgtggggactaccctaatgttccgttgatagggacgaggggttgtattaactataatcccgcacttgccataagacagctagggtaccccatgaggggagcgccaatggaagagaacctctcgcctttccttgtgagagatttcggcgcgcaaagtctcgaggttgtacaaagagtccacaaggcgtggagaagtccgttgaggaaagataaagaacttaggggcatccgtaatggcgtcatcggtggttctcatgaatggctaagagctcatacgcgagggttagattggctctccaagttgaaatttatcgatgagaagaacttcgaagctccaaaggaagatgaagaagtccaagctctaaaattagagctagggaaggcaagactcgccaaagaaaaattcaagacagccgcaacaaacatccggaaagagtgcaccgagttacgagaggaaaatgcggccactgcaagagcccttgaacaagaaaccaaaagggcccgcaaggaggaacatggccaagataaattacgggagctttgtggggcagcaacaatgagctcaagctccggagagaggaaagggacaagtcacgggagtttggctcaacacttggaagccacggagcaaagcatgctagctatcatagggcaatacaaggaagagttaaaccagtcgttgacccatgaacaaaagctagtagaggacttcgcacaagcgtacgccgagaatgaagcaagagggagggtgattgatgcattgcatcaagaagcgaccatgtggatggataggttcgccttgaccttgaatggaagtcaagacctcccgcaactattagccaaagcaaaggccatcgctgaa

SEQ ID NO: 32079 - DNA, 447 bp, Glycine max
  Peptide Sequence Number=SeqID_123764
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcagggatcctctag

SEQ ID NO: 32080 - DNA, 489 bp, Glycine max
  Peptide Sequence Number=SeqID_123765
atggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacaatctagctgacttcgagccttggctcggatatgccactgaagggcaagcagttggtggtataccctttgaaaacactttggagggccctcagttttgcccacaaccacaaccattgcattttgcggtgggaagagcccctcctgctacggccgaacaagaaagggtgaagttctcgagtgctttgctaaatccctatgaaagttgttctgaagtatgccgatcaaacatggtgccattccctgggtacagggttgaaccaagctcatggacttttcgacaagtacaagggtacttgtcatcaagtaccaagtctgaaatatggaagtaa

SEQ ID NO: 32081 - DNA, 429 bp, Glycine max
  Peptide Sequence Number=SeqID_123766
atggaagtaggcaaagatccacaagggatgtaccctcttctgttctctttgaacaccaagtggatgtaccctccacttgaactaatcgcacaagagatgtaccctctcttgttctcagttaaaacaacccaagtagatgtaccctctacttgtaccacaaaggatgtaccctccaatgtgttaagacagaattttcaggcggttagtcctttgaatccttgtaaggggaaacaaaagatatctcaggcgattagtcctttgaaatcttttgtttatgggaaagggaagaatcaaaagaattctcaagcggttagttctttgaattgtcttggaaagggagaagggagacacaaaagaattcaggcagttagtccctctattcttttggaaaaaggagaagagagacaaaaaaagaattcaggcgattag

SEQ ID NO: 32082 - DNA, 207 bp, Glycine max
  Peptide Sequence Number=SeqID_123767
atggtggatgagccacgctcgagaccaatcacgtgcgagccggtcagttctggacccatcgacgaccctttgcgtgcacgcacgctcccaacgagacctcaggtcaggcggggctacccgctgagtttaagcatatcaataagcggaggaaaagaaactaacaaggattcccttagtaacggcgagcgaaccggggggatcctctag

SEQ ID NO: 32083 - DNA, 195 bp, Glycine max
  Peptide Sequence Number=SeqID_123768
atggctgcccgtgaactaagtcctttaatcgcatgttccctagaggtgactatcaccttggatgatgtcgcgtcattgctacatctgcctatcaggcaagagctgagacgattcagtgttatggctcttatatttgactattgtggctatgagacgtgtatcaaacgaagattgaggcatatcactggattgtag

SEQ ID NO: 32084 - DNA, 264 bp, Glycine max
  Peptide Sequence Number=SeqID_123769
atggcacaggagcgtgtttgctctttgcccctatttgggaacctatgggataatatctatgggtctctaataactacttcccaaccatttataactcacacggcgaggctcacgggtgcgcttgccaaaggaggaaagatgcgcggagtcgccaccaacgtcgacaaaagcggggcttttgctcctacataccctcctttggagaggaaatcagacctacgtagttcttacttaggcatgaatcaagcgattctttttacttga

SEQ ID NO: 32085 - DNA, 330 bp, Glycine max
  Peptide Sequence Number=SeqID_123770
atgactaatgcaaactgtccgcaagagtcattgcattcagtctcaaacgggaatctaagagttttgaattccaaatatggtggatggaggaaccttgaagaaacaggaaattcagcaaaacaatgtgtttggtggagggatgtaaaacaagctttcaatcaatctcaacaggaactggttattcaaaataacatgaggtggaaggtgggggatggagagaaagttagattctggacagataagtggattaatcaagaggagtcgctagcagaaaggtaccccaggttgtttattatatccttgttagacaagtggcctcagatatcttaa

SEQ ID NO: 32086 - DNA, 532 bp, Glycine max
  Peptide Sequence Number=SeqID_123771
atgtcgtcaaagttagctggctttatttgtagcctctacagccccttctgttgtctttggccgataaggggtggagttatgatgctggatcttgaaatctttgcacatttcctgcatcatcttattgttcagattggtgccattgtcagtaatgatcttcctggaaggatcaatctcccatctccatcaaatgggtgggattcgacttgggctgcgagccctcaattgggacatctattcctccacatggaaaaaggccaaggagcagacataacatttagaggatgtggtctcgacttggtacattggttccgatcgggactatgccgtcgctctggccaagctgtcttgaaagaaattggaccaatagctttttgtccgcagaatacgcccccatctttcggcaatacatccgaagatcccttttggacatgccgtccctttgtacttatcaaagtctggatggtaccactcacaaagaaaccagtagccaatcttctcaacgtccttttgtcattgtcagaaatccctg

SEQ ID NO: 32087 - DNA, 382 bp, Glycine max
  Peptide Sequence Number=SeqID_123772
atgagggtgtccttcgcaacccttaatattcatggcataacgctgaaaggcaaacaagatgaaaattgggggcaactgtttgccccaatgatcaatcaatggaataatcgagcggattttagggttgacggttatcctcgacaagagggcctattgagctttaactccgactacatggtttggtataggcgaaaaacaaagatgtttgttgaccctaaaaatgcaagcacaattacattgactgaagttgtggagacattacagtacatggtgtctccacaagggaggaatacatggacagttgatgatctcgtgccttatgtggagaaaataaccattttatcggaagagcaagagagaatcaatgagcctatgtcgcatg

SEQ ID NO: 32088 - DNA, 720 bp, Glycine max
  Peptide Sequence Number=SeqID_123773
atgcataggtcacatcttagacctcactcccatagaagagagaaggaaagaaagcctcaagaggctaacattaacctcccatacttccaggggaaggacaatctagaggctaacttagttttggaaataagggtagagcaacaacttaaaaagaagtccacgtcaaaatcttatggctctcactcttatccaaagaaataccaaggtcaaggcatcttaggggtgacaccttctaagcccaaagatggtaaggggaatacaatagaaaagcaagcccttaaggctagaatgcaagagaatgctagctctataaagtgctttaaatgtcttgcaagaggacacattacttctcaatgccccaccacgaaaaccatgattatgaggggccaagacatttatagtagtcaagatgaggctactacttcaccttcctatagtgaaagtgaagaagcaaaacgggaagaatctagtgaagaaatctacccccaagaagaaggacaaccattagtggttaaagagaagtgtaaggagacacttgctagcattgccacacctcttgggcttgaggttattcctcaagtaaagaagttgttggatgaaggtttggttcgtaagagcttaaatccttgtgctttgttggtgcccaaaataggaataatcaacataaaaatacagaaaaagatagtgatcaaggggtttccaaggaccctaagagaataa

SEQ ID NO: 32089 - DNA, 49 bp, Glycine max
  Peptide Sequence Number=SeqID_123774
ggtgaatgctgtgaagattttcccagacgcccaaaatggactcggataa

SEQ ID NO: 32090 - DNA, 249 bp, Glycine max
  Peptide Sequence Number=SeqID_123775
atgaatgcagggatggaaaagccggtaatgatccaccaacccgctagttctttttatgaggcacaaacgggagaatttatcctggaagcggaagagctactgaaaatgcgtgaaactatcacaagggtttatgtacaaagaacgggcaaacctttatgggttatatccgaagacatggaaagggatgtttttatgtcagcagcagaagcccaagctcacggaattgtagatcttgtagccgttgaataa

SEQ ID NO: 32091 - DNA, 326 bp, Glycine max
  Peptide Sequence Number=SeqID_123776
ggaatgatatatgtgatgatccatttgtttttgcatctcaagctaagaaagtattctatgtggaggataaaacacaaaatagttggcttgttgttgtgcatgctaaaatcagagatgtatatgatatgggtgataagcaatccaatgacacggatcaagggaatgaacaagtcttacaagagataaatcataatggtttgatcagagtagaagctgatgatagtgatgatatcattgaagttacaatacctatggagaacattttaccacatgacaaggatgataattatatagatgatgatgagagcgatgcagacttcttttga

SEQ ID NO: 32092 - DNA, 216 bp, Glycine max
  Peptide Sequence Number=SeqID_123777
acttatcaaggtaatccttgcggcgtttaccctgacttatcttccctcactggaagtggcgtctaccctgacttatcttccttcactagaagtggcgtctaccctgacttatcttccctctttggaagtggcgtcatccaaatctccgtagcctgtatcaagcgattcgttcctagtcaggatcacatcatctggtatcagagcttcggctcttga

SEQ ID NO: 32093 - DNA, 120 bp, Glycine max
  Peptide Sequence Number=SeqID_123778
atgcctaatcctgcaaagttcataactgagacgtccatctcccgacttgcaggggtgacaccaactaacaggagtatcgaagggagcctgatcatgaaatgtggagagattcttacctaa

SEQ ID NO: 32094 - DNA, 54 bp, Glycine max
  Peptide Sequence Number=SeqID_123779
atggccgaccaatgggcgaccaagtccaaagccaaaggtagcaagataccttag

SEQ ID NO: 32095 - DNA, 663 bp, Glycine max
  Peptide Sequence Number=SeqID_123780
cagcgagccgtattcgcgccgcgctatcctgctgccctccggcgtcaccagaatgtcgcgcacgctctggcggatgtggtcaatgtccgtgatcgtctcgccggtgcacccgtcgcccggccacagataaaccctcgaatgcttccggcacgcgcacacgcgtcacggcaaactgagcgcttcagtcgttattcgagcgtcgtgccactggtccagatcagcagctgcccaggcattccggctcataccatgaaaccagcctgcgccgtccttaaacacgtgtggctggcgcctcctaatagcaggttggcgggacaagcctttcctgaatcatatggatccggcagcgcaaacgcggtttcaagattgccgccgagtgctcagcagtacaatacctgctcccccacagacggcttccaccacgtacgtgtattaccggcgcgcagggtcagccagttgatccagtctggtttcaaggtcgcccgttttcacccggcacagccagttcaccttatccacctcggacacagtgccggtgcggatcaggcgcgtggcgtcattctgcgggcggtcagtcagcaccgacagcagcgagccgtattcgcgccgcgctatcctgctgccctccggcgtcaccagaatgtcgcgcacgctctggcggat

SEQ ID NO: 32096 - DNA, 606 bp, Glycine max
  Peptide Sequence Number=SeqID_123781
gaggaatttgatatcccagaggcttctgacagtaggacgaaaaggaagttactgcataccgtaggggagagatggaggcagtttaaaacagacctcacgaggaaatgggcccatgcagccgatcaggacggtgtcgaggacactgtctgtgagaaatacggtatcagcaaggaaaagtgggcccagttttgccagactcctagagaccctcttgggaggtatgatgtgcgcaagaaggcacaggccatcagaagcagaatactaccccccacgttttgtctcgtgggggattcctttgaggagcaggccacacagggatccttcatcccccatgaacgtcaggatgttctggccgctgctattggacgtccagagcaccctagacgtgtccgtgctgctggagccggtgtcaccatcaagaaatactttggatcggctccacggacgtcccgcagcgcttcctccctgcctcctgacgaattgcagcagctaacccagcaaatcagggaccagctagaggagtccatcacagagaaagtgacgaggcaggtcatggcatccttcagccacatgcagtcccagcttcagtcgcagatgcaatcttag

SEQ ID NO: 32097 - DNA, 416 bp, Glycine max
  Peptide Sequence Number=SeqID_123782
gtcgactctagaggatcccgcaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaaggcaccaccaga

SEQ ID NO: 32098 - DNA, 357 bp, Glycine max
  Peptide Sequence Number=SeqID_123783
atgcctggcgaccacaatgccaatctccccctgcagatgtatcagttgggatcgcgcctacaagacaccctagtggacccggaagaagtccaacagggccctagggtttccagctctgggatcgcgcctgcaagacacccagtggacctgaagaagtccagcaggttctacggagtgcctgtcacctccagcaagggcatcaggccccctactaatcgagttttcatcaagaagtactgcatccccaggcaggcgcagggcgaaacaccacagcagcctggggatggccagcagcgggcaacaaacgcaccgccatcacctctagagttcacctcagctcatccacaaaaaggttag

SEQ ID NO: 32099 - DNA, 862 bp, Glycine max
  Peptide Sequence Number=SeqID_123784
gaagcgcaatggcaaatgctggaaagctgggtggcacatcggccagccactgtcttgaccaagactgtgcagggtgacgtgcatcagcacttattgccactgaatcgcttgcccggtgacccagatggcgaagtgatgcaaaaagcaggtttggccgtgctgatgccggtgattcctgcagtgattggagaggtgctccctggctccattgctgagcagaatggcctgcaaaccggtgaccgcatcctgaaagtgaatcaaaaaacaattagcgattggcagcagtttgtcaaattggttcgtggtcatccaggccaatctctgaaaatagaataccagcgagatgagcatgtgtttcaggtgaaactcttgccagagtcagttcagcagggcggccaaaagattggccgtttgggcgcggcggtcaatatggaggcggtcgatatggcgccttatcaagtggttcgtcaatacagtatcacgcaagcggcacaacgtgctgttgataaaatgcaggaaacaatcgcattcaccctgaaaatgttggggaaaatgatcacaggccaagcttcactgaaagcgattagtggtccggtgagtattgcagatgccgcgggcgaatctgccgggatgggcgtgaagccttatattggatttattgcgctgctcagtatcagtattgcagtcatgaacctgttaccgattccagtattggatggcggtcatttgttgtatcatatggcggaattgatccgaggagaacccttacctgacaaggtgctggcgattggacagcgtcttggcttgggggtgatgcatctgaacgcatatgcgacagaaccatttgtcattactgatatcc

SEQ ID NO: 32100 - DNA, 318 bp, Glycine max
  Peptide Sequence Number=SeqID_123785
atggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctgcggtcgatctagaggcccctgtggtgaataccttacaagaaagagagcatattttggaatacactattgtagtagctgaaacagcggattctccagctacattacaatacctcgcccttatacagggcagctctaggctgaatattttatgtaccgtgaacgtcacactttaa

SEQ ID NO: 32101 - DNA, 964 bp, Glycine max
  Peptide Sequence Number=SeqID_123786
atggccgggataggagggtacccaaacattccgctgataggaacgaggggttgtattaactacaatcccgcgctcgctataagacaactagggtaccccatgaggggagcaccgatggaagaaagcaagtctcctttccttgtgagagatttcggcgcgcaaaatttcaaggctatacaaagaatccataaggcatgggaaaccccgttaaggaaagatcaagaacttaggggcattcgtaatggcatcattggtggttatcatgaatgcctgaaagttcatatacgaggtttagattggctcgccaagttaaaagtcgtcagtgaagacagtttcgaagcaccgaagaagacgaagaagtccaagctctcaaaacgagttaggaaaggcgaacttgccaaggagaagttcaagttagccgctacacacatccggaaggaatgtgccggattacgggaaaagaatgcaactaccgcaaaagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctgttcgaggtccaaaaggagcttgtctcagcgtttatgcgagacggagaccaacatgctggctatcatcgccaagtaccaagaagagttaagtctagccacgacgtacgagcatagggtcgcggacaagtatgcccaagtatacgcggaaaaagaggctagaggaagggtgatcgactctttacaccaaaaggcaaccatgtggatggatcggtttgctcttaccttgaacgggagtcaagaacttccccgattgttagccaaggccaaggcaatggcggacacttactccgcccccgaagaaattcatgggcttctcggctatt

SEQ ID NO: 32102 - DNA, 192 bp, Glycine max
  Peptide Sequence Number=SeqID_123787
atgtcacgaaacttcacgtattgtgcaacaaagggtgccaagtacctcgaagcggtcaaacaaaggttgcatgccatcaaacaatggtacccggacgaaattagggagaattataagcaattgggcttgaatccggaattgggcttggacttgaagagggcagccaattttattttatcaaatcttatctag

SEQ ID NO: 32103 - DNA, 123 bp, Glycine max
  Peptide Sequence Number=SeqID_123788
atgccaagcacctcacaaggaccaaagaaaggtcgcatgtcatcaagcaaaggtccccggacgaaattagggtatgacagaaatgggtttatgatcccaacatggttggctcatggtgactaa

SEQ ID NO: 32104 - DNA, 662 bp, Glycine max
  Peptide Sequence Number=SeqID_123789
attcgtttgagagcagccacacagggatcgtcgtcccccatggacgtcaggatgttctggccgctgctattggacgtccagagcaccctggacgtgtccgtgctgctggagccggtgtcaccatcaagaaatactttcgatcggctccacggacgtcccgcagcgcttcctccttgcctcctgacgaattacagcagctgacccagcagatcagggaccagctagaggagtccatcacagagaaagtgacgaggcaggtcatggcatccttcagccaccttcagtcgcagatgcaatctcagggagttgcagtgcctcctgagccttggtttggtcctggtcccaaaaattccggttcgattgtgagcacaaaaactttgtttgtgttgcctcaggcggaatttgatatcctgagacgagcttctgacagtgcggtgtacatagaaaagcgaagtcctacacgaccgtggtgccatgggagacagaagctcctggctgaaaaaaccaagaagaagctgcaggaagctgcacagtcaggaagcgttgatggcgtcatcgaccctccatcccctgtcagacgccacgtgaagtggaagatggcccgcacgaagaagacaggggagataacgactgaggccgcaaagaaaatcgctgaaaagatt

SEQ ID NO: 32105 - DNA, 984 bp, Glycine max
  Peptide Sequence Number=SeqID_123790
atgtccaaatcttgtggatttgggatgaccggccctctcgatgagtcgatctcttgctttctcataagggtggacccttgggtacttgtacctatcacctttagaggactacacgtcctcgccttgagaggactacacgtcctcaccttcgtagggctacacgccctcacctttagaggaccacacgtcctcaacttcagagggctacacgccctcgccatcagaggaccacacgtcctcaccttcgtagggctacacgccctcatctttagaggaccacacgtcctcaccttcagagggctacatgccctcgccatcagaggaccacacgtcctcaccttcagagggctacacgccctcgccatcagaggactgcatgtcctcaccttcagagggctacacgccctcgccatcagaggactgcatgtcctcaccttcagagggctacacgccctcgccatcaaaggactgcatgtcctcaccttcgtagggctacacgtcctcacctttagaggaccacacgtcctcaccttcagagggctacacgccctcgccatcagaggactgcatgtcctcaccttcgtagggctacacgccctcgccatcagaggactgcatgtcctcaccttcagagggctgcacgccctcaccttgagaggactacacgtcctcgccatcagagggctgcacaccctcacctccagaggactacacatcctcgccttgagagggctgcacgccctcacctttagagggctacgttacgggcctggggtttccagctctggttacgggcctctggattgcgcccgtaagacacctagtggacccaaagaaggccaacagggtcttggagttgccagctctaaatatgggtctctcaaggtcattaggccccctaccaatcgggctttcatcaagaagtactgcgcccccaggcaggcacagggcgaaacaccacagcagcattgggatggccgatag

SEQ ID NO: 32106 - DNA, 177 bp, Glycine max
  Peptide Sequence Number=SeqID_123791
atggatcgtgctacatcattgcttcgtctactgccaaacacctttagtattgttgatatccttgttacttccagcttcaccttgacaaagataggaggtgcaagagaagatgaaggccgacatggaggccatgaaagagaaaatggccacaatgatggaggccatgataaagcatga

SEQ ID NO: 32107 - DNA, 435 bp, Glycine max
  Peptide Sequence Number=SeqID_123792
atggcatcgggattggagttatcggcggggcgagtgcgggagccaagttttgagtgggagacctttgtggttgagcgggcactctttgctagatgggcgctggattggaagggtttccgacgtgggccgaaaagctgggttggtgtagggaatattggtaagtgttatgaggggagcggcataatcgaactttccccttttcaagcctacctcgatcctctcgcccgcaaataccaaatatgcgaagctagagggcatcgcacatctaccgctaagcgcaacttcagcatgcttagcacgatagaagaatctggcagagcatcaatatcagggtcacgcgctaagcgtgagatcaaggcgctaagtgcaacagttgtcttcagccaggctcagtgcatgactggcgctaagctcaaatccacttactcgcgctaa

SEQ ID NO: 32108 - DNA, 609 bp, Glycine max
  Peptide Sequence Number=SeqID_123793
atgcaagacgagcagtgcaaggatgtctattgcacacccgctctttatgtatggctgatctctcacatgttttgtcatgaaagtagacctgtcagtcccctacaaggtcatcgcatgtgtgccgagaaagggaaagcgaattgggaagaaatcttggtgaatatgggattcccaaacgtccctttgatgggaatgaggggttgtgttaattataatcccgtacttgtcataagacaactaggctaccccatgaggggagcaccgtcagaagagagtattgcgcctttcatcgcgcgaggcttcagtgacccgaatgcaaaaggttcaagtggggaagtgactaaagtccctgaggagagcgaagaagtgcaagccttgaaagcagaacttgaacgaatgcgagcagtcaaggaaaagttcaagacgatggccattagggttcgaaaaaagtgcgacatgctaaaggacatcaatgtggtcacgaccgaagcattagaacgagaaacgaagagggcccaaaaggaagaatggggccgaaataagttccgaggggctttatggggcagcaatagcaaactcaagcttcggagggccgaaagagatgagtga

SEQ ID NO: 32109 - DNA, 824 bp, Glycine max
  Peptide Sequence Number=SeqID_123794
gaaacagtcgggatcgtgcgccggcagcgtttccgtcgggacggcctcctgctggccctgccaggggcgcttggcgcggtgcggtgagaccagcacccattggccgctcagcgggttgtagcggcggtaaagaacagcagatgggtcagattaagcccgaaatggaacagaatcggcacccacaggcggccgctccacatccacgccaggccgtagatcaccccggccagcgtcgcgaagatcaccatcagcatgccgccggccaaatgcgcggcgccgaacaccagagaagcgacgatcagcgccggccaggcgcccagccactggctgaggcgctgctgcaggtagccgcgaaacagcgcttcttcggccatacagacgaagaacagcgccacggccagcagcaacagcgccggcacggccagcagcagcgcaatccagcccgctttgccgacgttgccgccgcgttcagcggaaaacagcgtgggcaagcaggcgaacagcaggaagggcaccatcgccttgtcgaagttgtaatacatggtgaacggcgcgctgagcgggccggctttttcaccgtcgatcatcagctgattgtggatgcccggcaccaggtgcaagaacagcgccacgcagccggcgaccaccaacccttcgaacgcgatcgccagactacgccgctcgcgaaaatggtgacgcagccccgccagcgccacgatggccaacaggcaacccaggctgagcggcgtcaacaccccatgataaagccccatgcccgccgaggcggccaggataacccaggctatcagccggttaaacggtaa

SEQ ID NO: 32110 - DNA, 517 bp, Glycine max
  Peptide Sequence Number=SeqID_123795
gtgcacggggtcttaccgtctagccgttggtactccgcatcttcacggagaattcaatttcaccggttactgccgccgtttaccggggcttccattcaaagcttataacacttctccttccgaccttccagcaccgggcaggagagcaccccttctcccgaagttacggggtcattttgccgagttccttcgacatggttctctcaagcgccctagtatactctacttgttcacctgtgtcggtttggggtacggtcagttcaccgggaggatcgccctcccaattcgaagttttttcctggaagtttcaaccttgttgactatgacaacagtcgcgactataaacagactcgcgactatggcagggcggtacgctctgctctctcgcgaccctactctaacgagtaagcaagtcaactaccttttgaagcgccagtcgcgtagggcgaccgggccaggccgagtcagaaaggctttgatgactcaagcaaggttcatcttagggaaaggagagtga

SEQ ID NO: 32111 - DNA, 692 bp, Glycine max
  Peptide Sequence Number=SeqID_123796
atgagttggttaacgccggatcttatcgacatcctgctgagcattctgaaagcgattgttatcctgctggtggtggtcacctgcggcgcgttcatgagctttggtgaacgtcgtctgctcggtctgttccagaaccgttacggaccgaaccgcgtgggctggggtggttcactccagctggtcgcggatatgatcaagatgttctttaaagaggactggatcccgcgcttctcggatcgcgtgatctttactctggcaccgatgatcgccttcacctcgctgctgctggcgtttgctatcgtgccggtcagcccgacctgggtggtcgctgacctgaacatcggcattctgttcttcctgatgatggcaggcctcgcggtttacgcggtcctgttcgcaggctggtccagtaacaacaaatactcgctgctgggtgcgatgcgtgcttccgcgcagaccctgagctacgaagtgttcctggggctctccctgatgggcgtggtggcgcaggccggttcattcaacatgaccgacatcgtcaacaaccaggccgacatctggaacgttattccgcagttctttgggtttattacctttgccatcgcgggcgtggcagtgtgtcaccgtcacccgtttgaccagccagaagccgaacaggaactggccgacggttaccacatcgaatattcccg

SEQ ID NO: 32112 - DNA, 304 bp, Glycine max
  Peptide Sequence Number=SeqID_123797
atggaagaggcagagaaggagatcttggaaacatttagaagagtagaggaagtgaaagaattagcatgggcagaaatgtcctctgcattgattggtaaatctgttccccatatccttgaaaaatggaataataagtttgacaatgccatgctagatttaggagcttctattagtgttatgcctctgtctatctgtatctctctatctcttggtcctttgcagtcaactgatgtggtgattcatttagctaatagaagtgttgcctatcctgctggtttcatagaggatgtcttagttagagttg

SEQ ID NO: 32113 - DNA, 1139 bp, Glycine max
  Peptide Sequence Number=SeqID_123798
atggcgagccaagagaagtggggcccgtttgcagatattttagctttgctgatttttggggttgtcctctttccgaatgttgacggcttggtagacttagccgccattgattctttcctcgcatatcaccatagcaaggaaagtccagtggtagctatcttggcggatttgttcgacacctttgaccagaggtgtgagaaaaacagtgcacggattgtctgttgtttgcccgccctctgtgtatggttgatttcacacctattccgacaagacacgagacacccgtgtccgcttcaaagctatcgctcatgcgccgaaaaaggaagagtcgtttgggaccaacatttggctgggatagggggcagtacaatcaattggtttcctcgttggaaggaaggcaaggaaggagttcttttctcgtgtggggactatcctaatgttccactgatagggactacgggttgtattaattataatcccgtactcaccataagactgctagggtatcccatgaggggagcgccaaccgaagaaagtctctcgcctttccttgtgagggatctaggtgcgcaaggtctcaaggtgatacaaagaatccacaaggcgtggaggagtccgttgaggaaagacaaggagcttagaggcatccgaaacggcgtcattggagagaacttcgaagctccggaggaagatgaagaagtccgagctctaaagttagagctagggaaagcgagactcgccaaggagaagttcaaatcagctgctacacacatccggaagagtgcaccgagttacaagaggaaaacgcagccactgcaaaatcccttgaacaagaaaccaaaagggcccgcaaggaggaatatggccgaaagaaattccgaggagcattgtggggtagcaacaatgagctcaagctccgaagagaagagagagatcggtcacgggaatttggctcaacacttggaagccaccgagcaaagcatgctagccatcatagggcaatacaaggaagaattgaaccagtccacggcccatgaacaaaagttagtggaggactatgcacaagtgtatgccgaaaaggaggcaagagggagggtgattgatgcgctgcatcaagaagcgactatgtggatggatag

SEQ ID NO: 32114 - DNA, 414 bp, Glycine max
  Peptide Sequence Number=SeqID_123799
atggaaagactaccttcgtcacactgtggggaacattctgttacgaaggtgatgtcctttggactcaagaatgccgtgggacaacttatcgaacgtttaggccatggtggagcagtattgttccatggacaatcaatgatgtcactttcacagcagacgaggtctacgtggattgacataattgcaccaagtctaacatccgagtatgaagaacctgtgtgccctgccggatccgttgacaagttagactccaatgtcaaactactcaaggtgtaccggcgactcagcgttgattcatatcgcagctcaccgccatttgtgagccattgttcaaactcttacgcaaaaaccaaactgaccgctggaatgagggttgccaagaggctttcggaaggatcaagaagtgcctcatga

SEQ ID NO: 32115 - DNA, 323 bp, Glycine max
  Peptide Sequence Number=SeqID_123800
gggggcggagcctatggaaaaacgccagcaacgcggccttttacggttcctggcctttgctggcttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaataacttgtaaaaagaatttacaagatagtggaactctcaagcgggttgcttggggactggacgtaggcacaagg

SEQ ID NO: 32116 - DNA, 288 bp, Glycine max
  Peptide Sequence Number=SeqID_123801
atgtcacagaacttcacggattgtgcaacaatgctttcttttgacttccggcatgtcatagaacttcatggattgcctaacgatggatgtcaagtacctcgaagtggtcaaatgagggtcacatcccaacaaacggatggtccccggacgaaattagggtatgacaaggggcacaaagttgtcaaagtattgacaatcaaaatttctattccttggattatggggttgaaccaagcatatgcttttaagaaaaggttttcatcaagtcaaggtcaagtatggaagtaa

SEQ ID NO: 32117 - DNA, 528 bp, Glycine max
  Peptide Sequence Number=SeqID_123802
ggcgagctggagaggcgtaactttcacaagcgcctcaccaacttagctgatagtagcattgacctcgcgttggtgaaggagttctacgccaacctctacagtcctgaggggccttcacctaaacaagtcagaattcggggccacttaattaggattgatgcagacaacctcaatgactttctagaaacacctgtggtgcttgctgagggtgaatctttgcccgcgtactcaagatactgcaggatgcctactgacaccagagaaattgaggctgcatggtgcatacccggccgagggtttattctaaatgctgaaggtcacctgaggaagatcctcagaaaatacctaaccacccttgctcaggtctggagtgttctatcctactccaatttgtctccgacctcccacacattggatctgactgtggatcgagctaggttaatctttggcctagttactcagctagacatgaatgtcagagccctcatttctgggcaaattacttctatggcccagtctaactcctaa

SEQ ID NO: 32118 - DNA, 784 bp, Glycine max
  Peptide Sequence Number=SeqID_123803
gatccccaccatcagagggctgcacgccctcacctctagaggactacatgtcctcgccttgagaggactacacgtcctcaccatcagagggctgcacgccctcacctctagaggactacatgtcctcgccttgagaaggctacacgccctcaccttgggtactagttaccctcaccgttcagaggactacacagggctacacgccctcaccttgggtactacttaccctcaccgtcagaggactacacgtcctcgccttgagaggactacacgtcctcaccaccagagggctgcacgccctcaccttccagaggactataaaggactacacgtcctcgccttcaaagggtcatgtaccttcaacttcagaggactacacgtcctcgccgtcaaagggtcatgtgccttcacctttgtagggctacacgccctcaccttcagaggactacacgtcctcacctttagaggactacacgactacactccctcgccttcgaaaggcgacacatctgaacttcagagggctacacgccctcgctatagaggactatgcgtcctcactttcaggaccagtagtttccttttaacggttcctgggccaccccctgatattggaggagggccaactgtgcgagcacaaccagagagggaggctatcacacagctactatgcatactggggcaagatttcacccgtgccgctgcaaagagaagaggatcgcacccacaaagacacccagtgaacctgaagaagtccaacagggccctggggtttccagctctg

SEQ ID NO: 32119 - DNA, 246 bp, Glycine max
  Peptide Sequence Number=SeqID_123804
atgtccaagatggaagatactttaaaccagtttatgcaggataatgatgagaaaaagaataaaaaaggagttgaaaaagaaaacgagaaaaaggatgaagtggtgactagtgaagaagtggaagaaaaaatgattaacattcctttttctgaagtattagagcagataccaacatatgctaaattcatgaaggatttgcttatgaaaaagaaaagaattatggatggtgaaataataaagccttag

SEQ ID NO: 32120 - DNA, 129 bp, Glycine max
  Peptide Sequence Number=SeqID_123805
tctcgacccacaacagatagaggaggatttttcaatcacatcgtcatttcgggacaagcggatcatttatgatgaagaggatgagcttcaagagaatgattcagagttcttgcagggtggaaccatgca

SEQ ID NO: 32121 - DNA, 643 bp, Glycine max
  Peptide Sequence Number=SeqID_123806
atgtctaacatgatcaaaggtcaagtgaagtggttcaacgaagctaaaggttttggtttcatcaccccagcagacggcagcaaagacgtattcgtacacttctctgctatccaggatcaaggcttcaagaccctggctgaaggccagaacgtacagttctctatcgagaacggtgcgaaaggtccatctgcggctaaccccgcaagtctgcgggcaaaagttccttgttacttcttcatttgcgagcgcttctctgggggggaaacgcctgaagacaggctacgcgagaccggcttaagattctgcggccaaaccgttaagaaagtgaaaatccaggcggctgctacgctgatagcagaggctggcagggctagggcggtgtccatcgccctcgacggcggcccgcggcgtgaaggcatcattttggccgtagaggtgttcaacgaaggcaccatgtatctggtttctcttgacgactacccggcgggcgtatggttttttaatgaaatcgacagccgtgacggcaccggtaagattctttttatcgatgacaaaaaaatacccgttgcgctagcgggggataacgcagcaggtattcttttaagggcgccagcatctgatatccagatgacattatcaccgg

SEQ ID NO: 32122 - DNA, 75 bp, Glycine max
  Peptide Sequence Number=SeqID_123807
atgggtgtcaagtacctcgaagcggtcaagcaagggtctcacccaaacaaacagatgatccccggacaaattagg

SEQ ID NO: 32123 - DNA, 240 bp, Glycine max
  Peptide Sequence Number=SeqID_123808
atggagaattcgtccataacagtcaaccacttaatccaaccctatttcaatttactaagcgacccccctcaacttagggttttcaatatcccctcaggcaccacatacaccaggagaactgccaggaaaccacattacaagcgaaacctcaaagagagttgggcttcgtcctcaaaaggaaacaacaccagaaaatctagccttacatggattcaaacagaaaacgcaattgaaacatga

SEQ ID NO: 32124 - DNA, 207 bp, Glycine max
  Peptide Sequence Number=SeqID_123809
atgggttttcagaccttaccttactccaacataccaaacaccagtgttgatggaagaagcccagagtttcaagaacctctggatttgaggtcaaatccttttcaagggagagagaatgatgaaatcttacccccccaagggcattggatagaagactccaagaagattgggccagagatgcaagagaaggccctatggttctcatga

SEQ ID NO: 32125 - DNA, 369 bp, Glycine max
  Peptide Sequence Number=SeqID_123810
atgccgagggaaatgggccccgaaatctacatgatcgaggaagtccatgtggaagaaggctcgtttggaacgacgccctgggctgcttatggccaggaagatggcctgaagagcagggatttcccgtctgaattgtcatgctcttgttacaatctttctcgtggggaaagaaatgacatcgggattgaggccttaggcctcaatgtctcgcgtttcaatcctcgtagcgtagatttgtgtcacctgggtcgaggcgcttccgctataccaatgtcacgaggggtgtggtggtcaggttcattaagaaagagatcatctgccgacatggtttgccgaggaagattatcacagacaacggcaccaacctga

SEQ ID NO: 32126 - DNA, 390 bp, Glycine max
  Peptide Sequence Number=SeqID_123811
atgcaggctgttggtcatcaccgtgatgttgttaaagcggctgagcagggggatcatttgcaggacggtgctgcctgcgtcgaggatgatggaatcaccatcgtgaataaatttaacggcggcctcggcaataagcgctttctggtgggtattgatcagcgttttgtgatcgataggcgggtcagcttcgtccttattcagcatcaccccgccgtaagttcggatgacggcgccagagttttcgagcaataccaggtccttgcgtattgtcgtgccggtggtgtcaaagtagtgggccagatcctccaccgagcatttcccctgcttttgcagatactcgagaatggccgcctgccgctgacgtggtttcataggcgcttcgttccttag

SEQ ID NO: 32127 - DNA, 647 bp, Glycine max
  Peptide Sequence Number=SeqID_123812
cgtacacggtggatgccctggcagtcagaggcgatgaaggacgtgctaatctgcgaaaagcgccggcgaggttaacgaggcgaaccgggggaactgaaacatctaagtaccccgaggaaaagaaatcaaccgagattcccccagtagcggcgagcgaacggggagcagcccagagtctgaatcagctttaccgtgagggaaaggcgaaaagaaccccggcgaggggagtgaaaaagaacctgaaaccgtgtacgtacaagcagtgggagcaccttcggggtatagacccgaaacccggtgatctagccatgggcaggttgaaggttggcactgtttcggctagggggtcatcccgacttaccaacccgatgcaaactacgaataccgaagaatgttatcacgggagacacacggcgggtgctaacgtccgtcgtgaagagggaaacaacccagaccgccagctaagcctgcgaaggtggcctgtgagggttgctggaggtatcagaagtgcgaatgctgacataagtaacgataatgcgggtgaaaagcccgcacgccggaagaccaagggttcctgtccaacgttaatcggggcagggggggacggagaaggctatgttagccgggcgacggttgtcccggtttaa

SEQ ID NO: 32128 - DNA, 237 bp, Glycine max
  Peptide Sequence Number=SeqID_123813
atgaaggctaatatggaggccattaagcaacaaatgacaacgatgatggaagcaatgatgagcatgagaaagatgatggaggataacaccgctacagttgttgctgtgagtactgctattgagatggacctaattcacctggccgatttcaatcaagtgaatcgtctagtctccgatgtagtatgtcaaggaggttcagagcaagcattccttcccatcatatgggttgcctcctaa

SEQ ID NO: 32129 - DNA, 183 bp, Glycine max
  Peptide Sequence Number=SeqID_123814
cttgcttctacacgcaagtctcgcgctaagcacttatttggtcatgcgctaagccgagagtctctggcgcttagcgctcaacccttgcatctcaggctgatttggtctgctaagctggccaaggctaagctaagcctatttcaattcgatctgaattgggctaagcgatggccttctcgctaa

SEQ ID NO: 32130 - DNA, 1080 bp, Glycine max
  Peptide Sequence Number=SeqID_123815
atggtgagggcattggaggtctcttttaataggatgtccaagaagatgttcgagtttgactcgaccgtgtttcgccacttcaaggactatttcttcaagatcttggctactgacgttgtggctgatgggttgccacgcttctcgttctactactactacgaccttgcaggatgtatagacctttttgtctcttccctcggtataatggggggtcaacccactactggggttggccttattgataaagttgttgaggtcttccccaacatgccttcctgtattttggctaagaggaagcacgatgatggtgttggggtgttaggctacaagaagtcaagggccccttccagccttcgagctatgagggaagctgagatttctgcttcttctattgctgcatcggctgcttcgctcggtcctatcgaggttcctccatctgtagttgctgcacccttgttgagtgaatgccgccttccacctcttttcaccctagtgtttatttggatcacatctacacttctcgtgatgctgattcactgtgggaggggctcaccatgggcagaccttaggtttaatgagcttcggaccagggatgcattcgttctaggtattggcgaggctcaccaaggggatgtgttcgtcttgggttttggcaaggctcaccatgggtggaccttgggcttgacaagcctgtacagatgcatcgaggctcaccaaggggcagaccttgggtttgatgagtctttggagaagcgagacttactaaggaagaaccttgggtttgacaagcttttggagaagcgagactcaccaaggacaaaacttgagtttgatgagcctttggagaagcaagattcagcaaggacaaaccttgggtttgatgagcctttggagaatgagactcaccaagggcaggccatgggtttgaaaagcctttggagaagcaagactcaccaagggcaggccatgggtttaacgagtctttggagaaagcctttggagctacaactagggatgcacctatttgggttttttcaaggcttaccaaggacgaaccttgggtttgacaagcctttgtag

SEQ ID NO: 32131 - DNA, 166 bp, Glycine max
  Peptide Sequence Number=SeqID_123816
atgtcaggacatcgtatccgacatcttggatcctgcagcttcaatgcttcacttgacttttatcttgcattgtacagcacttccagtattctcgagcaggatgtcaggacattgtatccgacgggtaccgagctcgaattcgtaatcatggtcatagctgtttcct

SEQ ID NO: 32132 - DNA, 87 bp, Glycine max
  Peptide Sequence Number=SeqID_123817
atggcgggtgttacagactacatatgtgagacatggattgtccctcacaaggagaaatttatcttggcctggacgaataagggttga

SEQ ID NO: 32133 - DNA, 332 bp, Glycine max
  Peptide Sequence Number=SeqID_123818
tgccggaaggtcaaggaagttgtgacctgatgacaggggagccgacgaccgaagccccggtgaacggcggccgtaactataacggtcctaagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaagttactctagggataacaggctga

SEQ ID NO: 32134 - DNA, 195 bp, Glycine max
  Peptide Sequence Number=SeqID_123819
atggtgggagcaggtttgaaaaaggatcttagagtgtctagggttgtgccaggagggtctcttaatgccttcctttttcttctcatcggagttatttcacaaagacttgccatgtgcgatgatttacttcacgggcgaggtctctggttcaagtccaggatggcccagctgcgtcaaggaaaagatagaaactga

SEQ ID NO: 32135 - DNA, 666 bp, Glycine max
  Peptide Sequence Number=SeqID_123820
atgtcctcgccttcaaaggggctgcacgccctcgccttcagagggctacatgccctcgccttcagaggattggacgtcctcaccttcaaaggcctacacgccctcaccttcagaggactatacgtcctccccttgagaggactacatgtcctcaccttcaaagggctacatgcccttaccttcagaggactacatgtcttccctttcaaagggctacacgccctcgcctttagaggactacatgtccttgccttcaatgggttagggctgcacgccctcgccttcagaggactggatatcctcaccttcagaggcctacacgccctcaccttcagaggactatacgtcctccccttgagaggactacacgtcctcgccttcggagggctacatgccctcaccttcagaggactacatgtcttccctttcagagggctacacgccctcgcctttagaggactacatgtcctcgccttcaaagggttgtacgccttcgcaatcagagggctacacgacctcactttccgaggacagcacgtcctcaccttcagagggctgcacgcccttgccttcaaagggcgacacgtcctaaacttcagagggctgcacactctcgcttcaaaggcgacacatcctaaacttcaagggtgcacgccctcgctttag

SEQ ID NO: 32136 - DNA, 1465 bp, Glycine max
  Peptide Sequence Number=SeqID_123821
atgagctatgacttctacggtgcgtggagcatgaccgatctcggccaccaggcggcactgcatgcgccagcatggcgtccagacaccaactacaccaccgctaacggcgttgacgcgctgctgcagcagggcgtacagccaggcaaaatcgtggtgggtaccggcatgtatggccgcggctggaagggcgttcacggttacaccggcgacaacccgttcaccggtacggcgactgacgccgtgaaaggcacctgggaacccggcgttgttgactatcgtcagattgtgaacgagtacaaaggcaagccaggctgggaatacggttatgacgcggatgctgaagcgccatacgtctttaacaagtctaccggcgagctgatctcttatgaagatgcccgttccgcgacggcgaaaggtaaatacgtgatggccaaaaacctcggtggtctgttcgcctggtctatcgactctgataacggtgacatcctgaacgcgatgaacgaaagcctgctgggtggttcaacgccggatccggtggtgactaaccatgcgccaattgcctccgctgcggatcaaaccgtgaccggtccggcaactgtcaccctggacggctctgcgtctaccgatcctgatggcgatgcgctgacgtacaagtggacccagatctctggcccatccgtcacgctgaccaacagcaccaaagcgaaagcgaccttctccgttggcgcggtgaccagcaaccagaccctggcattccgtctgaccgtgaccgatcctaaaggtctgagcagcaccgctgatgttcaggttgtgaacaaggcgccgaaagcgaaccaggctccagtggttaaccagatgcaggctgtaaccctggaagcaggccagtcttataccctgaacgtacaggctgcggatccagatggtgatgcactgacctatacctggagcgttccatctgatatgcacgccaccggtacgaacacctcaagcgtacagatcaccgcaccggatgtgagcactgactcaacctacaccctgagcgtgatggtgagcgatggtaaagccagcgttcagtctaacgtacaggtcacggtcacgccgaaagcaacgccggttgtgcctgatgaagacaacacccccgctgacgaaggcgacaaaccttctgacgaagggcaagcaaccggcagctgtgacaacccggttgacgccaacgccagcaaatatgcggcatgggaatccagcaaagtctataacaatggcgatatggtcagttccgataatctggtatggaaagcgaaatactggactcagggcaacaaacctggctttgatgcagacgcatgggaaatggtcagccaggtgaaaatgaactggcgtgccgataaagtctacaacggtggtgacaaaacgtcctatcagggctttgaataccgtgcgaaatggtggactcagggcgacaaacccg

SEQ ID NO: 32137 - DNA, 231 bp, Glycine max
  Peptide Sequence Number=SeqID_123822
atgtggaccaccacgggggaggagcttgccacccagctcgcccaggcgagcaaggttgcttcctctagaagcaacagccttctggaggaaggatctggaaggcccaagtgggccagattgctatttctttcgaagaagttacggaaacttacggattgcgcaaaaacacctcttttcgatttccgccacattacggaatttcacggattgcgtaagcctgcttccttttga

SEQ ID NO: 32138 - DNA, 1494 bp, Glycine max
  Peptide Sequence Number=SeqID_123823
atgactacacgtcctaactttagagggtttcacgtcctcaccttcagagggctacacgccctcaccatcagaggactacacatcctcgccataaaagggacgcgtaccctcacctttagagggatgcacgcactcgccttcagacgactacacgtcctcgtctttagagagcagctcgccctagccttcaaaaggactacacgtcctccccatcagagagctacacgtgctcaccttaaagaagaccacacgccctcgccatcagagggtcacatacccacaacttcagaggactacacatcctcgccatcagagtgtcgcgtaccctcaccttcaaaggcctacatgtcctctccttcagaggactacatgtcctcgccttcaaaggactacacgtcctcgcctttagagggccacatgactacacgacttcaccttcagagggctacacgtcctcgccatcagagggctacacgccctcaccttcagaggagttcacgtcctcgccttcagaagactacacgtcctcaccttaagaggactatatgtcttcgccttcagaggactatacgtcctcgccttcagaggactacacgtcctcgacttcaaagggctacacgtcctcgccttcagaggactacatgtcctcaccttcagaggactacatgtactctccttcagagggccactcgtcgtcgccttcagaagactacacgtcctcatcttcagaggactacacacctcaccatcagaggactacacatccacgacttcacagggctacacgtcctcaccttcagagggctgcaagccctcaccttcaaaggactgcacgctcccacttttacaggactacacagtactacacgtcctcaccttcagagggctacacgccctcgccttctgaggactacacatcctcgccataatagggtcgtagggttgctcgccctcgccttcagaggactacacgtcctcgcaatcagagggctacacgccctcaccttaagaggactacacgtcgtctccatcagagggtcgcgtacccacaccttcagaggactacacatcctcgccatcagagggtcgcggctactcgccctcgccttcagaggactacatgtcctcgccatcagagggcaatacgtgctcacctttagaggactacacgtcgtcgccatcagagggtcacatacccacaccttcagaggaccacacatcctcgccatcagagtgtcgcgtaccctcaccttcaaaggcctacacgtcctcgccttcagaggactacatgtcctcgccttcagaggactacacatcctcgccttcagagggccacatgtcgttgccttcagaggactacatgccttgccattagaggactacacgacttcaccttcagggggctacacgtcctcgccatcagagggctacacgccctcaccttcagaggacttcacgtcctcgccttcagaagactacacgtcctcaccttaa

SEQ ID NO: 32139 - DNA, 261 bp, Glycine max
  Peptide Sequence Number=SeqID_123824
atgcgtaaggagaaattaccgcatcaggcgccattcgccattcaggctgcgcaactgttgggaagggcgatcggtgcgggcctcttcgctattacgccagctggcgaaagggggatgtgctgcaaggcgattaagttgggtaacgccaggctccttgtaagcaatgagttcatcgattctttacctagtgtagcgccttcatcttcaattatccttgaaggccaactgaggcaatgcaaagcctcagtttgtcagttgtaa

SEQ ID NO: 32140 - DNA, 234 bp, Glycine max
  Peptide Sequence Number=SeqID_123825
atgtatgcatcaatgcaaattgcaaaccaaatgacatggcactatgagaatagaagatcttcaagcgtcatccttttgatggaagaacaaaaatgccttcaaaaaaagggaagtagaaaggatgaatcaccgcgtatgttgaaacctacacaagtttggcatagggttagagatttgccaaaagtcatagaaactggtttgccaccaccaaatgtacatggatatggggagtga

SEQ ID NO: 32141 - DNA, 89 bp, Glycine max
  Peptide Sequence Number=SeqID_123826
aggaatgtggaatcatcccacaatacaccatgtcggggtcacctagcatgaatggtgtggctgaaacagaactcttaaggatatggtaa

SEQ ID NO: 32142 - DNA, 273 bp, Glycine max
  Peptide Sequence Number=SeqID_123827
atgatccttaagaatcaaggaagtcacttagtccattatgtaagtcaccaagaaaatcaaggagctggaaagaaatttatgaagaagcatgataagggcaatgagccattaaagataaatgatgcatcagtgcaaatccaaaagaaagcatcagagaacagtaattgccacttttgtggtaaagctgaacaattccagaaggattgcccaaaacataaggcttggttcgaaaagaaagatatctcttacaatccaaaccataagcccaaatga

SEQ ID NO: 32143 - DNA, 681 bp, Glycine max
  Peptide Sequence Number=SeqID_123828
atgcttggccacagagagggcgtgcgtgacatgagatcctgggtaagggtcagtggatcccgtttgatgccgacgctatcggccagctctgggatatccgttagtgctggaaaagggccaggagtgcgagtatggccagaggaggaaccggattttgcccggactgctgcagggaggcgagtgcgaatcatgcgcaccaatatgaccaccctgacccagatatggatgacgttgctcctcagcaacatcctgcccagcgatcataattccgaccttcccctgccgaagtgtcagctggtgtacgccatcctgacgcggatgagcatccatgtggctcagttaatcgctgatgccatctatatttttgcaggtatggcgcctactaggcaccctttggacccagataagtccaacagggccctgggatttccctcgctgatcacaggactctgccagtcattcggagtccccgttgcacctaccaaggtaattcggccgcccatcaaccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggtggccaaccatcgagcacatgtatag

SEQ ID NO: 32144 - DNA, 267 bp, Glycine max
  Peptide Sequence Number=SeqID_123829
atgttgcggaactttacggattacgtaatcatcccttttttgccttccagaacgttacggaactttacagattgcgcactaacacttccttttaattttcggcatgtcacggaacttcacggattgtgctacgacgcttttcttttggcttccggcatgtctcggaacttcacaaattgtctaacgatgggtgccaagtgcctcgaagtggtcaaacgagggtctcatcccaacaacggatggtccccgggcgaaattaggatatga

SEQ ID NO: 32145 - DNA, 228 bp, Glycine max
  Peptide Sequence Number=SeqID_123830
atgaattttgatgcatacacccctgtacataatcattgcatgttttaccacttgaggacaaaattcgctaagcgcaaccttcagtggctaagcacgaggaagaatccaaaagaagatgagctgtcaagttcactaagcgcaccgataccaggtcatcaagcacaccgctttagctcatccgctaagcgaaagaagtgcgctaagccaatatccatttatgcgcgctaa

SEQ ID NO: 32146 - DNA, 399 bp, Glycine max
  Peptide Sequence Number=SeqID_123831
atgccctcacctttagaggaccacacgtcctcaccttcagaggactacacgtcctcaccttcagggggctacacaccctcgccttcagaggactacacatcgtcaccttcagagggctacacacccttgccttcagaggactacatgtcctcaccttcaaagggctacatgcccccgccttcagaggactacatgtccttaccttcagaggactacacgtcctcgccttcaaaggactacacgtcctccacttctagagtagcaggcaacaggcgcaccgctaccacctctagagttcacctcagctcatccacaaaaagtaggacacacctagttgctcatgatcctaggaatttaaataaaacaagcacaagctcggaaggtagcaagataccttag

SEQ ID NO: 32147 - DNA, 243 bp, Glycine max
  Peptide Sequence Number=SeqID_123832
atggccaacaaaaacatatcatccaatgaaacatacccctccacacttattcccaaaacaattccaaagctcaaaaattccttaagggcttataagaacaaaatgcctaaatcatctcccaatatgcatgtgaagcaagaagtatcaacaagagtcaagccaaggctattgtgcaagcaatcaatggggcaaaacacaccgaataaaatagatgatggtagctctaattctcaccaagggtaa

SEQ ID NO: 32148 - DNA, 450 bp, Glycine max
  Peptide Sequence Number=SeqID_123833
atgggtcaacttcaacggcaagccttccgcgaagcctatggtaagatttgggacctagctagggtagaagtctccatggaaccgattgcatccctttcccaatgtatgccatgccaggtgtcctcttatccaaactatggaaggttagtggacctagcagtgattagactctttcccttccctttcatcatagggcaaggaaagcaaaccggtcgtcgccatttttggccatgcatgacacgtatcgatcagactgttatgttgaaaagagcggcgcaagaattgtttgttgtacaccggctctctatgtgtggctggtttcgcacctttttctccaagaaggtaggctcatctatccgctacaaggtcaccgctcgtgcgtcgaaaaaaagaaggacgaattgggaccaactcttggctagcaagagggcgtctgggggtatcctctag

SEQ ID NO: 32149 - DNA, 138 bp, Glycine max
  Peptide Sequence Number=SeqID_123834
atggcgcctgatgcggtattttctccttacgcatctgtgcgccccgacacccgccaacacccgctgacgcgccctgacgggcttgtctgctcccggcatccgcttacagacaagcttgtgacgtctcaggagctgcat

SEQ ID NO: 32150 - DNA, 519 bp, Glycine max
  Peptide Sequence Number=SeqID_123835
atggaagagggatatgaggctgcggttcaggtaggtgctgctactggtggaggcactagatttggttgccaaaccttaaggtcatggcactcacattttttggattatgcacagtttgtgaaggcaatttgtcagaattttgggactgagcatgactctgaatggaggctcttgtctcttgctgaaatttcatattctggatggtcatttgtctcactaactcttctaaggaaggttgaggaggagcctcagttgcttgttgtctttgttgtgactgctgttgctgctgctgctgtattggaggaggaacatatggcttgcttgggccaacaacattctggaaataagggacaggctattgttgttgtggaggacttgcccatctcagatttggatgatttctccaacctggattgtatctattgcttgaaagatcataattattatgttgttgttggttttgctgctgagggggtctattataaatgttggcagcataagcttcaagttgctcattga

SEQ ID NO: 32151 - DNA, 318 bp, Glycine max
  Peptide Sequence Number=SeqID_123836
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatcccccaaacttgagccccctttttaccagtctgagaaaaatcccaactcaaaaagaacaaaaaattccatccatagattaaaaaagaaaaagatctatggctataaaatacttttccatggtgagaaacatggaaaggtggtcccaccttag

SEQ ID NO: 32152 - DNA, 309 bp, Glycine max
  Peptide Sequence Number=SeqID_123837
atgagcacacaacagagacgtcctccaccactgggacaacgtcgtatgactcttgctgaacgagaacagtatcggaatgaaaaatgtcaatactgtgataaaatgggccatatgacaaagatatgctggtgggtgtccaagaaaccaactcaatctaatgatatacctcaagcacttgtagcccttaccttagacaacacaattgctaaaacagaatggacctttgacatcggggcctctaatcacatgacaggtacagactctgtgcttattggtgatggttcttctctcccaatctcatggtattga

SEQ ID NO: 32153 - DNA, 379 bp, Glycine max
  Peptide Sequence Number=SeqID_123838
ggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtaccgatatccctgaaggtcagcaaatatttgatcctatggtcaagtatgggcttgatccagaaacatgggtggggatcctctag

SEQ ID NO: 32154 - DNA, 1108 bp, Glycine max
  Peptide Sequence Number=SeqID_123839
atggggacaaatcaaaacggcaaaaggttttatcaagtcaaggttaaaggtctagatgtcactatcctcaaggaattgggacgattgatgggacccctccaaaggcaagccttccgcaaagtttacgggaagatcctagatttggccgtagcggaggtatttacggaagccgtcgtatccctcgcccaatactacgaccagtcgttgaggtgtttcacgtttggggacttccaaatggtgccaactattgaggagtttgaagagatattaggatgccctctcggggggagaaaaccgtatcttttcttcggctttcttccttccttgagcaaggttgcggctgtggttggagattcagcaaaagagttggatcgcataaagcaaattcgaaacggcgtagtgggcctgcctcggaaatacttggaagacaaggcaagggatatggcgagccaagagaagtggggcccgtttgcggatgttttagctttgctgatttttggggttgtcctctttccgaacgttgacggcttggtagacttagccgccattgatgctttcctcgcatatcaccatagcaaggaaagtccagtggtggctatcttggcagatttgttcgacacctttgaccggaggtgcgagaaaaacagtgcacggattgtctgttgtttacccgctctctgtgtatggttgatttcacacctattccgacaagacacgaggcacccgtgtccgcttcaaagctatcgctcatgcgccgaaaaaggaagagtcgattgggaccaacatttggctgggatagggggcagcacgatcaattggtttcctcgttcgaaggaaggcaaggaaggagttcttttcttgtgtggggactatcctaatgttccactgatagggactaggggttgtattaattataatcctgcactcgccataagacagctagggtatcccatgaggggagcgccaaccgaagaaagtctcttgcctttccttgtgagggatctaggcgcgcaaggtctcaaggttatacaaagaatccacaaggcgtggaggagtccgttgaggaaagacaaggagcttaggggcatccaaaacggcgtcattggag

SEQ ID NO: 32155 - DNA, 513 bp, Glycine max
  Peptide Sequence Number=SeqID_123840
atgggatcgagtcaggcgcctttgcttaaaaagaggttctatcaagtcaaggtcaagagcctaggagtcaccagtatgaaagagttagggcagttgatgggtcagctccatcaacaagcctttcacaaagcttacgctataagacaagttggctaccctatgagaggggcaccactagaggaagacctcacacctattattgcacgaggtttcaatagcaccaacgcggaggcacttcagaaggtccgcaaggcatgggagatggtgcaaaagaaggacaaggaattcagaggcagtagcaacgggcccattggtggctaccataggtggttgaaagcctacatgcaaggtctggattggctcccgaatttgagaaccactaaggggtggaagttgaagctccggaggaggacgaagagtgcaggccctcagacagaactcgagaaagcccaaactgtcaaagaaaagttcaaatcaacagctcttaggatccgaaaggagatgtcaaactga

SEQ ID NO: 32156 - DNA, 186 bp, Glycine max
  Peptide Sequence Number=SeqID_123841
atggcagcagaacggagaaggaagagagagaggagacgccacttcaaggagaagatgagtctagaagaagctcaccaccataggaggccatggataagagcttggaggaagaaggagatgaatgaattatggttcagccccactaatccaagatcaattccaagattctccactaagtgtgcttag

SEQ ID NO: 32157 - DNA, 321 bp, Glycine max
  Peptide Sequence Number=SeqID_123842
atgacacttatgcatgggagtgtgaaaaatggcatgcagcgtgtccgctccgtgccctattcaagggacctatatgggagggagctaacaaggcttttagtggtaattcccaaggtggtcatatctctcttgaaggtctctagaggggtaagtcacggtaaaacattgcacaagattaaatggcctaactctctaaaaacagtccccagtggagtcgccaactgtcgcaacctacccttcggcgagagggcgacgcgtgactcgcgggatgcgtgttccacgaaaggaatacgcgcggagtcgccaccaacgtttatttga

SEQ ID NO: 32158 - DNA, 236 bp, Glycine max
  Peptide Sequence Number=SeqID_123843
acgcaccgctaccacctcatcaggctgatctcgttgggtcactaggcatggagcattatctacaacacttggttcgccagcaggcggccaaccacttggggcaggtgcagatacatgagtgtctctaccagctcagcctcagtcagcaggggcagggtttcgctccttttgcgtgccctactccagatcagtttaggcctgaggtcgcatggcccggagattggcccgaggcctag

SEQ ID NO: 32159 - DNA, 189 bp, Glycine max
  Peptide Sequence Number=SeqID_123844
atggctatatggtgggaatacctttcttgggtaaaggaagacaaggtgtttcactgtaggcctttggataattttatccagcactactcctcagcaacttcaaaggtttctaacacaagaaggacaatgtggtggatagcagctacagacctatcaaacttttacaatgggtttggtatacatgaatga

SEQ ID NO: 32160 - DNA, 500 bp, Glycine max
  Peptide Sequence Number=SeqID_123845
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgtgaaaagcagttcactgcagcatcttctatcagctactagtcttttccaggatgtcaagacatcttacgtgacatcacctttctgctccccctgtctccatgctctagctgcagtatcttctatcagctactcgtag

SEQ ID NO: 32161 - DNA, 582 bp, Glycine max
  Peptide Sequence Number=SeqID_123846
atggcggttgatgaagaacctctccaaatgcaagccttccgcaagacttacggaaagatcttagagttgaccatagcggaggggtcctctcgggcggaagaaaaccggaataatctttcctccgggtgtctcccctctttgagtagcaattgcaactatggtcaaagattcagcgagaggtttggaatgaaacagactcgaaacggcatagcgggcctaccacggaggtacctagaagacaaggcaaggggtatggccaatcaaggagattgggtcccgtttatggatgtgttagctttgctaatttttggggtcgtcctctttccaaacgtggatggtttggtagacctagcagcaatcgacgctttccttgcataccaccatagcaaggaaagtccggtggtagctatcttggcagatttatttgacacatttgaccgaaggtgcgaaaagagtagcgcatggatcatctgttgcttgcctgccctctatgtttggttggtttcgcacttgttccaacaagacacaaggcatccatgtccgctcctgagccatcgctcgtgtactgaaagaggagaatag

SEQ ID NO: 32162 - DNA, 702 bp, Glycine max
  Peptide Sequence Number=SeqID_123847
gtcgactctagaggatccccggatagtatttatggttctacctttttcttagcaactggctttcatggttttcatgtgattataggtactcttttcttgatcatatgtggtattcgccaatatcttggtcatctgaccaaggagcatcacgttggctttgaagcagctgcatggtactggcattttgtagacgtggttcgattgctgagatggttctggaactcacggaaagaggcttttaaggggtgcgcccttaacccgattccggggttcattggagctgtcggagttagcgtcgggactaccctgtcatgccgaatgaagtcgtgtacaacaaccttaaccgcacaagcttgggctgggcctacctccatccctagaggagccggattagtgcgtgagaccgcgatccacaaaagcatgggactcaccctttacttgggaatgaagaggggaaagatagcatgtcacaagagcgaggcgaggtttgtaaccctactgcgagagggacgcctcgcgagccgggcttctagagatgaggccttttggcgaagccaagtcaatttcgggccaccaaaccctgcaactgatgagaaggcctatggagtaaagggaagcgtggggacaggagacggccatctcgaggcacatcacgacctacaggcaagaccggcgagacctgggaaggctacccgattggga

SEQ ID NO: 32163 - DNA, 264 bp, Glycine max
  Peptide Sequence Number=SeqID_123848
ggccttctcttgcatctccggtccaatcttcttggagtcttctatccaatgcccttgtggggtaggattgcatcagcgttgggaagtgcgggaagcccccattttgtgcaggttcaaaacaaatattccttcccaccatatggcttgcctcccaactatacactacccaatgttgcacacactctcgatgagaatgttgacaactctgcacccatacccattgagagccaacaaccccaatttgatcatgcacatgtctcttaa

SEQ ID NO: 32164 - DNA, 318 bp, Glycine max
  Peptide Sequence Number=SeqID_123849
atgggtcaactccaacatcaagccttccacaagacctatgggaagatttgggacctagctacaatagaagtctccgtggaagcaattgcctcccttactcagtattatgaccagcccctaaggtgcttcacatttggggacttccagctagtaccgactgtggaagaatttgaagaaatcctgggatgttcgctcggaggaagaaagccatatctctttttggggttttatccctccatggcaagagtacaaagggtagttaaaatctcagtacaagagttggaccgtgtgaagaacaataggaacggggtagtctga

SEQ ID NO: 32165 - DNA, 1030 bp, Glycine max
  Peptide Sequence Number=SeqID_123850
gatcccacagagcagtgcaaggattgtctattgcacacccgctctttatgtggggctggtcttgcacctctttcgtcatgaaagcagacccgtctatcccctgcaaggtcaccgcatatgctccgagaaagggaaggcaaattgggagcagctcttggctagtatggggttctcaaacatccccttgatgggaatgaggggttgtatcaattataatcctgcccttgccataagacaacttggctaccccatgagaggagcatcgtcaaaagaaagcatcacgcccttcatcgcacggggttttagtgaccccaatgcaaggatatttcaaagggtccaaaaggcattgagcgtagtgcaaataaaggataaggaacttaggggaagcaacaatgggatcattggcggatatcacaagtggctgaaggctcggacacaagagttagattggctcctgaagctaaaggtcccaagtaaggaagaggctgaaaccccggaggagagtgaggaggtacaagccttcaaggcggaacttgaaaaggcacaagcgatcaagggaaaattcaagatgacagccatcaagggcccgaaaggaaaagtggggccaaaacaagttccgagggcattgtgggtcagcaacagtgagcttaagcttcaaagggccgagagagaccagtcgagaatcaaaggcatgatattggaggacaagttgaaggcttgtcaaaggtcaaaaagaagtttttccgaccaattcagcaagacggaagaaaacatgtgggccatcattgaccaatataaggagaagctaagtctagcggcaacccatgaacaaaggctagaggacgagtatgaaaaggtgtcggtcctacaagcagaaagggaagcgagagaaagagtaatcgattcattacacagagaagcaatgatgtggatgggtaggttcgctttcaccttgaatgggagtcaaaagcttccgagattgctagccaaagctaaggtgatggtagacgtgtactcggcccccgaggaa

SEQ ID NO: 32166 - DNA, 255 bp, Glycine max
  Peptide Sequence Number=SeqID_123851
atggcagacaagctagacagtattttacgtgcaagaccttgtgatgaaaggtggtgcgtggctctgcagggcaaaacagttggtgttaatgtagaaaatgatgattcatacatggacacctatgttagtcctttgacctctcaaatcactgagacagaggtcaccaaacctagacttcatccagctcatgtttgtcgccagtttcatcatccaccacccttttcttctctggcttctcacgttcattgttgttaa

SEQ ID NO: 32167 - DNA, 456 bp, Glycine max
  Peptide Sequence Number=SeqID_123852
atgaaagaaagggaatggaaaatcttcagaccagataaattctcggcaagattgccattctcgactggcgatatcccaccccacatgaacaaagaggaaaagaccgaaacacccaacttcctctccaaaaacactaccctcgagaaaatcctattggtccgtgatccatgttttccttttaggtggaaaaacccggtggaccgttcggtcctgccaacaaacttttattcggagacccatgaatgtcattgcctagcgctgttcatgtgtcctccaccctcgagtctggagccctgcgaatgtcattgcctagcactgttcgccatcattttaggaacttttaggaataactgggaaatgtattttaacgatcctagttcattggagccagagagattaaaggcattgcggatccagtgggcacactattatctccgagttagagatcagacctag

SEQ ID NO: 32168 - DNA, 945 bp, Glycine max
  Peptide Sequence Number=SeqID_123853
atggctccgagaaagctttccacaaagaggtctaggaaggacgctacggctgaagggactagtgctgttcccgagttcgaaagtcattgtttcaggagcgctgagcaccagcagcgtttcgaggccatcaagggatggtcattccaccgagagagacgcgtccagctcaggaacaatgagtacacagatttccaggaggagatagctcgtcagcgttggacgtcgctggtcactcccatggccaagtttgatccggatatagttctggagttttatgccaatgcttggcccacggaggagggtgtgcgagacctgcgacgccccagccagttcctgggatacccgctagtgttggaggagggccaggagtgcgagtatagtcagagaaggaaccgggccgatggatttgacgaggaggccattgcccagttgctatgcataccaggtatgtcgcctaccaggcaccctctagacccagataagtctaacagggccctgggatttccagcattgatcacgggcctctgccaatcattcggagttcctattacacccagtaaggtgatccggccgccgatcacccgagccttcattgagaagtattgcacgcatagacaggcgcatggtgatgcaccgcaggccgcagatgcaccgccaccacctcatcaggcggatccagctgggtcatttggcatggagcggtacttatggcacttggttcgccagcaggcggccaaccacagggcgcaagtgcagacccatgacagtctctaccagctcagcctcagtctacagagccagggttttgctcctttccgtgccctactccagattagtttagggctgaggtcgcatggcccggagattagcccgaggaccagacagaggaggcacctacagaggctcccggcgatccagaggacgcccgcatggatgaggagatga

SEQ ID NO: 32169 - DNA, 321 bp, Glycine max
  Peptide Sequence Number=SeqID_123854
gtggagggcaaagaaggctcttctggggggccagagccatcagtgagataccactctggaagagctagaattctaaccttgtgccaggactacgggccgagggacagtctcagtgcaaaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 32170 - DNA, 461 bp, Glycine max
  Peptide Sequence Number=SeqID_123855
atgttgtcttcaaacgcagaggattcggtgaggaagaagggcttctacaagtcttgtcctccaccacctccgccaccgccaccaataatgtttcagaaatcagtgttcatgaagccaaggttcaatggttcatccaacgaagcaccttccttcaataaggagttgaagagaagctttacaagtgagagaaccacaccaccagctgagaaagaaagccttcttgtggaatctaacgatgatgacgacgacgatgacacagaaatcgaggaccaagacgttgaaggaggaaggaccgttgctcagaacaatgacaggggaaagggtccacctgttattggtggagaaagttcaaaaatagatggtgatgaaggaccagatgtggataagaaggctgatgagttcattgctaagagaattgagtcaatagagaggagtagaaggagtgcaagaaactcttcaag

SEQ ID NO: 32171 - DNA, 426 bp, Glycine max
  Peptide Sequence Number=SeqID_123856
atggacatagattatgctataaggaaagacgaaccacctgcaatcacaaatgaaagtagcccagctgacgttgcgctatatgagcggtgggaacgatccaaccggctcagcgtgatgttcattaagactaaaatctcggctgggatacgtggttctgttgaccagcatgaaaaggaagaagaaaggcttgtaatggagatgggtgagagtgcactactgactactgcttatgggaagaacaaagcaattaagtctcaagcttatcagaaggggaatggtaaaataccacctcaagctgatattaagaaggtggcaaagtgtttcttttgcaagaagaagggacacatgaaaaagaattgccccggattccagaaatggcttgagaagaaagggtatgcaaaacctaaggaaaccagtgggaagtga

SEQ ID NO: 32172 - DNA, 174 bp, Glycine max
  Peptide Sequence Number=SeqID_123857
atgtcagtgaaaaatctcgtcagacgtctaggagtacatgacaagacaaaccacacactaggagaccagtcaatgtcacattgttatgcgaggatgctccaatcatatgggatcaacataggcttaaagaaacactcaaaccgggtgtatttacccccaaggcctacactctga

SEQ ID NO: 32173 - DNA, 660 bp, Glycine max
  Peptide Sequence Number=SeqID_123858
atgaaaagagaaaaacatgcctcctatagtagtcataactcttgcaagagcctaagtgaagaacttcgtgactattacgaaggaaggcataggtcacatcttagacctcactcccatagaagagaaaaggaaagaatgcctcaagaggctaacattaacctcccatacttccatgggaaggacaatgtagaggctaacttagtttgggaaataagggtagagcaacaacttaaaaagaagacacattacttctcaatgccccacacaaaaaccatgattatgaggggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggaacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggaataa

SEQ ID NO: 32174 - DNA, 216 bp, Glycine max
  Peptide Sequence Number=SeqID_123859
gtacaaactgtcattgcttgatattgttggtgttacaccaacaggaatgacattctctattgtttttgcttacttggaaggagaacgtcttaacaatgttttttgggctctacagcggttttggggtcttttcatgaaagttggtgcactccctggggttattgttaccgacagagatatctttgatgaatgcagtgaaaattgtattttcggatg

SEQ ID NO: 32175 - DNA, 650 bp, Glycine max
  Peptide Sequence Number=SeqID_123860
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttactcgctaaagaaaaattcaagttagccgctacaagcatccggaaagagtgtgctgagttacgagaggaaaatgcggctaccgtgaaagcccttgaacaagaaaccaagagggctcgcaaggaagagtatggccgagataaattccgagcagctatatccaagaggagttgggcccaacacttagaagccacagagcgaagcatgctagctatcatagggcagtacaaagaagagttaaaccagtctttgacccatgaacaaaagctagtagaggacttcgtacaagcgtacgccgagaaggaagcaagagggagggtgattgatgcattgcatcaagaagcgaccatgtggatggataggttcgccttgaccttaaatggaagtcaagacctcccgcgactgctagccaaagcaaaggccatcgctgaa

SEQ ID NO: 32176 - DNA, 780 bp, Glycine max
  Peptide Sequence Number=SeqID_123861
atgtccacctatgttgattacaaaatcaacctggtggacaacaacgatttcaccgacgctgccggcatcaacaccgacaacgtggttgcccacggattgatccgttgtcggcatgggaagcgcttcggatcgcctccgctcggcctacgctgtcagtacagcaaacagaacggaggtgatatggaactcaagatcgataaggtgatcgaaacggtgttgtacgtcagcgatattgaacgcgcggacgctttttaccggcagggcgattcgctgagcggggcgcactatccgaccgggtttattcccgcgcacgatggcgtggggccggcgcatatcgggctggcggtggcgaaagagcaactgccgcactgggaacggcatctggtggccaacggcgtggagattgaggggcgaatgcgttgggaacacggcggggagagcatttattttcgcgatcccgacgcccacctgctggagctgcgcggcctgcggttgccgctctatctgcactctgacgatggcgccgtcgatcagcatcgccagcattgccgcccgctgttcccgctgcggcccggcgggcaggtggcgcgccagttcatccgccatctgccgcttatgccggccggcgatgtgcaggctttccggcagcaggtcggctatctccaccgcagtattgataaacgcgcagccgcgaaagcgcggatcgtcgaaccattccgccaggcagggcgccagcgccggcagcaacccgccggtctgcgccacatggcgggccagtga

SEQ ID NO: 32177 - DNA, 273 bp, Glycine max
  Peptide Sequence Number=SeqID_123862
atgtccaaatcttttgaatttgggatgaccggctctctcgatgagtcgatctcttgctttctcataaggatggaccctcggaggactgcatgtcctcaccttcagagggctacatgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttag

SEQ ID NO: 32178 - DNA, 186 bp, Glycine max
  Peptide Sequence Number=SeqID_123863
atggggatcgcacccacaaagacacccagtggacctgaagaagtccaacagggccctggggtttccagctctggttacgggcctctgtcggccctacagggcgcccgttccccccagcaagttcatgtcgtcgtgggattggcccgcaagacacctagtgacccgaagacgccaacagggcttgga

SEQ ID NO: 32179 - DNA, 228 bp, Glycine max
  Peptide Sequence Number=SeqID_123864
atgtatggtgttgcttgtcaatgttatgattcaacaagcgattctcctcaaatttcagccagcccgtatcaattagacttcacactttatgcttcggggtcagacaatgctcaatggaatgccccagggctcctccacgataagcacacgttgcgttcgagtcgaatcctcagaaaaatggaggtggtcttcgtcattggaagtgcggtagacagactttgtggttga

SEQ ID NO: 32180 - DNA, 162 bp, Glycine max
  Peptide Sequence Number=SeqID_123865
atggcgagcatgggtgaaccgcagatcctcggccaggtgaaggaggcctggtcgaccgcgcgcgaccacggccttctcggccagcgcctggaccgcctgttccagcagaccttctcggtggccaagcgtgcgcgcaccgatacccaggtcggcgccaacccg

SEQ ID NO: 32181 - DNA, 168 bp, Glycine max
  Peptide Sequence Number=SeqID_123866
atggaagaaaatctcaagaagactctcaaattcttagatgctacaaatgcaatcaacttgaacaagaaggcctacattgcatgggatgacaatgactcatccgatggttcagagaaggagatcaaccttctaaccaaggactatgaaagcgatgagaacatctcttaa

SEQ ID NO: 32182 - DNA, 315 bp, Glycine max
  Peptide Sequence Number=SeqID_123867
atgccttccaaggttattttgatgatgccaaagaataaagagttaagcaaagtttcaagcaaatattcaagaatcaagtttcaagtttcaagattcaagattcaagattcaagaataatcaagatcaagattcaagaatcaagcgaagactcaatcaagataagtattaaaaagtttttcaaaacattgagtagcacaagaagttttcacaaaatcattgccaaagagttttactctctggtaatcgattaccagaaggtagtaatcgattactggtgttttaaaatgttagatttcaaatttcaacagttttaa

SEQ ID NO: 32183 - DNA, 258 bp, Glycine max
  Peptide Sequence Number=SeqID_123868
atgaaggatacggcttatcaaaagccaatgaaccgacataaaggcgttccggtcatatccgcatggtggggcaaaccaactggcaggcatcatgtgcagagaaatcaaatttccaattgtcattcagtgtaccttcaaaatggaatacaccgtcctgggacatgggttattggaaaagggatatcagaaaatagtgtggacgaagatatggagggtggaattggtgctgtggatgcgctgttggctccggaacgatga

SEQ ID NO: 32184 - DNA, 174 bp, Glycine max
  Peptide Sequence Number=SeqID_123869
atgcagagactaacattgtctcctgcaccttttgtcatcctgacccgtgaagtcagggttaccttatggttacccacacttttcatcaaccagaggccaaacgagcccgttgacgcactgagactaacattgtctcctacacctcctgtcgtcctgacccgtgaagtcagatga

SEQ ID NO: 32185 - DNA, 712 bp, Glycine max
  Peptide Sequence Number=SeqID_123870
ttctgaggatcatccaccaaagcagtccagagtcagaggtcatttggtgaagattgatgctaacagtctcaacacattcttggagacacctgtggtattatctgagggggagaccttacctgcttactccagatactgtaggttgcctacagactatagagagatagaggctgccttatgcatacctggccaagggttcatcttgaactcagaggggcatcctaggaagattctcaggaaggatctgactacactagctcaggtttggagtgtcttctcatactccaacctagctcccacatcacacacttctgacttgacagtggatagagctaggctgatatttggcctagtctctcacttggacatgaacataggagcgttgatctctggccagatgacctctatagcccagtctaacacttctagacttgggttcccagccctaatcaccgcattatgtagagccagaggagttgtctctgatagccacacttttgagcgcctgagcccagtcattaacttggcctacatcaggaagaactgttggaaccccgaggaactaacagtttctattcgaagggctaggagagaaagggcaaggccagctgagcttccttttacttctgcagctcctactctagcatccacttcagcagccccttctgtcccagttcagacagattctcaacgctttgaagctatgctttag

SEQ ID NO: 32186 - DNA, 234 bp, Glycine max
  Peptide Sequence Number=SeqID_123871
atgagaaagcgccacgcttcccgaagggagaaaggcggacagtatccggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 32187 - DNA, 267 bp, Glycine max
  Peptide Sequence Number=SeqID_123872
gctacggagaattggatgacgccacttccagtgaaggaagataagtcagggattctcatcactatcaccttggatgacatggcatcgttgctacattttcctatcataggagcgttccatagcttcgagcaacttcatgtcaacgatgctatcaagattttggttgaattactcgagaaccctaacagagcaaccagaggaggagctctagagagcaccagagacgtcaccattgctaacagagaacatttaagcgactacatcgag

SEQ ID NO: 32188 - DNA, 639 bp, Glycine max
  Peptide Sequence Number=SeqID_123873
atggacatgaatgtgggagcccttatctctggccagatcacatctatagcccagtctaactcttctagacttgggttccctactctgatcaccgccctgtgtaaggccagaggggttaattctgatagcttggttttcgagcgcttgagcccggtcatcaacttggcctatattaggaaaaattgttggaatccttatgatctaacaatttctatcagaggggccaggcgggcaaggacgaggccagctgagcctccttccacatctacagctcctattccagcatgtacctcagcagctccttctgtcccagcttctgcagattttcaacgatctattccttcagtggagcagttcactgagttggtagcctggcccgggactcagtcttctcttcgtagggaagatgaaggtcccacagcccaggtatcacagcatgtggaggatgattcatccgaggccaccattccagagccttttgtcagggggatggaggcagaggagacacaggaagctgcggccacacttgagagatctcttgaggtagcttctgagtccccagcacaaggggaggacataccctcacctcagcctgcaacagacccttccactcttgtcttggacttatcagaggattaa

SEQ ID NO: 32189 - DNA, 213 bp, Glycine max
  Peptide Sequence Number=SeqID_123874
atggaggggcagaacataattgatggagtaaaactcgatgtacctcctttcaagggcaggagtgatccagatgcctaccttgactgggagatgaaaattgagcatctacaacagaaccatgcgatagaaacttcagaggttgacccagggaagtttgaccgtggaggagtactacaaggagatggagatgacactagtgagggccaacattga

SEQ ID NO: 32190 - DNA, 414 bp, Glycine max
  Peptide Sequence Number=SeqID_123875
atgctcagtaacccctactgcaaaaacaaggttgccatagtgggttcaagctactatggaatactgcaaaaggttttaggcaacaagtttcagagcagactgttacagattatagacacaagccaacttccagatttcctcgacggcagttgttcgtgcccaaatgatggagggtgtcttagatctgataagggaccttggaatgatcctgacattttgaaactattgcattctagagaagcaatgaagctaacaaagtttggaagtccttctgttgctgatggggttgatgtgaagtcatattccagcaaggttaaaagcactggaatatctgaacctctatcagcgtcagaagtaagattgaatccttcagccttcgtacaatctgttccttctagtgaaaaagtgagctga

SEQ ID NO: 32191 - DNA, 453 bp, Glycine max
  Peptide Sequence Number=SeqID_123876
atgagggcgtgtagccctctcaaggcgaggacatgtagtcctctggaggtaagggcgtgcagccctctgatggtgaggacgtgtagtcctctcaaggcgaggacgtgtagtcctctgacggtgagggtgagggcgtgtagccctctcaaggcgaggacttattgtcctctggaggtgagggcgtgcagccctctggtgctgaggacgtatagtcctctcaaggtgaggacgtgtagtcctctgacggtgagggtaacatggggttggcaactgtcgcaacctacccttcggcgagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttaa

SEQ ID NO: 32192 - DNA, 303 bp, Glycine max
  Peptide Sequence Number=SeqID_123877
atgatggagggatctggcggcccagtgatgagcatgaagaagataatggaagccaatgcggttgcagttgctgctaccagggctgttgctaaggtgaacctgattcccacatttgatctcaaccaaatgaatcatccaacctcagatatggtgggcaaagatttgggaagtacggacgaccccatgatgtgcaaattcaaaacgagcacgccttcccgccatatggcttgcctcccaattatacgccacccaatgtgcgtacactcccatgagaatgtcaataactcactcctatacccatga

SEQ ID NO: 32193 - DNA, 288 bp, Glycine max
  Peptide Sequence Number=SeqID_123878
atgtcatctattgtttgcagggattgtgcccgcaagacacctagtggacccgaagaagccaacagtgtcttggagttgccagctctaaatacgggtctctatcagttcaagggagtgcctgttgcccccagcaaggtcatcaagccccctagtaatcgagctttcatcaagaagtactgcgtctccaggcaggcgcagggcgaaacaccacagcagcctggggatggccggcagtgggcaatagacacaccgccaccacctctaaagttcacctcagctcatccataa

SEQ ID NO: 32194 - DNA, 228 bp, Glycine max
  Peptide Sequence Number=SeqID_123879
atgaattttgatgatgccaaagaagaatcaaacaaggccgcttcaaggataagcatttgcttcaagattaattcaagatgcttcaacaaaacaaagccttgtttaaagatcactaagatcaagccttgcctcaaaacaaagggtttcaaagtcatgcaaggctctggtaatcgattaccaggaagtgtaatcgattgccagaagggaagaatgaaaaagagcttttga

SEQ ID NO: 32195 - DNA, 492 bp, Glycine max
  Peptide Sequence Number=SeqID_123880
atggtggggggtcagcttgttatagtatcaagtgaggaggacatactagtaagttatctgtcttctacgccttatgttgaagcagcggaggagtcactagaaacgtcatttcaagcattggaaattgtgaatagtgcttatttgaagtctcttttgatacaaccacgcttgtttgatacctctttgatggtagctcgagttatgctaaaggatgggtataagcctagaatgggtttggtccagaatggtggtggcgcagtaagcctgttgaagattgatgaaaactgtgggaggtttcgtctggggtacaagcctacaagtgctgacaaaagaaggattgctttggaaaggaaagagaaagacttagctcgtttacaagggcgaggatcacaggtggagagggtccctatttgtcacatcaatgagagctttatgaatgtaaggtggatgcatgaagatcaggttcctatgctagatgaagagatcgattaa

SEQ ID NO: 32196 - DNA, 166 bp, Glycine max
  Peptide Sequence Number=SeqID_123881
gtacaaatcctaatgatggagtggggctttcgcaattccaaatgcaagctttgatgcaacatttggagagagggaatggtggtgttcctagacaaaaccgaattgatggtattaaactcaacattcctccatttaaaggaaataatgatctggaggcctacttgga

SEQ ID NO: 32197 - DNA, 589 bp, Glycine max
  Peptide Sequence Number=SeqID_123882
atgtccttgccttcagagggctacacgccctcgccttttgagcactacacgtcctcgccttcagagggctggacgccctcgcctaaagagggctgcacgccctcaccttcagagggctacacgccctcgcctttagaggactacacgtcctcgccttcagaggattacacaggactacatgtcttcaccttcagaggactacacgtcctcggcttcagagggctaaacgttcttatcttcagagggccacacgccctcgcctttagaggactacacatcctcaccttcagaggactacatgtcctcgcctttagaggactacacatcatcacctttagagggcaacacgccctcgcattcaaaaggctacacgccctcacctttagaggactatacgtcctcaacctcaagaggactacacgtcctcaccttcagaggactacacgtcctcgccatcagaggactgcacaccctcaccttcagagggctacacgtcctccccttcagaggacaaaaggtcctcaccttcagaggactacacgtcctcgcctttacagggctacacgtcctcgcattcagaggactacac

SEQ ID NO: 32198 - DNA, 769 bp, Glycine max
  Peptide Sequence Number=SeqID_123883
aggactacacgtcctcacctttagagggctacacgtcctcgccttaagagtactggatgtcctcaccttcagaggactacacgtcctcaccttcagaggactacacgtcctcgccatcagaggactacacgtcctcgccatcaaaggactacacgtcctcgccatcagaggactacacgtcctcacctttagaggactacatgtcctcacctttagaggactacacgtcctcaccttcaaaggactacacgtcctcacctccagaggactacacgccctcgcattcagaggactgcacgtcctcaccttcagaggactacacgtcctcaccttcagagggctacatgccctcacctttagaggactacacgtcctctccatcagaggactagacgtcctcacctttagaggactacatgtcctcaccttcagaggactacatgtcctcaccttcagagggctacacaccctcgccttcagagggctgcatgtcctcatcttcagtgggccactcgccctcgccttcagtggactgcacatcctcaccttcggagggctacatgtcctcaccctcagaggactacacatcctcacctgcagaggactacacgccctcgcctttagaggactacacgtcctcaccttcagtgggctacacgccctcgccttcagaggactacacgtcctcaccttcagagggctacatgccctagccttcagaggactacacgtcctcaccttcagaggactacacgtcctccacttctga

SEQ ID NO: 32199 - DNA, 614 bp, Glycine max
  Peptide Sequence Number=SeqID_123884
atgcatgagaacatggatcacactgctcaccttacctttgaagggaaacctccccatcccacaggaggcgcccgcgaagaccctcggaagcgtgcccaaggggacatcgactcctgcctccttttcaccactgagggaccggcgcccaatgccttgcctcagcccaatatcgcgagagtctctcaaccccacccgatgcaaccactactcttctcagtaggggagccgcctctagcagtggaaggaagagaaaagctcgatctcatcgaagagagattgagagcggttgaagggttcagagattatccctttgctaacatgactgacctattgtcataccctaatttcgtctggggattattacttgatgatatgcaacctttgattggccgcttcaaaatacttggcaccctttgttgcgcgatatgtaagtctgatacacgccggaaatcaaagggaagcaggctgaagggggctgttctaagggtcccggatccccctggtgatgtatttcagctgttttgggtgaaaaaaattgctttcgtgaggaaaatccaagccaaggttttcctccgttattcaccgttcttcatccgttcttcgttcttcaacgg

SEQ ID NO: 32200 - DNA, 581 bp, Glycine max
  Peptide Sequence Number=SeqID_123885
ccctcgcctttagaggactacacgtcctcaccttcaaaggactacacgtccctcaccttcagagggctacatgctctcaccttcagagggactacgcgtcctcgccttcagagggttgcaacgtcctcgccttcagagggctgcacgccctcaccttcagaggagctacatgccctcaccttcagaggactacacgtcctcccatcttgagagggttgcatgtcctcgccttcagagggctacacgccctcaccttcagagggctacgacgccctcaccttctgaggactacatggctacatgccctcgccttaaaaggacggcacgtcctctgccttcagagggctactgccctcgccttcgaggactacacatcctcgccttcagaggactacacgtcctgcgccttcagaggactacacgtcctcgccttcagagggctacatgccctcgccttcataggactacacgtcctcaccttcaaaggactacatgtccacgccttcagagcgcaaaatgccctcgcctgcagaggactacacatcctcgcctttagaggactacacgtcctctgccattag

SEQ ID NO: 32201 - DNA, 297 bp, Glycine max
  Peptide Sequence Number=SeqID_123886
atgataaaattaagagcgatgctaagcattatatttgggataacccctatttgtggaagttgtgcagtgactagtgtcgcaacatgcccttttgcgggcgagggaggcgaggctcacgggtgcgtcttccgaaggaggaaaatgcgcggagttgccaccaatgattatttgtggaaaacgtcggaaaaaccgaaggaaaccggtcatgaagaatattccagattcgggagatgtcgacaaaagcggggctcttgctcctacgtacccttcatcgaagaggaaataagacctacgtag

SEQ ID NO: 32202 - DNA, 198 bp, Glycine max
  Peptide Sequence Number=SeqID_123887
atgtccgtcagggtccagcctatagccttcttatgcttcttgagaactgacaacaacttctcctcttgctcatcagcaagggaggcagatataatcactgggaaaactctgctatcatccaaaggtaaaacaccaccatcagacatgcaatcaatatcactcttagattcactctcagcatcaaattcagacatatga

SEQ ID NO: 32203 - DNA, 452 bp, Glycine max
  Peptide Sequence Number=SeqID_123888
ttgcggcagcttccgcgccagcaagatacggacggcgaagccaaagcaatactaaacaagcgagaaaagccctatctattctattagtcaagcctaaacttattgaaaacgaaagcgctaacgagcaagaaaacgggaaggttggttcgaggacccgttggtcaaaggaaaggaaaggggaggtccttattccgggacggagccgtatgacgcgagagtctcacgcccgacgagcggtccacggagctgcatccctactcacctggtccatgcacatcgctctctccaggaggttggccgcctatcctagatcttcccattttcaagaggatcccgggctcgatctggaatttccctcttgcttgagtaatgggaagcgggctagtccccgaaaatgcccgttcgcttgtcgttggggatccaaatcttacttgctgaaactgtacttgtag

SEQ ID NO: 32204 - DNA, 269 bp, Glycine max
  Peptide Sequence Number=SeqID_123889
atgatcgaagaaggagatgaagatgcacaaacaataaaggggacctgtcataccctaatttcgtccggggacctttgcttgatgacatgcgacctttctttggtccttgtgaggtgcttggcacccatcattaggcaatttgtgaaattccaggacatgccggaaaaccaaaaaatattgatgcacaatcctcaaaaaggggatgattattgtaatccgcaaggttccgtaacattacggaaagacaacaagtatcgttacgagattcg

SEQ ID NO: 32205 - DNA, 201 bp, Glycine max
  Peptide Sequence Number=SeqID_123890
atgaaggtgttaagggaaggagcccagagtatcaagaacctcatgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 32206 - DNA, 117 bp, Glycine max
  Peptide Sequence Number=SeqID_123891
atgtggaccactacgggggaggtggttgccgcccagctcgcccaggcgagctcagctcgcccaggcgagccaggttgcttcctccagaagcaacagccttctggaggaatattctag

SEQ ID NO: 32207 - DNA, 183 bp, Glycine max
  Peptide Sequence Number=SeqID_123892
atggcggtttccaaactcagaaatgatgcaaaggaaaaccatgaaggtcagatcgggcttcgttctcaaccgaaaccgcgagacaagttggaagattccgctctgattgaaaggttcctctcgttgtggagtttcaatggaagacaacgatggttcgtggtggctaatggtggttatgggtga

SEQ ID NO: 32208 - DNA, 231 bp, Glycine max
  Peptide Sequence Number=SeqID_123893
atggcagcggaatggagaaggaagagagagaggagacgtaacttcaaggagaagatgagtctagaagaagctcaccactataggaggccatggataagagcttggaggaagaaggagatgaatgaagggagaggaagagaagagcacgaaattttgtgctctaaaagagctctgaaatctgaacccactaatccaagatcaattccaagattctctactaagtgtgcttag

SEQ ID NO: 32209 - DNA, 204 bp, Glycine max
  Peptide Sequence Number=SeqID_123894
atgaagttcgatgaccgagctcaaatgatcactcgcagaaactatttgaaagctgatggcagacttgtcgcacgtgcccttttgcgcggcgagcgaaggagttgctcacaggtgcgctttccagaaggaacagatgcccggagtcgccaccaacgtttatttgtggaaaacgttggaaaaatcgaaggaaaccggtcaaaataa

SEQ ID NO: 32210 - DNA, 318 bp, Glycine max
  Peptide Sequence Number=SeqID_123895
atggagaaactagggatcccgagaaagttgatagcatccttgaaatgcaaactcactgcacggttagccaagtcaggtttgaggggctttctttcccacctgggcaagatctcagggcaggcctgtggcaaattgtatgcaatagaggaagagcgggatgggaaaccgtggtacttcgacatcaaacaagtctcgagaacaaagaccccccggcacaatgattctgggaaaaaggagcaagccatctactatctaagcaagaagtttaccgcatgtgagatgaattactcaatgctggaaaggacgtgttgtgctctg

SEQ ID NO: 32211 - DNA, 395 bp, Glycine max
  Peptide Sequence Number=SeqID_123896
gagaagccaagaggtggctccattcatttaagggtaatagtctgaagacctgggaagaagttgttgagaaatttctgaagaaatacttccctgagtcaaagactgcgaaagggaaagctgcaatttcatcatttcgtcagttccctgatgaatccctaagtgaagcattggagaggtttagagggaggaaaataaaactgaaaacccctgaagaagcaatggagttgattgaaaacatgtcttccagtgatcacgccattttacgtgatagagttgtaccatatgtggtggtactcatgaatccggcctttgcattccttttgaagagcaaacgtaagaggttagctacatggggaatcaacaaaggcaaggatacaatcaatgtggattctcag

SEQ ID NO: 32212 - DNA, 336 bp, Glycine max
  Peptide Sequence Number=SeqID_123897
atgacattaacctataaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 32213 - DNA, 507 bp, Glycine max
  Peptide Sequence Number=SeqID_123898
atggggccaaatcaaaccagcaagaggttttaccaagtcaaggtcaaaagcctagataccaccagcatcaaggaattagggcggttgatggaacctctccaaatgcaagccttccgcaagacttacggaaagatctttagagttgaccctagcagagaattgcaactgtggtcaaggattcaacaagaggttggaccgcgtaaaacagactcggaacggcatagcgggcctaggaggtacctagaagacaaggtgaggggtatggccaatcaaggagattgggtcccgtttatggatgtgttagctttgctaatttttggggtcgtcctcttcccaaacgtggatggtttggtggacctagcagcaatcgacgctttccttgcataccaccatagcaaggaaagtccggtggtagctgtcttggcagatttatttgacacgtttgaccgaaggtgcgaaaagagtagcgcacggatcatttgttgcttgcccgccctctgtgtttag

SEQ ID NO: 32214 - DNA, 306 bp, Glycine max
  Peptide Sequence Number=SeqID_123899
atgcacacacaaagtttcacaattccacaatttcctaagataggcctaactcacaaaaacagtcgccaactgtcgcaacctacccttttgcgggcgagcgaggcgaggctcatgggtgcgtcttccaaaggaggaaaatgtgcggagtcgccaccaacgtttatttgtggaaaatgtcggaaaaaaccgaaggaaactggtcatgaagaatattccagattcgggagtgaggtcgacaaaagcggggctcttgctcctacataccctccatcgaagaggaaatcagacctccataggtctttctaa

SEQ ID NO: 32215 - DNA, 288 bp, Glycine max
  Peptide Sequence Number=SeqID_123900
atgatggtggcccgggtgatgttggggtatggctacgagcccgaaatgggtttaggcaagaacaacggcggcaaaaccagcctggtaagcaccagaggaaaccgcaggagatccgacaacgagtccctcgaaggtactaatacccaggacccgaccatcgatttcaagcaagaagcgggtcagacggagagtgaagaggacgaggatgtgggacttcccccagagttggagaagatagtcgctcaggaggaccgagagatggagtctcatcaagaagagatagaacta

SEQ ID NO: 32216 - DNA, 168 bp, Glycine max
  Peptide Sequence Number=SeqID_123901
atgtcgatctccccctgcagaagtatcagttggggtcgcgcccacaagactcccagtggacccgaagaagtccaacagggccctggggtctccagctttggttacgggcctctattagtcctacagggtgcccgtactccccgacaaggtcatgccatcgcgacatat

SEQ ID NO: 32217 - DNA, 429 bp, Glycine max
  Peptide Sequence Number=SeqID_123902
atggggatcgcacccacaaagacacccagtggacccggaaaagtccaacagggccctggggtttccaactctggttacgggcctctatcaatcctacagggtgcccgtacccccccggcaagggatcgcgcttgcaagacacctagtggacccgaagaagtccaacagggtcttggagtgtcaagctctaattacgggtctctgtcagttctacggagtacctgtcactccagcaagggcatcaggcccctactaatcgagctttcatcaagaagtattgcgccccagacaggcgtagggcgaaacaccacagcagcattgggatggtcggcagcgggaaacagacgcaccgccatcacctctagagttcacctctgctcatccacaaaaaggtttgagtattgcctacacaacatggccgaccaatag

SEQ ID NO: 32218 - DNA, 277 bp, Glycine max
  Peptide Sequence Number=SeqID_123903
atgggggtggaaatagcacccaggccacttgggccttccagattattcctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaggaatttcgcaaaggtttcaaccgttcttcgacgttcttcattcgttcttcatcgttcttcgatcttcaacggataa

SEQ ID NO: 32219 - DNA, 462 bp, Glycine max
  Peptide Sequence Number=SeqID_123904
atgttgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaagatggagctggaacgcctgatcaaaagactctcagacagtggcattgatgatggtgaagcagctgaggaagatggtgaagcagctgaggaagaagaagaagcagctgaggaagaggaagatgcagcagaggatactgaatcagatgatgatgattctgaagccccccccatgaccatcagacctttatttttgctttttactcttactagctataggggcatgtccctttga

SEQ ID NO: 32220 - DNA, 291 bp, Glycine max
  Peptide Sequence Number=SeqID_123905
atgtctgaatttgatgctgagagtgaatctgaattcgatattgattacacgtctggtgatgttttacctcttgagattgattttctagagtcagatagaactaaccatgtttcaggaatgattatatctgcctcccttgcagatgagcaagaggagaagctgttatcagttctcaagaagcataagaaggctataggatggacctggcggacattcctggaggtagccaagcttttgcaagatggaatcatttatcctatttccgacaaccaatgggtgagtcctgtccag

SEQ ID NO: 32221 - DNA, 285 bp, Glycine max
  Peptide Sequence Number=SeqID_123906
atggttaaagaattctatgccaacttatatagcccaaaagaccaaagccctaagcaagtgagggtaagaggacatttaatcaggattgatgctgacagcctgaataccttcttagagaccacaatagttttggaggagggtgagacactacctacctattatagatttacgaggatgaggattgatcctcaagagtttgctgcccgtctctacatccctggtagggacatggagtgtcctctcctacaacaacctgactcccacttcccacaggggatcctctag

SEQ ID NO: 32222 - DNA, 108 bp, Glycine max
  Peptide Sequence Number=SeqID_123907
atgagtgagataggaaggaggaggcagcctactggtaatcgattacatgaatactgtaatcgattacaggccatctattctagtgtaatcgattacactaaatggtaa

SEQ ID NO: 32223 - DNA, 177 bp, Glycine max
  Peptide Sequence Number=SeqID_123908
atgtgtgtggaaatggctccgagaaagcttttcacaaagagatctaggaaggacgccgcggccgaagggactagtgcctctcctgagttcgatagccatcgtttcaggagcgctgagcaccagcaacgtttcgaagccatcaagggatggtccttccaccgagagagacgtgtctag

SEQ ID NO: 32224 - DNA, 453 bp, Glycine max
  Peptide Sequence Number=SeqID_123909
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccgtgcatgctcagaacaaacattccttcccaccatatggcttgcctcccaactatacaccacccaatgttgcacacgctcccaatgagaagtcaataactccaatcccatactcattgagagccaacaaccccactttggtcaggtacatgaggcaccccaagaccacaatctag

SEQ ID NO: 32225 - DNA, 732 bp, Glycine max
  Peptide Sequence Number=SeqID_123910
atggccgacgccgtacagcagcgacgggtagccgtcgctcattgcactgacttcttacagggtcagctggttgccgataccgcgctggtaggtgccctgcaccagccacggctcatcggccagcagcttgttgcgcacctggccggcggtcagcgagtaacgcgacacgccttcgcgcagcatctgcggcaccgaaccgaacggcaccttgaattcgcggcggcggccatcggcctcgatcacgctcacttccagatcgccgccgtagcccgtcgggtacaggtcgtcgatgacgaagctgcccggcgacacggtggaggagtagatcagctgctcgttctggcgcacttcgatgcgtgcattggtctcggcgatgccgcgcacgaccggcgcgtagccgcgcagcgaatcgggcagcatgcggtcgtcgctggccaggctggcaccgcggtaaccgatcgagtcgaacagttcaccggtggtgtaggcctcaccgatggtgagcatgccgcgcacctgcgggatgccgcgctgcgcataggtggcgatgctctgccaatggcggccgtcaccctcggtccaggtcaggttggagtcgtggcggaactgccagccacccaggttcatgccggcgttgaggccgaggtaggcactgcggttgcgctggccaccttcgacacggctgtcgctgtcgatggcattgaagctgtagccgacgaagctcggcattga

SEQ ID NO: 32226 - DNA, 228 bp, Glycine max
  Peptide Sequence Number=SeqID_123911
atggcaggggttccgtgggttcgagcgacgacaatgtgggtgtcgagggagcggtttccggcagattttaggcgggaggagaaagagaagatcgatttcaggcaggaggatgacaaagagaagagggagggcaaggttttcgagcgcgcgcggcttgtgaaatctcaatttttattaacttataaacataacaacattggttttttaaggataaccgatgttaactga

SEQ ID NO: 32227 - DNA, 304 bp, Glycine max
  Peptide Sequence Number=SeqID_123912
atggtgaaggaaacatggaacagagatcagcaagttggttgggggggaattgtgcttaaaaataagttgaggaatttaaaatccagcttaaaacagtggagtagagagtttggggatgtcaaaatgaagaaaattcagcagctgagacaacagctaaatgacattgacactattgcctgtgatagaattttgactgaggctgagcttatgtccaagaagtctatacaacatgatctgtggatggcttcaaatgcttatgaatccctattgagacagaaatctagggctaagtggttcaaggaag

SEQ ID NO: 32228 - DNA, 258 bp, Glycine max
  Peptide Sequence Number=SeqID_123913
atggctcaacctccacctcgtgaagatcctcataagcatcttaaggagttccatattgtttgttccaccatgaagccccctgatgtccaagaagatcatatctttctaaaggcttttcctcattctctggagggactggcaaaagtttggctatactaccttgctcccaggtctattttcagctgggatgaccttaagagggtgttcttggagaattcttccctgcatctaggaccactgccatctttcatatcctaa

SEQ ID NO: 32229 - DNA, 243 bp, Glycine max
  Peptide Sequence Number=SeqID_123914
atgtttcacatcccaggtcattcaaagaagtattgccccactgtgtatgctcaggacaagaagaaatcaaatgaacaaaccactaagaaagagctatcattgcatgtcctagggacatgcctatttttcaagagaaggatgaagaaatggaaaatcttgatggttatttcattggaggagactgagctcctcaaccatgatcatcaaggagactttgatgattatttcattggaggaggttga

SEQ ID NO: 32230 - DNA, 348 bp, Glycine max
  Peptide Sequence Number=SeqID_123915
gtgtgcgatatatatccacgcattgaattggctaacggccaaaccaaatacgccaaatacagtgattcaaaaagcattcaaatgcctaagctgcgccgcatttcaatgatgagagtcatgagcaaaatgacggcgacagcaacgaagtctatttcgttgaagcctttgggaagagacggcaccgtaaggcgccatttggtggaggagattccgattgtggtgcctaggtacgtcgtcaagcctctggcgacggtagctgaaggcgccgtcggcaacaggcatgtcgacgacaaactcagtgtagcagaaagcggagaggagggtgcagaagccggtagtggcaattaa

SEQ ID NO: 32231 - DNA, 58 bp, Glycine max
  Peptide Sequence Number=SeqID_123916
gacacactagttgctcatgatcctaggaatttaaataaatcaagcacaagctcgaaag

SEQ ID NO: 32232 - DNA, 324 bp, Glycine max
  Peptide Sequence Number=SeqID_123917
atgccacaggttggcactggcattgcagaaaggttacaaggcagaaagggaaaaacccccttaagaggtctggacgaattcacgagctatggcattccagagaagagtaactggtcccaccaatcacttgccacttccagaagaagcaggttgctatcccctccaagaaaaggaaagaaatttctacttgcggttgaaaagagaacggaagagatgccttggattgcaaacggagacacatgtccagacatgtctgacatcaaggctgcttcaggactgctgaagatgtcagcaagttgggagttgattgctatgagagtctag

SEQ ID NO: 32233 - DNA, 525 bp, Glycine max
  Peptide Sequence Number=SeqID_123918
atgtcccttgccactctatttggaaagttgcaggaacacgagatggaattattgagattacaccaacatgaagaaaatgacaagaaaaagaaaggaattgctcttaaagcatcatcatcaattcaagaagaaagtgatcaggataatgatccagatgatgatgatgatgatctaagtctttttgtaagaagattcaacaagtttcttaaaaaaaagatggaaaaatctgaaaagaaaaatcatagtgaaaagaaactgaagaaagcatacatcacatgggatgaaaatgatatggaatcttctgaagattctgaaaatgaagagataaatctctgccttaaggctaaaagctacgaaagtgatgaagagggtataaatctgataaacaacaaaagtttcataaaaacttttccacttccacacaaaaatgtaattctaattctatcacttgtctttactgtggaagaagaggacatggcatatcaacttgctacttcaagaaaaattacagtaacattaaaatga

SEQ ID NO: 32234 - DNA, 228 bp, Glycine max
  Peptide Sequence Number=SeqID_123919
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggatttgagggtggagaatagacgaacagcgctaagcaatcaattcgtggggctccagactcgatggtggaggacgcatgaaaagcgctag

SEQ ID NO: 32235 - DNA, 879 bp, Glycine max
  Peptide Sequence Number=SeqID_123920
atgaggggagcaccgacggaagaaagcgtgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatggctgaaagttcatatacgagcgaagagaattttgaagcaccggaagaagacgaagaagtccaagctctcaaagcgagttaggaaaggcaaacttgccaaggagaagttcaagttggctgctacacacgttcggaaggagtgcgccgggttacgggaagagaatacaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 32236 - DNA, 225 bp, Glycine max
  Peptide Sequence Number=SeqID_123921
atgggtactccaagtcaaaagcttcgcttacaaaggcagggtcatgcggggaagaacgaaagtgatgaggtacaagccctaaaggcagagcttgaaagagcccgagtagtcgaagagaagttcaagtccatagccatcaaaggcagaatagtagtcaagctccgaagggaagtgtttggaggaaagggcaaaggccttggcaaaatcaaggcgaatgggcttctt

SEQ ID NO: 32237 - DNA, 771 bp, Glycine max
  Peptide Sequence Number=SeqID_123922
atggcaagaaactcagcttctacgatttcggagcgaccacaggactatgatgaagacggcaccgagacgcacgaactgatcgtcatcattcacgggactgggcggacagcggcacagtaccgtgatcactttgcaaattttgcgcgagagaaccgctgcattattctggcgccgctgtttcctgcgggcatcgtcgtgcagggcgatcttgccaactacaagcgcatagagtttcaaggcattcgctttgatcatattctgctgtcgatgatcgacgaagtggccgccaagtatcgtctcaaaagcaatcgcgccatcatgtacggcttttcgggcggcgggcagttctgccagcgctttttcatgctgcatcctcataggctcaaggctgtctctatcggagcaccgggcgtcgtaactctgctcaactctgattatgactggtgggttggcgttcgcgatgttgaagcacgttttggctgccgcattgatcttgaagcgatgaaggcggttacggttcatacagtgatcggtgaggaagataccgcgacttgggaaatcgccatcccgcgtgagagcgccttctggatggacggcgccgatctgcagggcgattgccggatcgaccgcattgaagcactggccaagtcgtttgaagcgcatggcatcgcggttcgcagggacagggtgccgggcgtggctcatgagcctttcaaagtgctggagccggtcgaagcatttttcgcggacgtgctgaggtcacaaagctga

SEQ ID NO: 32238 - DNA, 201 bp, Glycine max
  Peptide Sequence Number=SeqID_123923
atgcctataggtggagctgatattgaggaggaggaaccaacagatttgaggtcaaatcctcttcaagggggaggggatgatgcaatcctccccaggaatggatcagttacaagagccatgagcaagaggctccaagaggattgtgctagagccgctgaagaaggccctatggttctcatgaacctcaggataaatttttga

SEQ ID NO: 32239 - DNA, 251 bp, Glycine max
  Peptide Sequence Number=SeqID_123924
accggagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtgatccgccccgtaagattcacatcatctggtatcagagcttcggctcttgatacagtgggcctcaaacagacaaccgtagcaaaagttatgagcatttga

SEQ ID NO: 32240 - DNA, 540 bp, Glycine max
  Peptide Sequence Number=SeqID_123925
gtcgactctagaggatccccagtgtatattgatagaagctatcgttcaactgcacctggctcctatggtttgttgtctgttggtcaaccaaatgctgcatgtatgcgtgcatctggagctccatcctctgcatgtgagctgagatggactctagggacggtggctgatgtggaggcaatggtggtgcgtctgctgtcggttgttgttactggtcttgccccggctgttgtgcctgcctcggcatgcggacctgttaatggggagcaggatgagctttgtgggcgtgactggtaccccgtagaactggcagaggcctgtgatcaatgctggaaatcccagtgccctattggacttctttgggatagcgtagaccaactggcatttaggaagcgggagattagaattatggtcactgggaaggatgttgctgagcagaagcgtcatacagatctgagtgaaagtggtcatgctagtgcgcatgatccgtacccgcctccctgctatgctctgtgcacaatcatgtcccggggagcacagtag

SEQ ID NO: 32241 - DNA, 123 bp, Glycine max
  Peptide Sequence Number=SeqID_123926
atgggtccaagagagcctaagcccatgtgttgtgccagtgttgttggtgcccaaaaaggatgtgtaagtggcaacctagatgagtcacctcttaggacatctcacaagtttttcagtccttag

SEQ ID NO: 32242 - DNA, 279 bp, Glycine max
  Peptide Sequence Number=SeqID_123927
atggcaggacgtggtagggatcagaaccgtgatgtcctagaccgcatcacagttgtgctggaaactctagtgcaggaacgtgatgtggagccggcaaagtatcgaggactcatggctttccgtaagaaccacccgtcgaagttcagtggggactatgatctagaaggtgctaggttatggttagctaagactgagaagatttttgaggcgatgggttgcctcgaggagcataaggtcccttatgcgacattcatgctccaaggagaagctcagaactag

SEQ ID NO: 32243 - DNA, 462 bp, Glycine max
  Peptide Sequence Number=SeqID_123928
atggaggtgtctattacatatgaaattgcagacactgtggagctcaaccctgataggctacgtgagcttaaagcatttgatgactcaaaagctggtgttaaaggccttgttgatgaaggggtcacaaagatcccaacattgtttcatcatccccgtgatgatggcatccctgtcatgtttccagaggacttcaaagatggggtgcaaaggatttataaacaagataataagctgataacaaatgacagattcaagagcgtagaacatagagtgctggcaaatctcataggtccaagaatattatgtattgcatgctttttcagcgtaggtcttaaatcatcaccgaaactctatggacctataaaagatttattatcagaagacaatcatcccaaatacagagaaaccaccgttgcggaatatgcacgctactgtcaaaagaacaaaggagaaaacacctag

SEQ ID NO: 32244 - DNA, 882 bp, Glycine max
  Peptide Sequence Number=SeqID_123929
atggggatgcagcttgttttcattggcaccatagccttgtgtttggttgtttcctcggctatgcttgagcagtttgaacaagcacctaaacaagatggatcgcttagcttcttggtagtggacaaactagtggccaccgatacagcagagaaaccccaaacagttatagcagaggaggagcagccaatgaatatcgtgcttttccttgctatacaaagtggcatagatgatccagcctttgatgactcattcaccaaaatctacactgcttctagcttgcaaaagcaatggtacagtgttttgggcaaccacgactataggggtaatgttgaggcacggttgagtcctgtcctcacaaatcttgacaagagatggctttgcttgagatcttttactgtaaatgcagaagttgcagagttttactttgtagatactactccgtttgtggacaaatacttcacagaacctaaggacatgtctatatatgattggagtggcatattgcctaggaaacaatacatttccaacctcctcaaggacgtggatttggctttacaacaatcaaatgcaaaatggaagattgtggtgggtcaccatacaattagaagtgccggcttgcacggtaatacggatgagcttgtaaagcagcttctcccaattcttgaggcaaacaacattgatctttacataaatggacaggatcactgcctacaacacataggcagtcttggcaggggtgttgtgaactggtggaagccagaagagatgaagttctactacgatggccaaggattcatgtctgtgaagatcaccgaaactgaaattgacatagtattctatgatgtctatggccatgttctacacaaatggaacgcatcctaa

SEQ ID NO: 32245 - DNA, 303 bp, Glycine max
  Peptide Sequence Number=SeqID_123930
atggaggctttatgtaagcctgcatttcattttccacatcctcctcaaggtaaatattatcttgttaattctggttatcctacttttatggattttctagggccatacaagaaaactagaaatgacaagagtgatggagaatttgattcactagatgaagataacgaatatatagatagtgatgaggatgaaagtgaagttggtcctaatactacaacatgggaagaaccgaatgctcaaagtactctacaaatggaacgattaagagaatcttcaaagaatatgttttcaacacgtatttaa

SEQ ID NO: 32246 - DNA, 336 bp, Glycine max
  Peptide Sequence Number=SeqID_123931
atggcattgggtagaaaaaagagtgtgcaattagcatttttgcttctcctctttttgtgtttggatctgggaatagcgcatcagcatcagggtcattctcattcccattctggtttctgtgcatccgatgcccatcatcactgtggagatgaccatctccatggccatgcgcatgaccatcaccatgacaagattgatggtaggtcgaagcttcttcccgaagagttagcggaggaggaggatatgaaactctatggcttcggtttgccccatcaccatcaccatgatcacggtatcgaggctgcagaactctccggtttagctcgtgggaattag

SEQ ID NO: 32247 - DNA, 1857 bp, Glycine max
  Peptide Sequence Number=SeqID_123932
atgggtagaagcactttggctttggttctcgcgattctgatctcttttcagggaacccacgttagatccgatgcctccgatcaccgttacaaggatggagactccgtccctctttacgccaacaaagttggtccctttcacaaccccagtgaaacgtatcggtactttgacctgccattctgtgtaacagggacagaatactggattgctattgtgttttgtttttacggaatcactagtcgtggaaacgaaccatctggacgaacaaaatgtcatgagaaagaaaagactgaagccctcggtgaggtgttgaatggcgatcgccttgttagtgctccttacgaacttagtttcaagaaggagaaagactctaaggttgtatgcaagagaaagctcacaaaggagcaagttgctcagttccgagaagcagttaagaaggactattatttccagatgtattatgatgatttgccgatctggggatttattgggacgattgacaaggaagggaaaactgaccctagtgagtacaagtattttctttacaagcacattcagtttgatattctgtacaacaaagatcgtgtgattgaaatcagtgcccgaatggatcctcattctgtggtggacctgactgaggataaagatgttgatgttgagttcatgtacactgcaaaatggaaggaaacagatacatcttttgagaagagaatggataaatactctcagtcttcttctttgccacatcacttggagattcactggttctcaatcataaactcctgtgtaacagttcttcttttgactggttttctggcaaccattctcatgcgtgtattgaagaatgactttatgaagtatgctcaagatgaggaagctgctgatgatcaagaggagacaggatggaaatacattcatggtgatgttttccggtttccaaagcacaagtctttcttttcagcagcccttggttctggtactcagttattcacacttacaatcttcatttttatgcttgcactggttggtgtgttttatccatataaccgaggtgctttatttactgcactggtggtcatatatgctctcacatctggcattgctggctacactgctacttccttctatattcaacttgaagggactaattgggttaggaacttattgctgacaggatgcctcttttgtggccccctattccttatgttctgtttccttaacaccgttgccattgcttatagtgcaactgctgccctgccatttggcacaattgtggtgatagtcctaatatggacattggtaacttcaccattgcttgtgttgggtggtattgcaggtaagaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgctagtgtatggggccaccgaatttataccatctacagcatactcttcattgtcttcattattctgttgattgtcactgctttcatcactgtggctttgacgtacttccaacttgctgctgaggatcatgaatggtggtggaggtctttcctttgtggtggatcaactggcttgttcatctacggctattgcttgtattactactatgcacgatcagatatgtctggttttatgcaaacttcgttcttcttcggttacatggcctgcatctgctatggcttcttcctcatgcttggtagtgtaggtttccgtgcctctctgctctttgttcgtcacatatacaggtccatcaagtgcgagtag

SEQ ID NO: 32248 - DNA, 903 bp, Glycine max
  Peptide Sequence Number=SeqID_123933
atgattgatgatgatgcagatatgattgacgatgacggagatgaagatgctgattatgcttttgattacaatgatgatgatatctatgaagatgattattcaagtatgcaggaccaatttgacaatgtggatttgccccctggggtggaggcatcactgccttggttgaaggacatttcttctagtgaatgcaagcaggctattgctttttcccgtacagaatctagttccaaggcaaaagtggatgaaactgatgatatagtcatgcaaaagtttcaacaatttaagcaatttgatactgttgactcttttcctgatcatcactatgataaagagggaactaaagatgcacagaagcctaaaaattgggccaaaaagatccaggaggaatggaaaattttagaggaaaatctgccagagacaatctttgtgagagtttgtgaatcaaggatggagcttctaagggctgttatcattggacctcaaggcaccccataccatgatggtcttttctttttcgattgcctctttccttctacctaccctgcaggtccaccgaaagttcactaccactcaggtggcctgaggctaaatccaaatttatatcaatgtggaaaagtctgccttagtcttttgggcacttggcatggtagaaatagtgaaaactggattccagaaaaatcaaccatgctacaagtgttggtttcaatacaagctctaattctaaatgagaagccttttttcaatgagcctggatatccatcaacatatcctggttctgaggggcaaagaagatctaaggaatacaatgagagtacatttattttatccttgaagacaatgatgtatactctgcgtaaacccccaaaggtatgtagactagaacaatacatgaatctgtaa

SEQ ID NO: 32249 - DNA, 303 bp, Glycine max
  Peptide Sequence Number=SeqID_123934
atggataagcatgaaaataggtgttcacttgagactagtcaaagggcaagtgcacagctcgtctgcgtgcatgccaaggatgttgagtgtgatcggatgttaggatccaacaaggtggatggaagatgtgacagccaagaaggattaggttgtgagtacaccagccaacccactgctgccgaaaccaccagacttgagctcttgagtggaggaggatgcgccagcaaaggtagaatgggtgttgtgccacaactgcagaacatgagtgcaggttgcaagaggatgggagcaattgttagatga

SEQ ID NO: 32250 - DNA, 936 bp, Glycine max
  Peptide Sequence Number=SeqID_123935
atgggtcaaactggaatcccttcacttgggccagtgatgaagataccttcatgcaacaacccagttggctctgggccactgaataagaacacaaaagaggattgcagaattatttctactggaagtgtaggaagtggaaatagattttggcatcttatcaaaggagctactggggggccagtaattaaggggggtctcaattctggaagaagaaagtttgtgaagggaagaaagcaagatggtggcttacaatgggtagcttctccggcggaaggggtgtggagaaacaatggcaaggaaataattatagtcaactcctatgcaccttgcgataggatggctaggaggagggtgtgggaggaattaaaggcaagaaaggacgaaaatgtgggagaaagggaggaattaaacaatttcttggcggacatgcggttggaagatatgtctttggtgggaagaaagttcacttggtataggtcaaatggtggagctaaaagacgaaaacctttcaaagtctttgattgtgggttctcggatacaaggtttagcaagttcgtggaggacacatggagagatctcaagtttgaagtggtagagaggttccaagaggagcttaatcgggtgagggtggtttttgaggaagaggacacatggagatggagggtgaaatcaacatacttagctcttcatggtcgggactttgccaatgagggtgtgatatggcacgacaagtgtgatctcattgttgttatgtgtggatggctctcaacgtggtcacccaatgatccaagatgtgaaatttcattcttggacatggttgagaaacttggaaaatcagtttggctattcctagatgcagtggggttcgaatttgaggtgcatatgttgaaggataagctacatgctggcaatggtcattgcatggccattttataa

SEQ ID NO: 32251 - DNA, 978 bp, Glycine max
  Peptide Sequence Number=SeqID_123936
atggataatgcaacatttcgaagttttcttcaggttcttccccctgttgaatttgcatgcgtctatggatcatctcttcatccatccaaccacgacaagacaaccatgacagattatattcttggcgtgtctgatccaaagcagtggcattctgagaatctgaaattgaacaagcatcactatgcgtcatggatggtgcaccttggtggcgagagcctgattactggagttgctgatagaattggtgtgggagtgcatttcaacccttttgttacttggaatggaaagctgttcaagtatggggttatacaaatgcatgacttacttcaagatgttcagtattgggagaaattctacttgtgtggccggttacagaaaccagttcatattgttgtcgataatttagatgtcaacagcaccaattctgttaacttgagagctgcagtgtcagctgctcttctcctgcttccatcagaattcacagaggaagatctatatgccaaagtatgtagtctctcatacacaggtgatatacgcatgttatttgctgaggataaaaacaaggtgaaaaagattgttactgggcagtttgatctattccactcaatgtataagccatttcttgaagaatatgaggctaagaagttattgagactttcatcaactgccaataatcaaatacatgccactcaggattgtgacttatcagttgcttgtgctctagtttctgctcttcctccatcaatcagaagccagataagcaagaacggagaattaacggaaactggtagattcatacatgatactaaagtcagtgcaagagaagtggctgcaaattgcttgcagagaattctgaggcaaagagtaatggtttcaagtgcaaggcaggccatatctggccttctggctgttggtggggtaaatgctaccaggtatctttctaagaaagttagcaaagcctggagatcatggagatga

SEQ ID NO: 32252 - DNA, 1473 bp, Glycine max
  Peptide Sequence Number=SeqID_123937
atggatctcattcgtgtctttttcactctatgcatcactgtgatacttttgaaccataattttggaaatgtggagggaagataccaccatcatactaagcagaagaaagtttccactgctcctgctgattcttcaactgagccagagaaaccttcagttccacccccttctgattctccaagtgttccttctgacccttcggcatcaccaccttctaattctccaagtgttccttctgacccttatccgaaagataaccaaacttcctcttctgactgtgttttcgatgtgagatcctttggggcagttggagatggctgtgctgatgacacacgtgcattcagggcagcatggaaagcagcatgtgctgtggactccggggttgttcttgctccagaaaactacatctttaagatctcttcaactattttttcaggtccatgcaaaccaggattggtattccaagtggatggaacactaatggcaccagacgggccaaattcgtggccagaagcagatagccgcaatcaatggcttgtattttatcgacttgaccaaatgactcttaatggtacaggaaccatagaagggaatggagacaaatggtgggatctcccctgcaaacctcacaggggtcccagtggaaaaactttgtcagggccatgtggcagtcctgctatgatacggttcttcatgagctccaatttgaaggtgaatgggttgaaaattcaaaacagtcctcagttccacatgatattcaatggctgccaaggagtactgatcgataagctctccatttcttcaccaaaactcagccccaacaccgatggaatccatgtagagaattccaaatatgttgggatatataactccatgataagcaatggtgacgattgcatttcaatcggacccgggtcctcaaacgtggacattgctggtttaacttgtggtcctagccacgggattagcataggaagccttggagtgcacaattcccaggcatgtgtgtccaacttaacagtccgtgacagcatcataagggaatcagacaacgggctcagaatcaagacatggcaaggtggaatgggatcagtgtcaagtctgagattcgaaaacatccagatggagaacgttggaaattgcatcataatagaccaatactactgtatgtcaaaggaatgtctaaaccagacttcagctgtgcatgtgaatgatgtgtcctacagcaacataaagggcacctatgatgtgagaactgctcctattcactttgcttgcagtgacactgttgcctgcacaaacataacactctctgaggttgagcttttgccattcgaaggagcattgctggatgaccctttttgctggaatgcttatgggacacaagagaccttgactatacctccaattaattgcttaagggaaggtgaccctgagacagtgggcgatctttcagaatatcaatgcagttaa

SEQ ID NO: 32253 - DNA, 7453 bp, Glycine max
  Peptide Sequence Number=SeqID_123938
atgtcaagcgtaatcgtattaacattgtgggaagcacaaaccaacgtttcatgccccctccacctgatgaggcaaccattgccactattgttgagatgggcttctcaagggcaagggctgaggaagcattgagaagagttgaaacaaatagtgttgaaatggccatggagtggctgtttagtcatgctgatgatcctgtccaggaggatgatgaacttgcacgggcacttgctctgtccctaggaagtagttctgaatctactaaagctgagagtgctgagaagactatagatgttctaactgaagagggacatgtgaagaaacctccagttgatgatatacttgctgcatctgtaaagttgtttcagagtagtgattcagtgccatttcagttgacagatttgcttgtaacactttgcagtcagagcaagggtgatgatcgtccaaaggataactgtgcattgagtgtgttagcacatatcttggcactgcttctttttgaggatggaagtacacgggaaattgctgctcagaatggcattatatctaccattatagatatcttgacaaacttcaaaggtaggcaggagttggggaaagaactaccagtccctaaatgcattagtgctttactacttatattggatcaaatggtgcagtcaagacccaaagttgaaaatatggaaggaacccagactggttccctgcctgattcttctggggagcaattttctgatacagttttaccaaaggaaaaaaattcaaacgggattgagaaagaacctgcaatggcttttgagaatatactgggaaaatctactggttttgcaactattgatgagagtcataaattgctggatattgcatgtgatttgataaaacagcatgttcctgctgttgtcatgcaggctgttctgcaattatgtgctcggttaacaaaaacacatgctttagctttgcagttccttgaaaatggaggtctggctgctctttttaatcttccaaggacttgccttttccctggctatgactcagttgtgtcagctatagtccggcatctccttgaagatcctcaaacactacaaacagccatggagttggagatacgacaaactttaagtggaaatcgccattcagggcgtgtctctcctcgatcatttttgacatcattggcacctgttatctctagggatcctatggttttcatgaaagctgcagcagcagtttgtcagatagaaacatcagggggaaggactgttgttgtgttgtcaaaggagaaagaaaaagaaaaatcaaaatcatcaagtgttgaggttgggttatcttcaaatgaatgtgtccggatacctgaaatcaagtcacatgatggactggggaaatttttgaaaagccacaaaaaggttcccgttaatctcactcaagtaattgatcagcttcttgagattgtgcttaagtatccacttgtgaaaggtcaggaagattctgagtgtgactcaactttcatggacatagatgaacctaccatgaaggtgaagggtaaatctaaggttgaagaggctgggatattagagcctgaatctgaaaggtctactggactggtgaaggtgacttttgtcctcaagttattgagtgacattcttctaatgtatgggcatgcagtaggtgtcatactcagacgtgactctgaaatgtgtcaattccgtggatctaatcagccatctggacatagtggtattattcatcatgtattacatcggttgttacctctctccgttgataaatctgcaggacctgatgattggagaggtaagttgtctgaaaaggcttcatggtttttggtagttttgtgtggtcgatctggtgaagggcgcaaacgagtgacaaatgaacttgttaaagaattgatgtctttttcacatctggagagcaattcaatgaaaagcagcttactgccagataaaaggctattcacttttgttgatctagtgtattctattttgtcaaaaaattcgtcatctggtagcctacctggttctggatattcacctgatattgcaaaaagcatgatagatggtggaatcattctgtctctaactagtattctgcaagtggttgatttggatcatcctgatgcacccaaaattgtgaatcttatactcaaagggttagaaggtcttacaagagctgctaatgcaagtgagcaaatctttaaatctgatggaactgaaaagaaaagatccgctgttttaaatgatagatctgatgatcaaataacagcaccatctgcagctgaagcagtggcacatgatcagaatgcgggcagtcaagaagcaagcagagatgcaatggataatgcacacaatcaaggaacttctcaaggtgatgatcgtgcggataatccagatcaatcaatggaacatgatattagagtagaagaaggggggacaatggctcaaaaccaaacaatggaacttggaatggacttcatgcgagaagagatgggagagggtggtgtcttgcacaacccagatcaaattgagatgacttttcatgttgagaatagggctgatgatgacatgggtgatgaagatgatgatatgggtggcgatgaggatgaggatgaggatgatgatgagggagaggatgaggatgaggatatagcagaagatggtgggggcatgatgtccttggcagatactgatgtggaggatcatgatgatgttggctttggagatgaatacaatgatgagatgattgacgaagacgatgatgattttcatgagaatcgggtcatagaggtgaggtggagggaagctcttgatggcttggatcacttgcagatacttggccaacctggatttatagatgtggctgctgagccttttgaaggtgttaatgtggatgacctttttcgtcttcagagttttgaacgccgccgtcagactggtaggtcttcctttgagagatctgccacagaagtaaatggttttcaacatcctctccttgttagaccaccaccatctggtgattttgtctcaatgtggtcatcgagtggtaattctgcatcccgagattcagaaaccctgtcatctgggaatcttgatgtggcccatttctacatgtttgatgcacctattcttccatatgatcatgtgccaagtagtctgtttggagaccgtttgggtggtgctgcacctccacctctgacagattattctgtgggtatgggctcattgcatctacctggaagaagagtgttaggtaatggtaggtggactgatgatggtcagccacaaggaagtgctcaagcagctgccattgcacaagcagtagaggaacaattcctagctcaattgtgcagtgtagctcctgctagcagtcctgttgaacgacagttacagaattctggagaacaagagaacaagtctgatgctcttgcatcacatgatggtccaatattgactgcaggaattgactctacttctcagcagattgatagtcaggagcaagaaaatggtaacggaaccagagctcagcaaatcaacgatggtggtctttgtgaggaagagataaatgtagactctggtggtcgagatacagctgaagaactgcaagctaatgagcctatgtcagttcaaccagtttcactgaatatcatgccaaatggttttgattgcacagtgattgaaggaaatgtcactcatgatgagaatgtagctcaggcatttgtcaattcatctattaattctgatgctgctatacaatgtgaaagcggtgctgatgtacctactagcatccacaatgtgccaattgagtccatggaattcaatggatcatcaaatgctgatgggcagcctcctaatattgagttagggggctctggttttgaaactcccaatccaggtgattcccatgcatcgtcaatttatgctagtgctgatgttgatatgggtggtactgatgccgaaggaaatcaatcagagcaaccaactgtttttgaagacgggaggggtgagatgttatcaactcagaacactgaggttgctccagatgctactcaggctgaccaagttagtgcaaataatgaagcttctggtgctaataccattgaccctacctttttggaggctctgcctgaagatctacgggcagaagttctggcatcccaacaagctcagtctgttcaacctccagcttatgcaccaccttctgcagaagatattgatcccgagtttttagctgctcttcctccagatattcaagcagaagttttggcccaacaaagagctcaaatggttgcccagcaggctgaaggacagccagttgacatggataatgcctctataattgctacttttcctgctgaattgcgtgaagaggttcttttgacttcttctgaagctgttctgtcagcactaccatccccattgcttgcagaagctcaaatattgagggatcgagcaatgagtcattatcaagctcggagccttttcgggagcagccacaggcttaacaatcgaagaaatggtcttggatttgaccggcgacctgtgatggatcggggtgttggagttacaattgggaggagatctgctcttacagatagcttgaaggtgaaggagattgaaggtgagccactacttgatggaaatgcattaaaagctttgatccggcttctacgactgtcacagccccttggaaaaggccttctgcagaggctcttgttaaacttatgtgcacatagtgttacaagggccactcttatttatcttttgcttgacatgattaaacctgaagctgaaggctctgtaagcagaccagcgacattaaattcccagaggctttttggttgtcactcaaacacagtttatggtcgatctcaattgttggatggtcttcctcctcttgtgttccgccgaattctggagattctaacttatttggccacaaatcattctgctgttgcaaaattgttgtttcactttgatcaatcaattattccagattcttcatgtccagttaaggtgcatatgaatgagaaagggaaagagaaggttattgaagggagaccatcaccaaattcctctggagctcagacaggggatgttcccctagtgctctttttgaagctcttgaaccgacccctgtttctacgcagcaatgctcatcttgagcaggtcatgggtctgattcaagttgtagttgatactgcagcttcaaaattagaaagtcaatcacagtctgaaaaaggaatggcagatacccaaaatttgtcagccagtgaagccccaagtaatactgagaaggatgctccttcggtggagtcggactctaatcaacaagataagcatgcagatacaaatccatgccattctgaagggaagaagaatgtagatatgtacaatatcttcttgcagttgccacaatctgatttgcgaaatttgtgcagtcttcttggtcgtgaagggctttcggataaaatgtatatgcttgctggtgaggtgctgaagaagttggctttcattgtttcctcccataggaagttctttactttagagctttcagaatcagctcatgcgttgacaggttcagccatcagtgagcttgtcacactccagaaaacaaatatgcttggtttgagtgctggttctatggctggtgcagccattctacgtgtgctgcaagctcttagttcactcacttcacttaatactttgggtgatttggatatggaaaatgatgcggatcagcatgatgatcaagcaactatttggaatttgaatactgcactcgagccattgtggcaagaactgagtaattgtataagtgcagctgagatgcagcttggacagagctctttctctcctaacatgtcaaacataaatgttgccgagaatctgcaaggttcctctacttcaccacctcttcctcctgggacacaaagactcttgcctttcattgaggctttctttgttttgtgtgaaaagctacaagcaaatgaatccttcatgcagcaagaccattgcaatgcaactgccagagaagttaaggagtctgctggttgttcagcttcaacaagtgttaaaattggtggagattcactgcggaaattcgatggtgctatcactttcacaaggtttgctgagaagcatcgccgactgtcaaatgctttcattaggcagaatccaggtttgttggagaaatcactttccatgatgctcaaggcaccaaggctgatagacttcgataacaagagagcctatttccgctcaagaataaggcaacaacatgaccaacacttgtctgggccattgcgtataagtgtaaggcgggcttacattttggaggactcttataatcagctaaggatgcgtcctactcaggatctgaaggggcgattaaatgtgcaatttcaaggtgaagagggtattgatgctggtggtctcaccagagaatggtatcagctgttgtcgagggtcatatttgataaaggtgctttacttttcacaacagtgggcaacaatgcaactttccaaccaaaccctaattcagtataccagactgaacatctctcatacttcaagtttgttggccgagtggtggggaaggctttgtttgatgggcaactgctggatgtttactttactcgatctttctataagcatatacttggtgttaaggttacataccatgatattgaagcggttgatcctgattactataagaatttgaaatggatgcttgaggaaaagactgattgcgggtgtagagagcgagaactatggagcttggtgtacagccttgtcagtgagaatgatgtgagtgatattcctgacctgacatttagcatggatgctgatgaggaaaagcacatactttacgagaagaatgaggtcactgattatgagcttaaacctggaggaaggaacataagggtcacagaagaaacaaagcatgagtatgttgatcttgttgctgaacatcttttgacaaacgccatccgtcctcaaattaattcctttctagaaggttttaatgaattggtaccacgagaacttatatccatatttaatgacaaagagcttgagcttctcataagtggtcttccagaaattgatttggatgacttgaaggccaacaccgagtataccggctatacagtggcatcaaatgttgttcaatggttctgggaggtggtcaaaactttcaacaaagaagacatggcaagattactgcaatttgtgactggaacgtcaaaggttcctttggagggttttaaggccttgcaaggcatctctggtccacaaaggtttcagattcacaaggcatatggagctcctgatcgacttccatcagctcatacttgcttcaatcaacttgaccttcctgagtatacctctaaggaacagcttcaagaacgtttgttacttgccatccatgaggctagtgaagg

SEQ ID NO: 32254 - DNA, 3003 bp, Glycine max
  Peptide Sequence Number=SeqID_123939
atggcgccgagcaccggagacgtgcaactaacttcccccgcctccggcgaagattccgacgacctcgaagacgttcgcctcctcgactcctacgacaaaaacgacgtcgttcacgatgaaacgaaaagaattcaggtcagaatcaccggcatgacctgcgccgcgtgctccaactccgtcgaaacggctctccggtccgttcacggcatcaccgaagcctccgtcgctcttcttcaaaacaaagccgacgtcgttttcgtccccggcctcgtcaaggatgaggatatcaagaatgcgattgaagacgcaggtttcgaggccgagatcttgccggactccggtgcggtggcgcacggcggagccgccgccgccgtggtggggcagttcaccatcggcgggatgacgtgtgcggcatgtgtgaattccattgaaggcattctgaggaacctcaacggagtgaaaagagcagtggtggctctggcaacttcgttgggcgaggttgagtatgatcccaacgtgataagcaaggacgatattgtggctgcgattgaagacgcgggtttcgagggcacgtttgtgcagagcaacgggcaggaccagattgtgttaggggtgagtggcgtgtactctcttggtgatgctcaggttctggaagcgatgctgagtggcaccaaaggggtgaggcagtttcggttcgacacggcggtgaacgagcttgatgtggtgtttgaccctgaagttatcagctcgaggtcgttggttgatgggatccagttggggagtaatggcaggttcaaattgcatgttaggaatccttacgctaggatggcttctaaagatggggttgtattagtctgtacaggaatttcatcgaaaattcctctcttcttcatgggggtgatttgtcctcatataccattggtttactctttattactttggagatgtgggccttttctcatgggtgattggctgaattgggcgttggtgagtgtcattcaatttgtgattgggaaacgcttctatatagcagctggaagagctcttagaaatggttcaacaaacatggatgtcctggttgctttgggaactacagcctcttatgcttattctgtttgtgctcttctgtatggtgcccttacaggattttggtctccaacatactttgaaacaagcgctatgcttataacatttgtattgttgggcaagtatttggagtgccttgccaagggaaagacctctgatgccattaagaagctagtggaacttactcctgcaacagctttattgattgccaaagataaaggtggtagaactgttgaagaaagggaaatagattccttgctcattcaacctggtgacacattaaaagttcttcctggtacaaagattcctgctgatggtattgttacttggggctcaagttatgtaaatgagagtatggtgactggtgaatctatacccgtttcaaaggaggtcaatgcatctgttattggaggtacgatcaatttgcatggcgtccttcacgttcaagccaccaaagtaggatctgatacagttttgagtcagataattagtttggtggagacagcccagatgtccaaagctcccattcaaaagtttgctgattatgttgcaagcatatttgttcctacagttgtggtgttggcattattgacactattgtgttggtatgtagctggggctcttggagcatacccagatgaatggctgccaaaaaatggaaatcactttgtttttgctcttatgttttcaatatctgttgtggtgattgcatgtccatgtgcacttggtttggcaacaccaactgctgtcatggtggcaacaggggttggggccaacaatggtgtgttaattaaaggaggagactccttggaaagggctcagatggtgaagtacgtcatatttgataaaacaggcactctaactcaggcaaaagccactgttactgttgctaaagtgtttggaggaatggaccgtggagattttcttacattggtggcttctgctgaggctagcagtgaacacccactggcaaaagcaatattgcaatacgctcgccattttcatttctttgatgagtcttctcctaccagtgataccaagagtgcttctgaggactacaagtcagggtggctttatgatgtctcagacttctctgctcttccaggaaggggcatccagtgctttatagatgggaggcgtattttgaactattttccagagagttgcttacttgaggcagcatatcctaaacaggttggtaaccggaagctgctggaggaaaatggcataaatatttctacagaagtcgaaaattttgtagtagagcttgaagaaagtgcaaagacagggatactagttgcatatgatgatatattaattggagtcttagggattgcagacccactaaagagagaagctgctgttgttatagagggcctacagaaaatgggagtcatacctgtgatggttacaggagataactggagaacagctcgagctgtagccaaagaggttggcattcaagatgttagggcagaagttatgcctgcaggaaaggctgatgttgttcgttcattccaaaaggatggaagtatagttgcaatggtgggtgatggcatcaatgactctccagcattagctgctgcagatgttggtatggcaattggggctgggacagatgttgcaatagaagctgctaactatgtgctgatgagagataacttggaagatgtgatcactgccattgatctttccaaaaagacctttttccgtattcgattgaattatgtatttgcgatggcttacaatgttgttgctataccagttgctgccggggttttctttccttggttggggatcaagctgccaccatgggttgctggtgcatgcatggctctgtcgtctcaatatgcgagggtacatgtgaatgtgtctctatttgcaaaaccagggcaggaaaatactgagattgagtag

SEQ ID NO: 32255 - DNA, 1485 bp, Glycine max
  Peptide Sequence Number=SeqID_123940
atgggtacgcttcagtcttggagaagagcctacggtgccatcaaggacaccaccaaagtgggtctggcccatgtcaatagcgattacgcggatttggacgttgccattgtcaaagccacgaaccacgtcgagtgtccccccaaagagaggcacctcagaaagattctgtttgccacgtctgctgtgaggcctagggctgatgttgcttactgtatccatgcactttcgcggcggttggcgaagacgcggaattggacgtatgatattgaagctgagcgtctacccaaacctgctgaagggcaggagaaggggtgcagcaagaccagggatttggatagtgaggagctattggagcagttgcctgctttgcagcagctgctgtatcgacttgttggttgtcggccagaaggagcagctgttagcaattatgtgatacaatatgctcttgccctggtactgaaggagagctttaagatttattgtgctattaatgatggcattatcaatcttgttgataagatgcccagacatgaagctattaaagcccttgatgcctataaacgtgcgggtcagcaggcagcaagtctatctgatttctatgatgtttgcaaaggattggaacttgctaggaattttcagtttcctgtcttaagagagcctccacaatcttttcttacaaccatggaagagtacattaaggaggcgccacgagtggttacagttccaactgagccattgcttcagttgacctacagaccagaagaagttcttgcaattgaagatgccaaaccatctgatgaagaacaggagccaccagttcctgttgataataatgttgttgtctctgattctgaatctgcacctccaccaccaccaccatcggctcacaacaattttgaaactggagacttgctgggattgaatgacactgcacctgatgcatcgtccatagaggaaagaaatgctcttgccctagccatagtccccactgaaactggcgctacatcagcttttaactcaactgcttctcaaacaaaagattttgatccaaccggatgggagcttgccctggtcagcactccaagtactgatatttctgcagccaatgagagacaattggctggtggattggactctctcactcttaatagcttatacgatgaagcggcatatagatctgctcaacaaccagtatatggagcaccagccccaaatccatttgaagtgcaggatccatttgctctatcaagcagcatccctcccccacctgctgtccaaatggcagcaatgcaacagcaagcaaatccctttggttcttaccaacaaccatttcagcctcagccacagctgcagcagcagcagcagcttatgttgatgaacccagcaaatccctttggagatgcaggatttggagcatttcctgcctccaatcctgttcctcacccacagaacaacaatccatttggaagcactggcttgttataa

SEQ ID NO: 32256 - DNA, 234 bp, Glycine max
  Peptide Sequence Number=SeqID_123941
atgggtggaatagtgatatacctggagaagggaatgggagcggtgagaagggaggcagtgggggcagatgctaaggcaacagtgcaagcaaaagacgttcttctcgttcttcttgtgattctgatggaccccacaaccaccaaagaatgtctcagccataagcctctcaagccatgcagcaggttctcagtagcatcaacaaaattgacaaatgggatcacaacaagaaattag

SEQ ID NO: 32257 - DNA, 2718 bp, Glycine max
  Peptide Sequence Number=SeqID_123942
atgggttcgagagtagatactgatgaagatagtgataacagaggtagtatgtgggatttggatcagaagcttgaccagcctatggatgaagaggcaggaaggctcagaaatatgtacagagaaaaaaaatcttcagcattgttgcttctgcggctagcatttcagagtcttggtgtggtttatggagacttgggcacttcacccttgtatgttttctacaatacatttcctaatggagtgaaagatgaggaggatgtaattggagcgctttctttgattatctactctcttaccttggtgccactcctcaaatatgtttttgttgtattaagagcaaatgacaatggccaaggtggaacatttgcgctttattccttgctttgccggcatgcaaagataaaaaccattcctaaccagcatcgaaccgatgaagacctaacgacatatagtcggtctaccttccatgaaaaatcttttgctgcaaaaaccaaaagatggttagaggaacaagaatctgcgaaaagagccattcttattcttgtccttgttggcacctgtatggttattggagatgggattcttaccccggctatatctgtttacatgttgctacatccaaagggaggcacaatcgatggcacaagtggcagcatggagtggaggtctggtggttgtgaacaaaggagaggtccggcagtgcaggatgaaaagatttgcaaatgggtagggaacaaagaaagtcacaaatgggtaggaaagggcttcatgaatgagaagaaagggactctggaactgggtcatacagatccaacctggttttttcagcttgctctgccttgccgaggatcgactatctcacaattgcacgtggaagatctcaatcccactctgatcctacccaccggcgatccaggcacgattcagcttgcccgggtgtattcgactcataggatgtacgatcctatgagttatttcaagagattcataaccatatattctgttgtagttttatcagctgttggtggcatcaaggtaaatcagcctcggatgagtagtggtcttgaaaaagcttctttctttctgggatacaggtgtagtagtgctggttgctgtggtataggtatatttaacatctggaagtatggaagcggtgttctaaaagctttttctccggtgtatatatatcgctattttagaagaggaggaaaggaaggatggacttcccttggtgggatcatgctcagcataactgggacagaagctctttttgctgacctagcccattttccagtctcagctgtacagcttgcatttactctagttgtgtttccttgccttcttttagcctattctggtcaagctgcttaccttatgaataacttgacccattcacaagatgctttttatcgttcaattccagatagaatatattggccagtatttattgttgcaacattggcagccgtagttgcaagccaggctacaataactgcaactttttcaattattaagcaagcccttgctcttggatctttccctagagttaaagttgtgtatacatcaaagaaatttcttggccagatatatgttccagatattaattggatccttatgattctttgcattgctgttacggctgggttcgaaaatcaaaaccagattggaaatgcatatggtactgcagttgttatagtcatgctggttacaacgatccttatgattttaatcatgatactagtgtggcgctgccattggattctcgtcctcgtcttcactggcttatcattgattgtggaatgcacatacttctcctcagtactcttcaaagttgatcaaggtgggtgggttccacttgccattgctggagcatttcttattattatgtctgtttggcattacggcaccgtgaaacggtatgagtttgaaatgcatagtaaggtctcaatggcatggattcttggtcttggcccaagtttaggacttgttcgtgtccccggaattggactagtctacacagaacttgcaagtggagtgccccacattttttctcatttcatcaccaacctaccagccattcattccgttgttgtttttgtatgtgtgaagtaccttcctgtctacacagtcccagaagaagaacgattccttgtcaagaggattggacctaagaatttccacatctttcgatgtgtggcacggtatggctataaagatctgcacaagaaagatgatgattttgagaaaaaactctttgagaaccttttcacattcgttcggcttgagtctatgatggaaggatgttcagattcagatgaatacagcttatatggacagaaaatagagcatccaagagatggccttttgcataacaatggaagcacagtttcttccaatatggatttaacaatgtcctcagtagattcaatagtaccagttagatcaccgcatcacatgaatattactgtcaggtcttctggtcaaacaagcagccagaccgaagttgacgaatttgaatttttgaatacctgcagggatgctggggtggttcacatactaggaaacacagttgtgagggcaaggagagaatcaaggttctacaagaaaatagctgttgattatatttatgcatttcttaggaagatatgcagggaaaatagtgtaatcttcaatgtccctcatgagagtctcttaaatgttggccagattttctatgtatag

SEQ ID NO: 32258 - DNA, 1001 bp, Glycine max
  Peptide Sequence Number=SeqID_123943
atggatcgaagagatgcattccattgtcgtgctttgaaaactgaacgtgcacctaccttttcagtggggcagaaatttcaactaaatgatattattgaagctcaacagtttgatcgagatattctcagtgccatttttgaagttgcacaggatatggagaatgttgaaaaggattcgcctgataaccagcttttaaagggttatctaatggctaccctattttatgagccctctactagaactagactttcatttgagtctgccatgagaagactgggtggagaggttttaactactgaaaatgcgagagaattttcatctgcagctaaaggagagacacttgaagatacaatcagaacaattgagggttactctgatataattgtgatgcggcattttgaaagtggtgctgccagaagagctgcagctacatctgacattccaataatcaatgcaggggatggtcctggacaacatccgactcaggcacttttagatgtctatacaattcaaagagagattggaaagattgatggcataaaagttgggcttgtgggagaccttgctaatggcaggactgttcgttcattggcatacttgcttgctaaattcaaggatgtgaaaatttattttgtctctcctgatgtggtaaaaatgaaggatgatataaaagactatttgacatcaaagggagtggagtgggaagaatcttctgatttagtagaagtggcctcagagtgtgatgttgtttatcaaactcgtattcaaaaggaaagatttggcgaaagaatcgacctttatgaaaaggctagaggcaagtacgttgtgaatcagggtattctcaatgtgatgcagagacatgctgtggttatgcaccctcttccaagacttgatgaaatcactgtggatgttgatgctgatccaagggctgcttactttaggcaggccaaatatggtctatatattcggatggctctattgaaactcttgcttgttgggtg

SEQ ID NO: 32259 - DNA, 2817 bp, Glycine max
  Peptide Sequence Number=SeqID_123944
atgtcaggtttctccaaagacatgcctgcagttgatgaggaccaacaagaagacgatgtgcatgcaaatcgtactgatcatgacgaaggtttatgggagaacattcctatgctcatggcatcacccccaccgtcgcccaatgctacagataatcctctgaaggtaacatctaagaagactagacaagctaccaggctaagaagctatcttggggttgtcgcacgggaaaagattcctattgtacacgccacctggaatgatgtgcaggatgatcttaagaagttagtctgggaagatattttgcgtaaacttgacatccctgaaggtgaaaatgccaaaaaaaaggtcatgtcgacagtcgcaagtaaatggaggcaatttaagtctcatttgacttcaaaatttgtgtttgctgacaatgagggccaagcaagtagtgagccgacagtgaagcatggtattgatctagctacttgggcggaatttgcaaaaagccgccaaaccccaaattggcagtacgcaaacgggcgcaggagattcagaaatacaatgattgcccccacgccctatcttgagggggggtatgaactgccagacaaaaagcttgtggacgagaaaacgaagaggcgggaacagctcgcagagttcattgaaaatccttcatcgagcatcgaccccccatcccctgtatcgagacaagaaaagtggaagatggcccgcacaaaccgttatgggaaaatgtcctctacggtagcaaaggaaatagcagacaaaattgattctttagagcaagaagctacgcaaggaagctttgttccacatgcgtcacgtgggtcatcaacttcgtcgccatcaatcacccaagcacaattagctgatatcatcattgggataacggatcaggtgcgaagacgggtcgaagaagaacatcaacagagggaagatgcatggcaaagggaatttgaagcacaacatacatgccagattgagatgatgaagaaagagctacaagcgtcaattaaaattgaggtatctcaaattgcatcacatcaaccagtacccatcgagtcggcactgatacaggtattaggtgcccgagttagcacaaagggaagttgcgctgaacctcaggcacaaggattagctaaagacccttctgatgttggtgtcgaactaatggggttgtatgtagttgatggtgatggtactatgctagtggctatgggaatatcccttatgcagatgacatggttaggtacaagcagaggattgactccagtttatggtttccttgagccccaggcaatacactgtgcaaaggacaaacgtacaaaatgtgaacagtacatcgccaactgggtcaaggaatcacatcgagaagtatacttaggaccttacttgaatcaggcacattggaaacttcttgttttgtgttcacgagacaatattgtactttggttttgttctttacggaaaaagcctgatgttcacattaaggctgctattaacagtactttcgaaggtaaggagaatggacatgcacctcaatggattgaaccaaagtataaatcaaaacatgagggtgacttagtggcaaaatgttacttcgctaaacataagcttgtttgggaagttcttgaaggtgaactaaagaacaaaatggaaatccaatggtcagatatcatggcacttaaggcaaattgtcttgatactggacctagcttattgactgtagtgctcgctagacaacctcttctcttcaaggagactaatcctcagcctagaaagcatacaatatggcaaccaacatcagattttactgaaggagaggcttgcaaacacaggcagcattttttggaatttccacaaggcttgttagccaagcattttgaaaagcttatccagtgtgacacacatcttaatttcttaagccaacaacctgagataatcttggattcacctcattttggtacacgaccagctgcttttgagaaccttgacaatccagaagatcctgatttgcatcttgttaattgtaaaggatctaccacatcttgtttgcaggacataggatcacctcattcatccctgtcaccatcatttaagattgaacacaatgatcttcttggcattgcctcgaataatctaccttgtgaagcacctttccccagttcaggtagtacaagttctgaaactgatttcaagggaccaagaaactgggatcagataaaattgcctagactccggccttctatggcagtgagtgattttatcggccacattgaacattgcctttttgaacaaataacttccggaaatccatccttttgtggtggaagactagagttccaggaaatgctagaggaaattgcacagcatcttctcaatgacaataaggttataacaacttctgatgaaaaatcactcatgacaagggtcaattctctttgttgtcttctacagaaggaccctgcagcattgcagagttcacatgacaaggaaagtgctgatgaaggacctgctgatggaaaaactttaagaatctcatataagaagatgaatcctttttgtgtaccttttgcaacaacaaatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggtggctcagatgctactattataccaattggtatccttttgttactcattctccgtggcttgtgtgaagttatcatgccatga

SEQ ID NO: 32260 - DNA, 905 bp, Glycine max
  Peptide Sequence Number=SeqID_123945
gacattgtctaggtgttggtactaggtatgaagcattagtggtactttcaagaagggagagacaagcaggaataaagccagaccctgagattgatgcaattcatgaaggctatagcattgtcaggtcacaaaaccaattcggtaacagattatgttctcaagcggtaaagttgtgccttggtgacttgttggtcatgggttcgaatccggaaacagcctctttgcatatgcaaggggcgagccctggtgcagcggtaaaattgtgccttggtgacttgttggtcatgggttcgaatccggaaacagtctctttgcatatgcaagggattggacagttccaccacttttcagatatgcaagttcatgaggcaaatgaaggtcaaattgcataccaaggttcacgtgagaatgtgttagagttctttgaacacatgggcttcgagtgtcctgagagaaaaggagttgctgatttcttacaagaaagaccagcaacaatattggacttcaaattgtattatgatgctaagtttggtaggaagaaagtcgcggagaatggagatactgctactgataaagcggtcagcaatggaaattcagtgacagtgaccattgtgtccaatggcaacaaaagggcatcggaaatggctgtttatgagcagtttcgaggcgaggggctgaatcagattcacacaaatggctttgtgccgaccattgtggatgaaaggccgcagaagtctttgcttccaccctttgaatctgcagaaatgcgagctttagcagagagcctaagtagggatatcattcgtggaagtccagatgtgaagtgggaaagcatcaaggggttagagaatgccaaacgtttattaaaagaggctgttgtgatgccgattaagtatcccaagtag

SEQ ID NO: 32261 - DNA, 2805 bp, Glycine max
  Peptide Sequence Number=SeqID_123946
atgatgcaacgggcaaagaagtcaaagaggcaatggatggatgaggtttgtattgaaatggtcgttcattcgctcactcactcgtgcttggtggtgagactatcccaaaccaaaaccaatgttcagaacgtaacaaacaaaagaaaaaacctctggttctccctttgttttctcaattgcccctcctattctcagccttctctgtctctccttcctcttgccatgattggaagtaaagatcgtgttgttgactctgaaggtgaaaactccaggagcaagctctcaaggcacaattttgaggccaacaaggagtacccagatgaaaaaggtgttgaatttctgagagattcaaaagtgggtggtggtggtgttgatggggtttttcactcaaaacccaccaaggttgttgttgttggtggtggtggtggcagcagctcagggtttcaagagttgaccctcagctacctttgtgataacccaaaattcaatcttgctgagaaagagattcctggtaaaagcctgctgaattccttggaaaaaatgagccacaaagggaaagaggttgtgatctgtgagaattcaaatcaagatgggaaatgggtggaaagagattttctcagcctgagtgagccaagggaagattcttcaaagcgatcccttgaggaagttgttgagagggagagtaatagggagaagaagccaaaactggagacacttaacctctctcttgctttgcctgatgtgtcactttccctcactgcctcaaacgccttgcaaaacggtgatcaacaacaaccaattaggaccaaaccttgcaggccatccactactactcacacttcatattccaatgactacactgcagcttctttgtcttactcttattcccaccctttctctcacaatccaagctgttcactcacccgcaattcaactgataattttgattactcagtgagcaaagatgaccaaatttggaactgtggagaggggactaatggctctgtgcatagtaggttcaagccaattggagatgggttggttggtttatccaaccatggtggtgctgctggtggtattagttcctttatgcaaggtaataatagtcagtataaaactactagttcagataaccattcttttttcccttcagagttgcctgcaaggtcaaggtttgaggctcagtcaggggactcaagggggaggaattctaagaatctgagaatcttggaaggcttggatgatgggaaggtaaggaagatttctaggccagagagaattgttagggaaattgtttcagagtctatacctgtcatggcattgacaattcaggagcttactgatgatgtcatagcatcaactaaggaatacttgaggaatctcattgagaagcccgagaagaaagaggaactggtaagcctccagaaccggctcgagagaagatctgaccttactaaggagagtctttcaaagtgccataaagtgcaattagaggttttagtggctgtcaagatggggcttgctagcttcctatctaataaaattcaattgtctgagatggtagaggttttcttgtttaagaggtgtaggaatgtaacctgcaagcatttgcttcctgttgatgattgtgactgcaagatttgctcaggaaacaagggcttttgcagttcttgcatgtgtcctgtctgtttgaactttgattgtgcaagcaacacttgtagttggattggatgtgatgtttgttcacattggtgccatgctacttgtggtattcagaagaatcttatcaagcctgggcctagcttgaaggggccttcagggacctcagagatgcagtttcattgtattggctgtggacatgcctcggaaatgtttggttttgttaaggacgtgtttgtgtgttgtgctaaggattggggtcttgaaaccttgatgaaagagcttgactgtgtaaggaagatcttcaggggaagtgaagattgcaaagggaaggaattgcatgttaagactgatgacatgctattaaagcttcaaactaaaatgatatctcctttggatgcctgcaattacatcatgcagttcttcagctatattttcatcttagcattggcattttgcactgaagtacttcatgagataggaagcaatggaatgccattagttcttgagaattgcagtggtgggagaaactggaaagatgcgtatataactgttacttatgcagacagcatgtcagactttcatacttctggtatttcttcaaaggatttgccagcctctcaatctaaccttacaaaggatacaccatctctttcaaaacctaattctctattaccagaatatggttatgacatgggctattctaggtcacatcctgatgccatgtcaagtgatctacttcagaaagacctcaaagcttccatcttaagtgaactgaaaaatgaggctgatttccatttgggggctttattaaggaaaggtggacttgaaagtttggagagcattgtgaggataaaggaggcagaagccagaatgttccaaaccaaggcagatgaagcaagaagagaggcagaagggttccagaggatgatcaggacgaagactgcgcagatggaagaagagtacgccgaaaagctttccaaactctgcttgcatgagaccgaggaaacgcagaggaagaaattggatgaactgaaagtcttggaaaattcctattttgattactataaaatgaaaaagagaatgcaagatgagattgatggtttattgcggagaatggaggcaacaaagcagcaatgggtttaa

SEQ ID NO: 32262 - DNA, 351 bp, Glycine max
  Peptide Sequence Number=SeqID_123947
atgaagtactggagtagctctggagtgctcggttcctctgctatctcgagagaagcagcagcttcctgtcccacctatgtctcacctgcctcctcctctaccatgaatggctctggaatggtggcctctggccaggctacactctttagaaactgctcaacggaaggaatggatcttgtaggcgccaccacctgggctgctgaagtggatgttggagtaggagctgcaaatgtggaagggagctcgatccttaggattccaacagctcttcctgatgtaggccaagttaatgatcgggctcaggcgctcaaaagtaaggctgttagagacaacccctctagctctacatag

SEQ ID NO: 32263 - DNA, 561 bp, Glycine max
  Peptide Sequence Number=SeqID_123948
atgatacgcggagatccttacggtatcgcacccttttgtcatccagaggccgcgggcccgatgacaagcagagaccaagtttggtcattctgcacccttgtatcatccagaggcggcggcccgatgatacgcggagataccttacggttatccgcacccttttgtcatccagaggcggcgggcccgatgacaagcagagaccaagtttggtcattctgcacccttgtatcatcagaggcggcgggcccgatgatacgcggagataccttacggttatccgcacccttttgtcatccagaggcggcgggcccgatgacaagcagagaccaagtttggtcattctgcacccttaggcggcagggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaatttggtcattctgcacccttgtatcatccagaggcggcgggcccgatga

SEQ ID NO: 32264 - DNA, 924 bp, Glycine max
  Peptide Sequence Number=SeqID_123949
atggagttcttctctaatgagaattttgaatgcttccaagcatttgaaaactccaatcttattccattcatgtctctgaaattacctgtctattctgagttagttaaagctttttattcaaatttagaaattcatgaagatgttctaatgtctgaaatctatgggattaagatggtcattgaccaatccctattctatgatttaacaaaattgcctagtgaaggtgtgccttttgaggctgcactgattgatgaatggaaattcgatttctctgtgcatgatgcccgccggttggtttgcaccaaccaagcggatatgaccggaagacttcttgtcggttcattggcttttgaaagccgcatcctccattaccttatagttcacattttgcttcctagatcttcaaacctttctcaggtttctgaagaagatctcattgtcatgtgggcctttcataaaggtttacaaattgattggtcacatcttgttagatatcgcatgcataaggcattgcgattgaatgccccattgccttatcctcaccttgttaccctcttccttcaacatttcaacatccctcttgattctgaaccttatgttccaatcaagagatcattccttataggcgcttcagtcatagcatcctttggttatattaaggagcatgatggatcatgggtaaagaagggtgctagaaatattggtgaagaaggacatgagggaaaagattcatctcttctttcgaagattttggaaaggtttgatggtcttcaaacctttgttggtgagaggtttgatactttggaactgcaagtggatatgcgcttcaatgaaatggagtcaagaatgactaagtttgaagaagatgtatcttacattcggtcaagctttgatcttccaccaccgccgccaccatcatcttag

SEQ ID NO: 32265 - DNA, 1089 bp, Glycine max
  Peptide Sequence Number=SeqID_123950
atggctacctcaccaaaagaaacttcatctcctggttcaccctctgtaccatcatctccatcatccaccaaagcaccttcaaaccaggaacaacctgaattcaatatccaacccatacaaatgattcctggtcaagcccctattcctgagaaactggtccccaaaagacaacagggagtgaagatttctgaaaaccctagccttgcaacaagtcctagggaagtagacacggagatggataagaagatccgcagtattatgttccaacatcttccaccccaaatgctgaagtcctctcttcatccagtaaagaggaatcaacagagaagaggatcaagccacagaggagaccctgcaccaagggcaccagaacctgctccaggtgacttcattgacctagaagaagtagaatctgatgaggaaccaattgccaaaaagttggcacctgccattgcagaaagattacaaagcagaaagggaaaaactcccattactaggtctggacgaatcaaaactactgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctaaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaa

SEQ ID NO: 32266 - DNA, 653 bp, Glycine max
  Peptide Sequence Number=SeqID_123951
gactacacatcctcaccttcagaggactacacgtcctcaccttcagaggactacacgtcctcgccttcaaagggctgtacaccctcaccttcagagggctgcaagtcctcgccttcaaagggctacatgccctcgccttgagagggctgcaagtcctcaccttcagagggctacaagccctcgccttcagaggactacacgtcctcgccttcagaggactatacgtcctcgccttcactagactacatgtccttgccttcagaggactacatgtcctggcctttagagggctacacgccctcaccttcaaaggactacacgtccttgccttcagagggctacacgtgctcaccttcagagggctacacgccctcgcctttagagggctatacgccctcgctttcagaggactacacgtccttgccttcactagactacatgtccttgccttcagaggactacacgtcctcgccttcagagggctacatgccctctcctttagaggactacacgtcctcgccttcaaagggctacacgtcctcacattcagagggctacacgccctcgccttcagaggactgcacgtccttatcttcagagggctacacgtcctcaccttcagagggctacatgccctcgccttcagaggatag

SEQ ID NO: 32267 - DNA, 744 bp, Glycine max
  Peptide Sequence Number=SeqID_123952
atgtcctcgcctttagaggactataggtcttcgcctttagaggactacacgtcctcacctttagaatgctacaggccctcgccttcagaggactatacgtcctcgccttcatatggatgtacgcaaacgtttagaggactagacatcctcgccctcagagggcttcgtgtcctcctattcagaggaccccatgtcctcgccatcagagggctgcatactctcaccttcagaggactaaacgtcatcaccttcagaggactacatgtcctcaccttcagaggacgacacgtcctccccttaagaggaccacatgtcctcaccatcagagggttgcacgcccttgccttcagaggactacacgtcctcagcttcagagcactacacctcctcccctataaaggactatacgtcctcgccttcagagtaatggaagttctcaccatcagaggactatatgtcctcgccttcagaggactacacgtcctcaccattagaggacgacacgtgctcaccatcagagggttccacgccctcgccttcagaggactacccgtcctcaccttcagaggactacacgtcctcttattcagaggactacacgtcctattattcagaggactacacaccctcgccttcagaggaatggacattttcaccttcagagggctacacgccctcaccttcagaggactacatgtcctcgccttcagaggacttcatgtcctcaccatcaaaggacaacac

SEQ ID NO: 32268 - DNA, 225 bp, Glycine max
  Peptide Sequence Number=SeqID_123953
atggggactaccacagcaaatagggaggagcttgccacccagctcgccaggctagccaggttgcttcctccagaagcagctgccttctggaggaagaatctggaaggcccaagtgggcctgctttcaaagagttacagaaactcacggattgcgtaacaacgcttccttttgatttccgtcacgttacgaaatttcacggattgcgtaacaacgcttccttttga

SEQ ID NO: 32269 - DNA, 387 bp, Glycine max
  Peptide Sequence Number=SeqID_123954
atggagaggagtatgattgatgctgccagtgctggagctcttggtgatatgacccctactgaagctaggaatttgattgagaagatggcttccaactcccaacaattcagtgcaagaaatgatgctattgttcttagaggagtccgtgaggtggccacggattcatcttcatctactgaaaataaaaagcttgaaggaaaacttgatgccttggtcaacctagtaactcagcttgccatgaatcagaaatctacacttgttgcaagagtctgtggtctatgttcttctgcaaatcaccatacagctctttgtccttctctgcagcaatctggagtcaatgaacaacgtcaagcttatgctgcaaacatttataatagacctccttag

SEQ ID NO: 32270 - DNA, 174 bp, Glycine max
  Peptide Sequence Number=SeqID_123955
atgaagaaaatcttggagaaaactgtagcttcctcaagaaaagattggtcaagcaagatgaaatccaaatggtctggacctttcatcatcaaagatgtcaagccctacggggctgtggaattatttgatcctcaattagaaaatctagacagaccatgggtagtaaatggttag

SEQ ID NO: 32271 - DNA, 399 bp, Glycine max
  Peptide Sequence Number=SeqID_123956
atggagtgcctagaggaagtttgggagacccccgaaggcaatgagaggtgccgatttcgtggcacaattcaactcactgctacttcattagtacatccggaggaacccgcacgcacgcttcagcagcctgtggagtggatactacctaatcctactccatatcgactagtggagccagttcaagtgatagaggtgtcatcctctaaagaggatcctgaagaggacccagaggagttacctcctgaacctgttgtggatgcccttgactttccagaggatgatgaggacccactccctgatgtggattcttcagaggatatcatgtcagcatctgaggcagactctacagatgagagcggccctggagggacagcgaatagtgaagactcttcatcctag

SEQ ID NO: 32272 - DNA, 432 bp, Glycine max
  Peptide Sequence Number=SeqID_123957
atgacggtgaaaacctctgacacatgcagctcccggagacggtcacagcttgtctgtaagcggatgccgggtgagcgacaagcccgcattgggaggcaggggtttgctaggatggtccacacaaaatacgagccggaagcatcaaagtgtaaacgccatggtcgccattcgagtgacgcaactgacattgaattggcgatcggtgcggcctcactgcgctattacgccagtcggcgaaacctgggggatcgtgccaaggctgcattaagtgaatcggtccaacgccggggaggcgtgctcaagctgactcgcatgcctcaggtcgactctagaggctgcggggagcggatcgcatcggaaggagggtcgttcgctccaagctgggctgtgtgcacgaaccccccgttcagcccgaccgctgcgccttatccg

SEQ ID NO: 32273 - DNA, 438 bp, Glycine max
  Peptide Sequence Number=SeqID_123958
aatcatggcaacaccaccagcatcccctcgcagtccaatcagcagtcagaggcgatgtctaggaatactagacgattgacacggcttaggatgttgactagaagaaccttggatcagccgcgacctattgtcaccgttgatgctgcaactggttggaaggatgtaccggacacactaaaggagctagtatggaatgagattttggccaagtttgatatcccagaagccctagatgcaaagaaaaaggtgatgtcaactatggccactagatggaggcagtttaaatcatccctgacaagtaaatttgtgtttagtatttctgaggaccaacataaagaagatccttctgtcagatatggctttgatgcacagatatgggaggaatttgcgacaacccgcaaaacccctagttggcagggaattaggaagaagatgtag

SEQ ID NO: 32274 - DNA, 210 bp, Glycine max
  Peptide Sequence Number=SeqID_123959
atggacgggggggattcttatttgtacaaatacttgcgaactcgaacgatatttctgactccggatacgcctcaaggccttttctctattgatgatagtgacgatattgatgatagttacgatagtgacgatatcgaccgtgaccttgatatggagctggagcttctaactatgatgaatacgctaactatggatatgatgccagaatag

SEQ ID NO: 32275 - DNA, 274 bp, Glycine max
  Peptide Sequence Number=SeqID_123960
ccccacgaattcattgcctagcgctgttcgccaattctccattctcaatcttattcggagacccatgaattcattgcctagcgctgttcatgtgtcctccaccatcgagtctggagccccgcgaattcattgcctagcgctgttcgccaattctccattctccacttttattcggagacccatgaattcattgcctagcgctgttcatgagacccatgaattcgattgcctagcgctgtacatgtgtcctccgttatcaagcgcggaacctccg

SEQ ID NO: 32276 - DNA, 765 bp, Glycine max
  Peptide Sequence Number=SeqID_123961
atgtccaaccttggctccaaagaggactccttcccaagtagaaaatacaccattgagacacagtttgtgtgggagccttacccatcaaccgttttatcattgttgcctcccgtttgtttagtcggaagtctcgcgtggtacgcggtggtgccactaatttgtttccaagttattgagtggcaccaaccggacagagtcttgagacaatttgggatgcagcaaccagttccagagtctccttcacaacccctaaacattcatggcataacattaaaggggaaacatgacaaaaattgggggcaattgttcgccccaatgattcagcagtggaataatcgccatgcatttagggtcgacgcttatccccgacaagaaggcctattgagttttaactcggactacatgggtgaagttgcggaggcattacaatacatggtgtctcctgaagggaggaatacatgcacatttgatgatcccgtgccttatgtggaaaaaattacaattttatccgaagagcaagagagagtcactaagccagtgtcacatggtcccgcatcagagcgtcaattttccgcacaacagtttcacatgcttcagtcaagtattgaaactcaggggatagacagaagaagggacactgttgaagcggaagaatattcccaacaaatggcggagcgtggccatggaatgtattacacgccacaaacatttgctcagtatccgacacagatgtatcagtatccttttcaagggtcatcacactga

SEQ ID NO: 32277 - DNA, 444 bp, Glycine max
  Peptide Sequence Number=SeqID_123962
atggctaggcttagtgggcacttgccaggccagctaagtgaactgtgtctcgctaagcgcataatggcatcaagaaaaagggctagaactgatgacatcccttcatcatccatcccagctcctcagtcagcagccataggaccagatgtagcctggcctgaagctcaacttccattggtaagacccaatgaggctgctcctcctgagcccgcaccggcatgggttgaaccaataccagctgagccacgatctccagtggtgaatccacctccttctcctgagcttgaagtagttcccccatctccacctctgattatcatatctgatgcatcatcggatgaaactgctgcccctcccgattcaccaattggagaaatagttgatcctcctgtttccccagttggaggattgccgatctttctgattcatcatctggaagaagct

SEQ ID NO: 32278 - DNA, 165 bp, Glycine max
  Peptide Sequence Number=SeqID_123963
atgtctctcaatcaagttcctgtgaaaagaaagaaagcagaatggtgtgataaaaatactgaggttatgttgaaagtgtgcatagaagagggaaggacacaggtcttggctgggatgggagaagaaaccattgcagctagtgatgaatgtgagaagccaaatcag

SEQ ID NO: 32279 - DNA, 237 bp, Glycine max
  Peptide Sequence Number=SeqID_123964
atggctggtacattcttccttttgaaaaagcaaaatagtttagagattatgagcggtgatgtagctccatgtggagcttgtaggccttggatcttcttcatcaatagagtcctttgcttcttgaagatcatggcagtggaatggagaaggaagaaagatgattggagatgccacttcaaggagcagatgagtcaagaagaagctcaccaccataggaagccatggataagagcttga

SEQ ID NO: 32280 - DNA, 87 bp, Glycine max
  Peptide Sequence Number=SeqID_123965
ttctagttaaccggagtgcttctagcactgcttttcctaagacagcgtgtctaaccaaatatttcgccgtatgtgcggctttctcca

SEQ ID NO: 32281 - DNA, 378 bp, Glycine max
  Peptide Sequence Number=SeqID_123966
atggcctctggttttcatgtgcagaagctgtgtaactcgagtttgggcattggtaatcgattacatactttgtacatacggaggaacccgcacgcacgcttcacagcctgtggagtggatactacctacacctactcatatcgactagtggtgccagttcaggtgatagaggtgtcatcctctgaagaagaccctgaagaggacccagaggagttacctcctgaacctactgtggatgaccttgacttacctgaggatgatgaagacccactccccgatgtggattctccacaggatatcatgtcagcatctgatgcagactctatagaggagagcggccctggagggacagcgaatagtgaagactcttcatcatag

SEQ ID NO: 32282 - DNA, 234 bp, Glycine max
  Peptide Sequence Number=SeqID_123967
atgttacggaacctcacgaattgtgcaacgatgcttccttttgagttccggcatgtcgcagacttcatgaattgtgcaacgatgcttccttttgagttctggcatgtcacagaacttcacaaattgcctgacgatgggtgccaaaggaaaaacttatcagaatttaatagtaataatagaacctcaaagagagttgtgcttgatcatcaagagaaaacaacgctggagacttag

SEQ ID NO: 32283 - DNA, 505 bp, Glycine max
  Peptide Sequence Number=SeqID_123968
ggtacatctacttggggattgttatactgagaacaagagagggtgcatctcttgtggatcagttcaagtggagggtacatccacttggttattcaaagagaacaaggtaggggacatcccttatggatctttggcttgtaaaggattttacaaggttgaaagaaatctcaagaactgcagtgtatatgcctatatgttcttggtagaagtaggaatagtgggggcaagatctgcgggtcagattttcctcacttatgtggctgagtatgggtcacaatcaaaagagaaagtgggcccttcttgctccactcaaatggagacatcccccacacttttcagacagctctctctctccctcacgttgccattttcttcttcttcattctccattgaagctccaagcaaagcttcaacctttggccatcatttctgtccaaaatcgcgaaaggatggcattttcggggtcgtgaagtgcgtgtctacgagtgggacttcgaaaattcag

SEQ ID NO: 32284 - DNA, 424 bp, Glycine max
  Peptide Sequence Number=SeqID_123969
tccctgttgctgcttctagtgtgcatgccttattagaagagaaaaacaaacttatcagcgaagtggagaattctagggatgaagatcaaaatagtaaaaaggcaatggagagcttagcttctgcattacatgaagtatctgcagaagctacagaaaccaaagaaaatctactacacatccaacctgaaagtgaaagctatgatgcccagattgaagacttaaagttagtcttaaaagatactaatgaaaaatacaactccatgcttgatgaggctgagtgggagcagagagaggttcaactagtcagctgcataaagaaaaatgaagaagagaagtgtcgcaacctacccttcggcgggagggcgacgcgtgactcgcgggatgcgtgttccacgaaaggaatacgcgcggagtcgccaccaac

SEQ ID NO: 32285 - DNA, 288 bp, Glycine max
  Peptide Sequence Number=SeqID_123970
atgcaattctgcacaggattggagctgcaagacttgggttcccaccagattcatacttccacagaatttgccacagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgagaagaacgagaagcagctgaagaagagaagaagctgctga

SEQ ID NO: 32286 - DNA, 351 bp, Glycine max
  Peptide Sequence Number=SeqID_123971
atgactcaagagctggtagcccgcggagacaccttacggttatccgcacctcgtcattcagtgaccccaagtgtgattgacgagcagaggccaatatggtcatctgcgccctttccggagatgtcagcattttccgatggagacttttcaagtctcacaagttatctagaactacgtcatgtgacatgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 32287 - DNA, 264 bp, Glycine max
  Peptide Sequence Number=SeqID_123972
atgtgtgttcaggaagaagaaaggcttgtaatggagatgggtgagagtgcactactgactactgcttatgggaagaacaaagcaattaagtctcaagcttatcagaaggggaatggtaaaataccacctcaagctgatattaagaaggtggcaaagtgtttcttttgcaagaagaagggacacatgaaaaagaattgccccggattccagaaatggcttgagaagaaagggtatgcaaaacctaaggaaaccagtgggaagtga

SEQ ID NO: 32288 - DNA, 669 bp, Glycine max
  Peptide Sequence Number=SeqID_123973
atggtcatttctccgggaacgacatgtccagctcagggacgacgaatataccgacttccaggaggagatagttcgccggcggtgggcatcgctggttacccccatggccaagtcgacccagacatagtcctcgagtttatgctaatgattggcctacagaggaggtgtacgagatatgcgatcctgggtgaggggtcagtggacccattcgatgcggatgctctcaaccagttcctgggatatcctttagtgctggaggagggccaggagtgcgagtatggccagaggaggaaccgggccgatgggtttgatgaggaggccatcgcccaattgctgtgtatactggggcaggattttgcccggactgttgctggaagacgggcgaggatcatgcgcaccaacatgaccaccctgacccagatctggatgactttgctgctcagcaacatccagcccagcgatcataattccgacctccccctgccgaagtgtatagcgcctaccaggcactctctggacccggataagtccaacagggccctgggatttcccgctttgatcacaggactctgccagtcgttcggggtccccgtcgtacctagcaaggtgattcggccgcccatcagccgagcttttgttgagaagtattgcacgcagagacaggcctag

SEQ ID NO: 32289 - DNA, 303 bp, Glycine max
  Peptide Sequence Number=SeqID_123974
atgacgcgtggtggtaacccagtgtcgttgaatcacaacatcggttttatgaccgtctttgaaggatggcttttctacatcggttgtctagctacaaccgatgtagaatgggtaggtttctacagcggttctaaggctgaaaccgatgttgaatgggtaggtttctacatcggttatcagtcaaccgatatagaaaatgaaagaatgggcactaatggaaaggtttctacatcggtcttcaatcaaccgatgtataatttgaagagtttttacatcgtttatcgcctaaccgatgtagaatga

SEQ ID NO: 32290 - DNA, 633 bp, Glycine max
  Peptide Sequence Number=SeqID_123975
atgaaagataagagggatgaggaagaaaaactagaaaaccaaaagaaaaagaaggatagaaaggccttgtcttcaaaggccaaggggaaggaaaaagaggaaaaagattcctctaagaagattgttaagaaggaaaatcattttgcaataaaatgtgatatcaaaagagaactccttcttaaacaatatttctaccttctcctatcaagggaaacatcccttagcaccaccatacctcttgagcttgaggttattcctcaagtaaaggagttgttggatgagggtttggttcgtaagagcttaaatccttgtgctttgttggttcccaaaaaaagtattatgaggcaccaaatccctatgataggtggtatgatgaatgtgttgagtggtgcaaccctcttttgcaaaatcactcatgcacccaacatcttcatgatgtgtgtacatagggacctcattagtgatcaagggcttcccatgaaccctaagagagtaaaggtcattcttgagtggcttactccaccaagtgttgaggaaagaattaatgagtttcaagaacctcgggatttgacgtcaaatccttttcaagggggagggaatgatgcaatcctaccctccaagggcattggatag

SEQ ID NO: 32291 - DNA, 237 bp, Glycine max
  misc_feature (93)..(93): n is a, c, g, or t
  Peptide Sequence Number=SeqID_123976
atggaggaggcacctacaagagctcccgacgatgcagagaaggcccacatggatgaaggagatgacagacttgctcggcttcttgggaggaancggagccacgtgaccgaggtcaccgcattttttgacattactgaaatttttgacgttatggctctcagttatttcgtcactgttttgcgacataccatttttgtgcgtttctcattcaccttgtggttagacgtaagtaggtag

SEQ ID NO: 32292 - DNA, 291 bp, Glycine max
  Peptide Sequence Number=SeqID_123977
gtcgactctagaggatccccggttcgccagcaggcggccaaccaccgggcacatgtacagacccatgattgtctgtaccagctgagcctcaacatgcagagtcagggcttcgcttctttttcatgccctactccagaccagttcagggcggaggtcgcatggcccggggattggcccgaggcccaagcaggagaggcgcccccagaggctcccggcgatggagaggaggcccacgaggacgaggagatggccgatttgcttgacttcttgggagggagtggagctacatga

SEQ ID NO: 32293 - DNA, 662 bp, Glycine max
  Peptide Sequence Number=SeqID_123978
gatccctgatcctactcacattaggcctagtgctcaggtggtttggccaatagtgggccaagaaatattgaatggtgatgtagggggaggagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaag

SEQ ID NO: 32294 - DNA, 49 bp, Glycine max
  Peptide Sequence Number=SeqID_123979
atggagcttacatcacctagtgagtttaagatacataggaaggttgaaa

SEQ ID NO: 32295 - DNA, 513 bp, Glycine max
  Peptide Sequence Number=SeqID_123980
gtcgactctagaggatccccgatcggtgtgcgcgtatccgtcgccgaggacggtgaggtgctgacccagtcgaacacgaacctggacggatattgggatcagccgcaggctaccgcggaggcattggcgggcaattggtttcataccggtgatcgcggatcggtggacgacggatacctgaccatctcggaccgcaaaaaggacatcatcattaccggtggggagaatgtcacctccatcgaggtggaggacgcactgatatcgcatcccgacgtgcgcgaggccgccgtggtcggtgttcccgacgagaaatggggcgagttggtgaccgcggtagtggtggtcgtcacgctggacgatccgccatcgggcgccgatctgatagcgcactgccgggacagactcgcgggatacaaatgcccgaaacgcgtcgagttcgtcgactccctgcccagaacggccaccgggaaagtccagaagttcaggcttcgagagcagctcgcgcgagactag

SEQ ID NO: 32296 - DNA, 309 bp, Glycine max
  Peptide Sequence Number=SeqID_123981
atgaaggatgagtcatctgaggccaccatcccagagccatttgttataagagaagaggcagaggagacacaggggagacaagtaactgctgccacacctgagcgatcccttgaggctactttagagccttctgcacaaggggaggatataccttcacctcagcatgcagcagacccctccactcctcttctagagatgccagaggacccgactacatcagtcctggctatggacacttctcctctagctactccagtattgcatctaatagatgaagaggatgttcagactttggacacccatgactag

SEQ ID NO: 32297 - DNA, 267 bp, Glycine max
  Peptide Sequence Number=SeqID_123982
atggagatgcagcggaagacaaataagaagagctccattggagcttgtaggcctaggatcttcttcatcaatggattcctttgcttcttggaagatgaatggcagcggaatgaagaaaggaagagagagaggagacaccacttcaaggagaagatgagtctagaagaagctcaccaccatatgaggccatggataagagcttggaggaagaaggagatgaatgaagggagaggaagaaaagagcacgaaattttgtgctctaaatga

SEQ ID NO: 32298 - DNA, 213 bp, Glycine max
  Peptide Sequence Number=SeqID_123983
atgtgcaacctccgtaagacgaacgcactccctcttcttcgcctcaacgagatgactcctcagccctcatgcatgaagttctttcggagttacgaggcctccacacctatgttggaattacattgtcatcatcaaaaagggggagattgtagaagccagactttgatgatgcctgtaacgacccacctcgtcgctacggtatccacactctaa

SEQ ID NO: 32299 - DNA, 263 bp, Glycine max
  Peptide Sequence Number=SeqID_123984
gaaaaccccaaggagttgcgggtttttttctaccaattggggccctcccttcaccacccccatgcggatggtctacggggttcataactactcctcttactacaggacgcttacctagccaacatttagatccggctctacctaaatttttctggtttactccaacatttcccacttgtccgactgttgccgagcagtttttggatatcaaacggacctccccagaagatggatcttatgataatctatatatctatagatag

SEQ ID NO: 32300 - DNA, 249 bp, Glycine max
  Peptide Sequence Number=SeqID_123985
atggtaattgattaccagcaatttattcaaattttaaagcctgtgatctattacacaagtcttgtaaggtcgatctaccagaggagattttcagaaaataatttccatgaggagtcaatctatggttcaaatggatttttagaaggcatcaaaggtgcacttgcgaaacacgaatttaaagagagttgtgacaaatttgagagtggaaaatgctcaagtggactttatatgaggaacaatggacagtag

SEQ ID NO: 32301 - DNA, 348 bp, Glycine max
  Peptide Sequence Number=SeqID_123986
atgggtcccaagggtgtggcttttctcctctccctcaacctccttttcttttccatgattggtagcttcaatccttctttccctgcccaaaatgatgaccctagcagtcagatcaggtgccctgatttgattgagtgttccaatgttggtttgggtgttagcataataagcaatcagtgctgcaccgcagtcgccgctcttcctataattggtggcgctttttgcttttgccgcgcagtgtcacttgggatccttcctccactagccactgaaatactcgcgcaaatactttttagcgcctgtggacgcaacaacactattttcgactacaattgccaacaagattag

SEQ ID NO: 32302 - DNA, 724 bp, Glycine max
  Peptide Sequence Number=SeqID_123987
atgttgctaagtagcaatgtcatctatatctgtgtaagagtggtcatgttggtgcgcatggtccgcactcttctctttgcagcggcacgggtgaaatcttgccccagtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgagggcgtgcagccctacaaaggtgaaggcatatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctctgacggtgagggtaagggcgtgcagccctctgatggtgaggacgtgtagtcctctcaaggcgaggacgtgtagtcctatgacggtgagggtgagggcatgcagccctctgatggtgaggacgtgtagtcctctcaaggcgaggacgtgtagtcctctcaacggtgagg

SEQ ID NO: 32303 - DNA, 315 bp, Glycine max
  Peptide Sequence Number=SeqID_123988
atgtgcggtaggttgcccgaagggctatctgatccgatcaactgcgtaagccgtagcgcgctagcgcgcgtactcttcctctatgagcgagactccatccaaatctgccactcgttgggcgacgccctcttttctatgaacaccccaccactgaatgatgaactttgccagtcttcgcctccgacccgaccaggagagaacacagagtcaagccaagcccttacccgccagaatggaattcatatctccttcgtctggtcgagaagggagaaagcccaatcgaacatcaatcacttcacggacgctattgattga

SEQ ID NO: 32304 - DNA, 270 bp, Glycine max
  Peptide Sequence Number=SeqID_123989
atggatgccaggtgtggactagtgcatcagccatttgatttcttcccgaaggctctgtggcagtcactgttccacaggaaccgcctgttcttacgtcaaagatggccgtatcactttctcaagggatctgatctcctaccctttctgacgatttacgatcaaatcctagcagcttcccctgacttcaccctgcaaaggtgcactgtggttcagtttattggctattgtccgcaatcaaaacctaacctagccgtgaaaggaatacactaa

SEQ ID NO: 32305 - DNA, 324 bp, Glycine max
  Peptide Sequence Number=SeqID_123990
atgtctgctcttcttttccttatgccgacttccagtcgcaaagccttggatctatctccgcatccagacaggaatcctccttacgactgcgcatttctttatggggaagttcacacctctcaactattcattgataggtcgggagccatatcagaatgtacgatacctgccttaggaaggggttcacatcagccttaccaagttagactggcggctatacgggaagcttccaactgcattaactgctcccacactacctgcgagggtgtctcacggccagatcctcttggaaagacagtgtcatcaacagcttttcatctttag

SEQ ID NO: 32306 - DNA, 351 bp, Glycine max
  Peptide Sequence Number=SeqID_123991
atgagtgttgaagaatttctgcaaaaggtggcctggccaggagtccagccttctcctttgggagggggtgaggcctccgcagcccaggagcctcagaaggatcagcaggaggacattccagaggccgcagagcctacacctcctgagccattcactttagagtttgatccagttgttgtacaagttcaggaggatgttacagcatcagagccctctccaccaaagccctttattttttatgctgatccagctatatctcctcatcctgagccatctgtaccagtgtcgagcctgcctctttctcaggatccatcatctgcaccagcactggacctgaatgagcatgcatag

SEQ ID NO: 32307 - DNA, 282 bp, Glycine max
  Peptide Sequence Number=SeqID_123992
atggtccatttattgatgggcgaacgacggggattgaacccgcgcgtggtggattcacaatccactgccttgatccacttggctacatccgcccctacccccgcacaggggaagcaaagcttcaaacaaagaggttgggctgttcacttcattgatttgacttcactttacttaagattaaagataggggccgggcgggcagtgaaggctcgtttagtagaaagcaagctccgctttttgaagcgagcccccagaaagcctttgcacgctagcctcttgtag

SEQ ID NO: 32308 - DNA, 405 bp, Glycine max
  Peptide Sequence Number=SeqID_123993
gaatccattgatgaagaagatcctaggcctacaagctccaatggagtttacatcaagcttggttcaactgagcagccatctgccccatctgatttgtcagaccctgaatggaggctcttgtctcttgctaaaattgcatattctggatggtcatttgcctcactaactcttctaaggaatgctgaggaggagcctcagttgcttgttgtctttgttgtgactacttttgtattggaggaacatatggcttgcttggaccagcagcattctagaaaggagggacaggctattgttgttgtggaggacttgcccatctcagatttggatgatttctccaacctggattgtatctgttgcttgaaagatcataattattttgttgttgttggttttgctactgagggg

SEQ ID NO: 32309 - DNA, 330 bp, Glycine max
  Peptide Sequence Number=SeqID_123994
atgctggaggcgaccttaccctccatccttttaattagcctggccctgttttttgcctataaattcatagatcctgccccaccccgccatattgtgattgccaccagcaatgacgaccttaactacaacgcctttgcatctgtgtatggggtgtatttgcaaaaagaagggatcacgctggaggtccgtaaaacggctggtgacaatgacaacctgcgcttgctgaaagaccctgactcaggcgtcgatatcgcatttatccaggatggtgtcgcccacagcgagggggcaggttcattactgtcgctgggcagcttgtattaccagccg

SEQ ID NO: 32310 - DNA, 240 bp, Glycine max
  Peptide Sequence Number=SeqID_123995
atggtaggcaaagatttgggaagtacgggcggcccccatgatgtgcaaattcaaaatgagcacgccttcccgtcatatggcttgcctctcaactatacgccacccaatgtggcgtacactcccaataagaatgtcaataactccactcctataccatggaaagccagcaaccccaaactgatcatgcacatgtctcttaaaccgtggaagagacccatgaaattccccatcacaatctag

SEQ ID NO: 32311 - DNA, 222 bp, Glycine max
  Peptide Sequence Number=SeqID_123996
atgaccaaacttggtctctgcttgtcatcgggcccgccgcctctggatgacaaaagggtgcggataaccgtaagcaaaaggggtgcagataaccgtaaggtatctcagcaggctaccagctcttgggtcatggcaacaaaaggcggtgtggtcgacaaaagcgaggctcttgctcctacgtatcctccaatgaggaactcagacctacgtagttctggataa

SEQ ID NO: 32312 - DNA, 372 bp, Glycine max
  Peptide Sequence Number=SeqID_123997
atgccactgtctgagagtcttttgatcaggcgttccagctccattttcttctctgtggtggctttgatggttgcttccagcaccttgcatgtgtccttgagttcagcaatcaaagcatccttggacacagcacctgaagcagcagctttccctgatgtcgagacaatgtctgggacatgtgtaacccctcaaacagttgtaatgcagggacagagccgaacttctctcttcatcacagagtcaatcaagcacagcggtatctgtagtggcgacagcaaaattcttcaagttgcaagttgtttccaggatgtcaagacatctcacgtgacatcagctttctgctccccctgtctccatgctcttactgtgtga

SEQ ID NO: 32313 - DNA, 396 bp, Glycine max
  Peptide Sequence Number=SeqID_123998
atgcctgccagttggtttgcaccaaccaagcggatgatcggaaggctgcttgccggttcattggcttttgaaagccgcatccttcactatcttattgtgcgcattttacttccaagatcttcaaaccttgcacaggtttctgaagaaaatcttattgtcatgtgggcttttcataccgaccgacaaattgattgggcacacttagtccgatatcgcatgcataaggcattgcgattaaatgctcctttgccctatcctcatccagtcactcttttccttcaacactttaacatccctcttgattatgaaccttatgttccaatcaagagatcctttctgatcggtgctgctgtgattgcatcttttggttactgcaaagagcgtgatggctcttag

SEQ ID NO: 32314 - DNA, 221 bp, Glycine max
  Peptide Sequence Number=SeqID_123999
gtggccttgttggtgcttgtgcgcttagcgcaaatctagaccgcttagcgcgcattagtgaatttcgacttagcgcgcgtcttcttgctcagcagatggactcaagcggtgcacttagcgggatgacacctcgctcagcgaacatgcacaactcatccttcttccagattcttcctctcgctcagcgaatggagtgttgcgttcagtggatggctcgctaa

SEQ ID NO: 32315 - DNA, 540 bp, Glycine max
  Peptide Sequence Number=SeqID_124000
atggcttctccacctgcctcccctcctcctcattctccttctcctcctcctcctcatgctccttcggacgcattggcttcgccgtctgtcattaagcggacatgcaaagcctcacgtctacaatcgttgtctactagaccacctggtgctgagagaccagtggtccatgttgatccttctatcggcaaggccgacggtccccacaggaagaaattaagaacatatttggggattgtggcgcgtgataaggtggatgtcacctacgagaattggaaggaggtccctactactcagaaggacctgatttgggaggatattcaggcggaatttgatatcctagaggcttctgacagtaggacgaaaaagaagttacttcagaccatgggggagagatgtaggcagtttaaattagacctcacgaggaaatgggcccttgcagccgatcaggatggtgtcgaggacactgtctgtgagaaatacgacattagcaaggaaaaatgggcccagttttgccagactcacagagacccttattgggag

SEQ ID NO: 32316 - DNA, 471 bp, Glycine max
  Peptide Sequence Number=SeqID_124001
atgtggacacgtagccctctaaaggcgagggcgtgcagccctctgaagtttaggacgtgtcgccctttgaaggcgagggcgtgcagccctctaaaggtgaggatgtgcagtcctctagaggtgaggtcatttaaccttctgatggtgaaggcgtatagccctttgaaggcgaggaaatgtatgcctctcaaggggaggatgtatagtcctctgaaggtgagggcgtgtagcccttggaaggtgaggacgtccaatcctttgaaggcgagggcgtgtagccctcttaaggcgaggacgtgtagtcatctgaaggtgagggcgtgtagccctctgaaaggggggacgtgtagtcctctgaagattgattgtccttttgaaagaggtgataattcatgcaaccttatcctatcttttgcaaatctctccgggaactccctcagagtgtgcgttctgtttgatttagtcacttga

SEQ ID NO: 32317 - DNA, 266 bp, Glycine max
  Peptide Sequence Number=SeqID_124002
aggtgaactctaaagtggtggcggtgcgtctattgcccgctaccggccatcctaatgctactgtgtgtctcgcctgcgtctgcctgggggcgcagtacttcttgatgaaagctcgattagtagagggcctgatgcccttgctggaggtgacaggactgatagaggcccgtaaccagagctggaaaccccagggccctgttggacttcttcaggttcactggggggagattggcattgcggtcgctgggcagaatgttgctaagtag

SEQ ID NO: 32318 - DNA, 201 bp, Glycine max
  Peptide Sequence Number=SeqID_124003
atgaacactcatcctcttgctgaactacctgtggctaagcgaggcggaatcgctaagcccagatggcctctaagaaacataagaatggtgattctagaccacaggatcaaaatgataacaggagatttcactgagaggaagcctagaaccgatatatcgataatcttagaccgaaggatccttccggaaaggaatgtgtaa

SEQ ID NO: 32319 - DNA, 339 bp, Glycine max
  Peptide Sequence Number=SeqID_124004
atggtcgggagcgggctacagatgcaccgccaccaccttcagagcccctcagctcatctacaaaggctgaagcgttgcctacgacctgtggccgaccagcaggcgaccaagtccaaagccaaaggtaagaaaaagtacaaggttcgtgatcgacaagtcatcatgcgtccggctcaagacgttaaagaagcgctactaggaggcatcctagaattggctatgatgaagctccccgcgaagcagtccaggaagggcaccattaaagagggttccagtgcggccccacaagccgacataggctttgacaaacaccgattccagagcctggaacatcagtag

SEQ ID NO: 32320 - DNA, 270 bp, Glycine max
  Peptide Sequence Number=SeqID_124005
atgacgactctttgcaaatctagaagaagacacttccagaaggattgtctaaagtgtaagtcttggttcaaaaagaaaggtgagcttaatgctcctggattccttacaatccaagccataagcccaaatgtgaagttcatcttcatggagaatagagtgaaagctcaagtggaagcgatcgagacttatcatttaaaacttgacactggacatcattttgatttactagaaactctttatgtacctagtttacctacgaatttagtttaa

SEQ ID NO: 32321 - DNA, 264 bp, Glycine max
  Peptide Sequence Number=SeqID_124006
atgtatatccctttgaaagagaggaagtgtagccctctaaaggtgaggacgtacagccctctgaaggtgaggacatgtagccttctgaagtcgaggatgtgtagccctctgaagtcgaggacgtgtagccctctaaagtcgaggacgcgtagccctctgaaggcaaggatgtataaccctcggaaggcgaggacatgcagccctctgaaggcgaggacgtgtagccctcaaggggtccaaccttatgagaaagcaagagattga

SEQ ID NO: 32322 - DNA, 115 bp, Glycine max
  Peptide Sequence Number=SeqID_124007
tgatctatggtttaagttgaagaagtcagaccttaacatcatggctggactttgtggagggtcaaaggttcagatgaaaaatggaaaacacttgatggtgtggagctatgattag

SEQ ID NO: 32323 - DNA, 731 bp, Glycine max
  Peptide Sequence Number=SeqID_124008
cactcgctgcatcgcctctccagtcaggagctgcgctgcgccgagcacgccggcgctggcgcatttcccgctggcgcagtggcgtcgcgcactcaatcaaaccgcgcagcaggcacagctgctgggctacggcgatccgctgggtgagctggcgctgcgtgaggcgctggcgcagcatctggcgctggcgcgcggcgtgcgctgtgcgccgcagcagattgtgattaccgaaggcgcgcagcaggcgctgacgctgtgcgtcgcgctgctcaccaatcgtggtgacaccggctgggtggaggagccgggctatcgcggcgccaaagcggcgatgcgcctcggtgatctgcagatcgagccgattgcggtggatgcgcagggactggcaccgacagcgcaggactggcagcagcgcccgccgcggctgatttacaccacgccaacgcatcagtatcccaccggcgcgatcatgagcgccgcgcgccggctggcgctgctggcggcggcacagcggcatcaggcgtggattatcgaagatgattacgacagcgattttcgctacagcggcgagcccatcgccgcgatgcagggcatggcgcagccgacgccggtgatttacatcggctccttcagcaaaaccctgtttccggcgctgcgcatcggctacatggtactgcccgccccgctgctgccgcggctgcggccggccttgcatgagctgttacgcggcg

SEQ ID NO: 32324 - DNA, 393 bp, Glycine max
  Peptide Sequence Number=SeqID_124009
atgactctttcatcatggcagaacaagctaaacagaaccatgactaatccacctggctcgcctcctcctccttctcctcctcctcctgcagatccatttaccgtgaagcggacacgtaaagccacacggctacgatccttggccactagaccacttggggcagagagactagtggtccacgtcgatcctgcgactggcaaggccgacggtctccaaaagaagaaattaagaacatatttggggattgtcactcgtgataaggtcgacatgacatacgaaacctggaaggaactccctgctgctcaaaaggatttgatatggaaggatattcaggcggaatttgaaatccctgaagcttctgatagtaggacaaagaagaaagttcttcagacg

SEQ ID NO: 32325 - DNA, 66 bp, Glycine max
  Peptide Sequence Number=SeqID_124010
atggggccagagatgcaagagaaggccctaaggttcatcaagagccttaggggctccataatgtag

SEQ ID NO: 32326 - DNA, 312 bp, Glycine max
  Peptide Sequence Number=SeqID_124011
atgaaacatatcgcaggtttcaattccaacgaagaagtatatgttgaacaacctccagttttgagtgcagtcccggatctaaaactaatttctagagaaaacacaagtggaacttgtcaattcattggatccctcttgtctcatggcatagtaagaaacaaaacagtgttgctttatccactgctgaagcggaatatatttctgccggcagttgttgtgcacatagattttatggatgaagcaactaattatctgactatggcatccttcttgattgtataccaattaggtgttgaaatactagtgccataa

SEQ ID NO: 32327 - DNA, 972 bp, Glycine max
  Peptide Sequence Number=SeqID_124012
atgaaaataggcatactttgctatccaacatacggcggaagcggtatcgtagcaacagaactgggaatgtctcttgctaataaaggctatgaagtccatttcattagttcagcccttcctgcgagactcgatattaccaatcctaatattttttttcatagggtaaatgttcaaacttatcccctgtttcaatatcaaccttatgatattgcactgagttcgatgatctacagagttgttaatctgtataaactggatttattgcatgcacactatgccattccatatgcttatgcagcgtttacggctaaacagatgctacaggaagataataacgacattcctttggtaacaacacttcacggaacagatattactttggtaggacaacatcccagctacaaacatgctgtagagttttcaatcaacaaatccgatgcaattacctctgtatctgaaagtttaaaaaaagacacgctacagtttttcaatattaaaaaaccaatccaggtgatcacgaatttcatcgacaattctgaatttgatgaatgtaatgaatgccagagaacgcagttcgctgatccggatgaaaaaatattaatacacgtttccaatcttcgccctgtaaaacgtgtggatgaagttcttcaaattttcaagaatgttcataagaaggtaaaatccaaactgatcattatcggagaaggtccggatatggagaaggtgaaccagtttttagaagaaaatccggatttgatttctaagatcaggcttcttggaaaggtaaatgacctgtatagaattcttcagctttctgacgttttcttattaccatcagaacaggaaagttttggattggctgcattggaagccatggcagcgtatactccggtgatcagttccaacgcaggaggaattcctgaagtaaatgtccagggagaaacaggattcttagctgaatcggaaatgtag

SEQ ID NO: 32328 - DNA, 730 bp, Glycine max
  Peptide Sequence Number=SeqID_124013
atgacgaattggagtttacaacaacactcaaaaggaaaaaagattatagaagatgatatttatcttcgtcaactggagatcaaccgtcaaaataaagaattggcggtacttagaaaaaattacgcagaagttttagtgaatgcttataaaaacaagggagtacaaaacaaagtaacctttattctttctgctaaaaaccttggagaagctattcgtagagttcaatatcttaaagaatattcggactatcaggataaaaaagcggctgaaattacagacgctgcaaatcagatcaaaaaaacaattgcccaaagacaaaaatcggttgcagataagcaacaacttttgatagatcaacaaaaagatctggctactattaatgtggaaagagctcagaaagagcagcttgttgaggattttaagaaaaatgaatcgaaattaactgctgaattaaaacaaaaacaagttcaatctaaagctcttgaagggcagatcagaagcatcattgcagaagaaatcagaatagcaaaagcggaagaagaagccagaagaaaggctgaagctgagaaaatccgtttagctaaaattgcagcggaaagagaaaaagcaagaatagaagctgaaaatagagcaagagcagaagcacttgaaagagaaagaaaattagctgaagctgaagctaaaagagccgaggagctagccgcaaaaaaagctgaagaggaaagaaaac

SEQ ID NO: 32329 - DNA, 165 bp, Glycine max
  Peptide Sequence Number=SeqID_124014
atgggggtgcaaatagcacccaggcccatttgggccctccagaagattcctccagaaggcggttgcttctggaggaagcaacccttcttgcctgggcgagctgggcggcaaccacctcccctattagctataaataggggaggaaatgaagagggatcctctaga

SEQ ID NO: 32330 - DNA, 387 bp, Glycine max
  Peptide Sequence Number=SeqID_124015
atgttgtatcattgtattgccagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgtacgcaccaccccgtcagtagctga

SEQ ID NO: 32331 - DNA, 324 bp, Glycine max
  Peptide Sequence Number=SeqID_124016
atggctccgaaaaagctttccacgaagaggtctaggagagacgccgcagcggaagggtccagtgccgcccccgagtttgatagccatcgttttcggagcgccgagcaccagcagtgcttcgaggccatcaaaggatggtcgttccacagagagaggcacgcccagcttagggaggatgagtatacagattttcaggaggagatagctcataggcattggacgttgttggtgactcccatggctaagtctgaccctgagatagtcctacagttctatgctaatgcttggcctacagaggaaggagtgcgagacatgcgttcatgg

SEQ ID NO: 32332 - DNA, 369 bp, Glycine max
  Peptide Sequence Number=SeqID_124017
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccgttgtcgatgcaaaaccgtgcgatggaggagatgaagtga

SEQ ID NO: 32333 - DNA, 1026 bp, Glycine max
  Peptide Sequence Number=SeqID_124018
atgcaatccttgcttactggcagccgcctggcttggggggcgcaaaatattgccaagtatgaagagggggcttataccggtgaggtgagtgcggaaatgttgcgagactttggggcgcagtatgtcattatcggccactctgagcgcagcacggcttattgtgagtcagatgaaaatattgccgaaaaatttatgatggccaaacgtcatggtttgatcccgattttatgtgtcggtgaaaccttgctggagcgcgaagcgggtgtcatggagcgcgtggttggcaagcagcttgaaaccattattcgcctgtttggcggggaggcgtttgcagggactattgtttcctatgagccaatctgggcaattggtacagggttggccgcttctgccgagcaggcggtggccatgcacacgtttattcgtgagactgttgcggctgcagataaagctgcggctcaaacgctaaaaatcctctatgggggcagcgtaaacccgcaaaatgcgcatggtaaaggcgccgacatgggcgcagcctttggaagtggtgcctctggcagtttatttggggtgtccggatcttctaacttgcttagcaagctgacatcgatttttattacagtgttttttgcaaccagcttaacgttggcatttatgtccagccataaagcgggttctggcagcgtggtgaaagccccgttgacacaacaggctccggccaaaggcttggggccactgattgctggtaaaattctttctccgcacaaacctgatgcggaaaaaaactctccttatgaatgcggctttgaagcctttgaagatgcgcgtatgaaatttgacgtacgctattatctggtcgcgattctgtttattctgtttgatctcgaaattgcttttctattcccgtgggcggtggtcatccaagaaattggttcggcaggcttttgggcaatgatggttttcttgtttgtgctggtggtcggcttcatctttgaatggatgaaaggcgcccttgaatgggattaa

SEQ ID NO: 32334 - DNA, 453 bp, Glycine max
  Peptide Sequence Number=SeqID_124019
aaggtagaaatcttacttattcacaatttgtttccaaattcgtgttacaaccaaaaggctagatcatggaacctcagaaagaaaggcaatacaattggcagactaatatgggttccaccaaccactggtgaattgttttatctaagaataatgcttactacatgcaaaggacctactttatttgaggatattagaacagttgaaaatgttctataccttacatatagggaagcatgcttcgcaatgggttttttgcaagatgacagagaatttgtggaagcaatcaaagaagctaaggactggggcacgactaattatttgaggaaattatttgtcttaatgctatttacaggtgccattactaaacctgaagaactttggaatcaaacatggaattcgttagctgaagacattgcatatcattataaaaaaacaactctgaacacatgttag

SEQ ID NO: 32335 - DNA, 279 bp, Glycine max
  Peptide Sequence Number=SeqID_124020
atgggaggatacgtaggagcaagagcctcgcttttgtcgaccacaccgccttttgttgccatgactcaagagctggtagcccgcggagataccttatggttattcgcacccttttgtcatccagaggcggcgggcccgatgacaggcagagaccaagtttggtcattctgcacccatgatacgcggagataccttacggttatccgcacccttttgtcatccagaggcggcgggcccgatgacaagcagagaccaagtttggtcattctgcacccatga

SEQ ID NO: 32336 - DNA, 321 bp, Glycine max
  Peptide Sequence Number=SeqID_124021
atgataacaaaagatgatgacaaaggtgatgacaaaaagctcaaagatcaatcaaagaacaactcaagtgaatcaagaacaattcaagagttcaagatagaatcaagaagaattcaagactcaagaggaaagttaagagtcaagaatcaaagattcaaggttcaagatctcaagaatcaagatcaagattcaagactcaagattcaagaatcaagagaaggcttaatcaagataacacatgatttttctcaaaacatgtttaccaaagagttttactctctggtaatcgattaccagattgctgtaatcgattaccagtag

SEQ ID NO: 32337 - DNA, 126 bp, Glycine max
  Peptide Sequence Number=SeqID_124022
atgactccagaacaagtcatgtacaacattatcatcattcatcctatgccagtgaatatattaatcgcgatcaagcaggatcatgagctgttgcatttcggtgttacttcctctcatggaagaacg

SEQ ID NO: 32338 - DNA, 234 bp, Glycine max
  Peptide Sequence Number=SeqID_124023
atgctccaactatatgggatcagcataagcttaaaggagcactcaaacccggtgacccccaagccctacactccgaagagtccgtcagggcctctccctcctgattcaggtccaacccctaaaattcattttagcacacagacactgctcgtgaattatacaatactcatgacctcacattcgtgtgttaaacacgtacaacatattgcgctacaatttaacaccggttcctaa

SEQ ID NO: 32339 - DNA, 485 bp, Glycine max
  Peptide Sequence Number=SeqID_124024
gagcaagagcctcgcttttgtcgaccacaccgccttttgttgccataactcaagagccggtagcccgcggagataccttacggttatccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggaggataccttacggttatccgcacccttttgtcatccagaggcggcgggcccgatgacaagcagagaccaagtttggtcattctgcacccaagatgcgcggagataccttatg

SEQ ID NO: 32340 - DNA, 294 bp, Glycine max
  Peptide Sequence Number=SeqID_124025
atgcctaggcagacacagggtgacgcacctctgggcgcgggcgcaccgccaccacctcatcaggccagtcctgctggatcacttggcatggagcgttatctacagcacttggttcgccagcaggcggccaaccaccgcggacagtttgcggctgaggtcgcatgggtgggagactggcccgatgcccaggcaggggaggagcctacaggatcccccggtaggatggatgagccccgcatggacgaggatatgactgacttgttcgatttcttgggagggagcggagccacatga

SEQ ID NO: 32341 - DNA, 360 bp, Glycine max
  Peptide Sequence Number=SeqID_124026
atgtcaatccttactctcggaaacaaaaaaggaggaaaggaaatttccaatcaaagagaaagaaaagaagaggaaaggaaattcccaatcaaagagtgggagaaagcgaaaagaaaagaaagaaaattcccaaccaaagaatgggagaaaaattgtcaccaaatgaacaaaagaaagaaaaggaaccatgacctaaagtggtcttctccctttgattatcaaccaaaatcctgtgcggctagcgactttttcgcccgcactaaacaaaacagaaaagaaaagccaccaaaatcaaaagccaaaacacccaaagccgaaaaccatcaaagacccactccaggaagtcctattggatcatga

SEQ ID NO: 32342 - DNA, 171 bp, Glycine max
  Peptide Sequence Number=SeqID_124027
ggcgctcttccgcttcctacgctcactgactacgctagcgctacggtcgttcggctagcggcgagcggccagcaaaaggccaggaaccgtaaaaaggccgcgttgctggcgtttttccataggctccgcccccctgacgagcatacacaaaaatcgacgctcaagtcagag

SEQ ID NO: 32343 - DNA, 558 bp, Glycine max
  Peptide Sequence Number=SeqID_124028
atgtcttgcctagtgatcataactccgaccttcctctgccgaagtgtcagctggtgtatgccacccaccaggcaacctctagaccaggataagtctaacagggccctggggtttccggcattgatcatgggcctctgccagtcattcggggttctcgtcactcctagtaagtattgcacacctaggcaggcgcagggtgatgcacctcaggccatagacgcaccgccaccacctcatcaggctgatcctgctgggtcactaggcatggagcattatcttcagcacttggttcgccagcaggcggccaaccaccgagggcaggtgcagatacatgagtgtatctaccagctcagccttagtcagcaggggaagggttttgctccttttgcgtgccctactctagagcagtttagggctgaggtcgcatggcccggagattggcccgaggcccaggtaggggaggcgcctgcaggagctcccggcgatgtagaggaggcccgtatgggtgaggagatgacagacttgcttggtttcttaggaggaagcggagccacatga

SEQ ID NO: 32344 - DNA, 107 bp, Glycine max
  Peptide Sequence Number=SeqID_124029
gtgtcgagggaaggagcctagagtatgaagaacctcgggatttgaggtcaaatcctttccaaggtggaggggatgatgcaatcctaccccccaaaaattaccattaa

SEQ ID NO: 32345 - DNA, 113 bp, Glycine max
  Peptide Sequence Number=SeqID_124030
atgaggttatttgatatcctgagtatatgcactgtgtgtcaatacccaggaaggagatccgctacggataaagagccactcgaggcactcgggctgacagccatcttagtgag

SEQ ID NO: 32346 - DNA, 177 bp, Glycine max
  Peptide Sequence Number=SeqID_124031
atgggctcagaaatctaccctaaggttcatgagaaccctagggccttcttcagcagctcaagcccaatcctcttggagcctcttgctcatggctctagaattaatgaagcattgggcttgaatccagaattgggtttgtccttgaagagaggagactattttattctacaaaattag

SEQ ID NO: 32347 - DNA, 2709 bp, Glycine max
  Peptide Sequence Number=SeqID_124032
atgtcgacaagcgcaatgagcgtggtgatcctcgccgctggcaaaggcacccgcatgtattccgatctgcctaaggtgctgcacagcctggcaggtaaaccaatggtgcaacacgttattgatgccgctaccggcctcggcgcacagcaggtgcatctggtctacggccacggcggtgaattgctgcaggagaaactggcgcataacccgctgaactgggtgttgcaggcggaacagctcggcaccggccatgccatgcagcaggcggcaccgttcttcgccgatgacgaagatatcctgatgctgtacggcgatgtcccgctgatcgcccaggaaaccctgcagcgtctgcgcgacgccaaacccgctggcggcatcgggctgctcaccgtggtgctggataaccccaccggctacggacgcatcgtgcgcgaaaacggcaccatcaccggcatcgtggagcaaaaagatgcgtcagccgaacagctgaagattcaggagatcaacaccggcatcctgatcgccaacggtgccgacctgaagcgctggctggcgcagctcaacaaccacaatgcgcagggcgaattctacatcaccgatatcatcgccatggcgcatcaggaaggccgcgtgatcaacgcagtgcacccggcgcgtatcagcgaaaccgacggcgtgaacaatcgtctgcagctatccactctggagcgcacttatcaacgcgagcaggcagaaaagctgctgctggctggcgtcatgctgcgcgatccggcgcgcttcgatctgcgcggtacgctgcagcacggtcgtgatgtcgatattgataccaacgtgatcattgaaggcaacgtcacgctgggccatcgggtgaaaatcggcgctggctgcatcatcaaaaacagcgtgattgccgatgactgcgaaatcagcccttattcggtgattgaagatgccacgctggccgccgcctgcaccgtcgggccgtttgcgcgcctgcgtccgggcagcgaactggctgaacaggcgcacgtcggcaactttgtcgagatgaagaaagcgacgctgggtaaaggctctaaggccggccatctgtcgtatctcggggatgcggagattggcgcgggcgtgaatatcggtgccggcaccatcacctgcaactacgacggtgccaacaagtttaaaaccattatcggcgacaacgtgtttgtcggctcggacacccagctggtggctccggtcagcgtggcggcgggcgccaccatcgccgccggcacgacggtgatgaaagacgttaccgctgccgatctggtctataaccgcaaagagcaaaatcagaagtctggctggcagcgtccggcagctaacgcacctgcaacctggaataggaagggatatcccccactctctacaaggctcggggaacaatcagtagcgcagcgtgatatcgcagaaattctgctggaagggctgcgtcgtcttgagtatcgcggttatgactctgccgtggccaatctggcagaagcggcggagcagcagccgctgattggcggaaccggcatcgcgcacacccgctgggcgacgcacggtgagccgtcggaagccaatgcgcatccgcacgtctcagagcacattatcattgtgcacaatggcattattgagaaccacgaaccgctgcgtgagcagatgatcgcacgcggttaccgctttgcctccgaaaccgacaccgaagtggtggcgcatctggtgcactgggagcagaaacagggcggtacgctgcgcgaagtgatactgcgggtgatcccgcagctgcgcggggcgtatggcatggtgatcatggacagccgcgatccgtcggtgctggtggctgcgcgttccggcagcccgctggtgattggccgcggcgtgggcgaaaactttatcgcttccgatcagctggcgctgctgccggtgacccgccgctttatctacctcgaagagggggatattgccgaaattacccgccgcgaagtgacgattatcgatcgccacggtaaccaggcacagcgcgcagagatcgaatccaatgcgcagtacgatgccggcgacaaaggcgtctaccgccattacatgcagaaagagatctacgaacagccgaacgccatcaaaaacacgctggccggccgcttccatgacggcattgttgatctcagcgagctgggcgctaacgcggaaacgctgctgagccaggtggaacacattcagatcatcgcctgcggcacttcctacaactccggcatggtgtcgcgttactggtttgagtcgttggccaacatcccgtgtgacgtggaaatcgcctccgaattccgctatcgcaaatcggcggtgcgtaaaaacagcctgctgatcaccctgtcgcaatccggtgaaaccgccgatacgctggcagcgctgcgcctgtccaaagagctgggctatctcggttcgctggccatctgcaacgtggcgggttcgtcactggtgcgtgagtcagatctggcgctgatgaccaaagccggcaccgaaatcggcgtggcctcgaccaaagcgttcaccacccagctgacggtactgctgatgctggtggcgaagctgggccgtttgcacggcatgcgcgctgaaaccgagcatgagattgttcatgcactgcaggcgttgccgagccgcattgaacagatgctggcgcaggataaa

SEQ ID NO: 32348 - DNA, 600 bp, Glycine max
  Peptide Sequence Number=SeqID_124033
atggttgcctatgtttcgaaagcccaatctacagttgaagagttaaaattatcattgaacgtcgataaacttgaagacataaagacgaaactttataatctatatatggtgctggtactacgtgggatgcatctagattttgatcatatttgtgaccaagtcttaactggccaagaagttgtttctctagagaatttaattatccgactccttcgagtcccctcaccaaaaataagaggaaattcagttgacagtattgaaacttctgccatggtatctaatcgaggtggacgaagtggttgtggaaaccgaggaggacgaactagaagaggaggtcgccctcaatgttcttactataagagagtgggtcacacacaagacacttgttattctattcatggattccccagaaaatcggtgaatatttcaaagtctgaaacatctgagataaagttttcgaagactaactatcaagagtatcttcaactaaaagctgccaaggaatctcaaacatcatcttctataagtggtcataactccattgcctgcatttcccaatttggaatgtggtacgggtcggacgattggcgtaggacatga

SEQ ID NO: 32349 - DNA, 456 bp, Glycine max
  Peptide Sequence Number=SeqID_124034
atgaatccggatactgtattcctaatgaagagcaatttgcatatgaagtcaattatatgggggaatcaacctagaggtaatttcaatacaagtggatttccaggacttcagaacaaccagcagtatcaacaacagagacaatggcaaaatcaccctggtaaccaattcaacagagaccagggtggttcatctacaaggccacaacaacagatgccaagtctctataaccgaaatctagctcaattcatgcaagtgtcaatgtctaaccaaaagagaattgagagtgtaattaagaatctggaagtccaggtggtccagcttgcaaagcaattagctaaaagaccatcaaatagctttagagcaaacacagagaaaaatcctaaagaagagtgcaaagctgtgatgactaggagcaaaatggtgattcaagcggaggaaagtagagctgataagaag

SEQ ID NO: 32350 - DNA, 213 bp, Glycine max
  Peptide Sequence Number=SeqID_124035
atgcatcctccaccatcgagtcctggagccccacgaattgaattgcctagcgctgttggtgcatcctccaccatcaagtcttattcggagccccatgaattgatttccattcatgcatcctccaccatcgagtctggagtcccacgaattgattgcctagcgctgttcgtgcatcctccaccatcaagtcttattcggagccccatgaattga

SEQ ID NO: 32351 - DNA, 510 bp, Glycine max
  Peptide Sequence Number=SeqID_124036
atggctactccacctggctcgtctcctcctcctccctctccttcttcttctcctcctcctactcctcctgcagacccctcaacatctccgtctactataaagcgaacatgcaaagccacatggctacgatccttggccactagaccacctggggcagagagaccagtggtccacgtcgatcctgtgactagcaaggccgacgatccccaaaagaagaaattaagaacatatttgggaggatatacagaatttgaaatccttgaagcttctaacaataggacaaagaagaaagttcttcagacagtggatccctcatgggaggatgtgcggaaaaaagcacaggccatccagaagcaaaacaccgccccccacgtgttgtctcgtgagggttatgattatttagaacagaagctgatggctgagaagacaaagaaaaaactagaggaagctgctcagtccggaagcactgagggcgtcactaacactccatttcccatcaatgatacatga

SEQ ID NO: 32352 - DNA, 753 bp, Glycine max
  Peptide Sequence Number=SeqID_124037
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgacaatcaacaagcaatacaggaacagccagttgagctgattgatagtggtggagcacatcaagctgaaccaggaaattccattaattggaattatcctaaagaagcttcggttgactatcaacaaacaatgcaggagcaatcagttgagctgtttgatggtggtggagctgttcaaagtgaaccacaaaactccataaattggaactctcccaaagaagcttctgggtaccgagctcgaattcgtaatcatggtcatagctgtttcctgtgtgaaattgttatccgctcacaattccacacaacatacgagccggaagcataa

SEQ ID NO: 32353 - DNA, 219 bp, Glycine max
  Peptide Sequence Number=SeqID_124038
atgcattctcttgatttcaggactgtcatcatcaaaaagggggagattgtggaagcaatgtcttccaaggttattttgatgatgccaaagaatcaagagttaagcaaattccaaagattcaagaatcaagtttcaagaatcaagattcaagattcaagaatcaagtttcaagaatcaagatcaagattcaagaatcaagagaagactcagtcaggataa

SEQ ID NO: 32354 - DNA, 448 bp, Glycine max
  Peptide Sequence Number=SeqID_124039
cccgaatgagtttgagcaagataacgcggcagaactgcctggtaagcacagaggaaaccgtgggaagaagaacagaggccaaggctcgcggttggggcaacaagccgaaggggccccaccctgccacatcagtagaagctttataagtgcgggtctaagatacgacggccaagtcgccacgatatgcgaggatgactccccgaggaggtcggatttggtacggtcatgtcctcctggttttggactaggaaattggcgagtagaggagcgcccagacttttacgcgacaagcataatatccgatgacaagtccctcgaaggtactaatacccgggacccggccgttgattttgagcaagaagcgggtcgaatgaagagtgaagaggacgaggatgtgggacttcccccaaagctggagaggataatcgctcaggaagaccgaaaatga

SEQ ID NO: 32355 - DNA, 405 bp, Glycine max
  Peptide Sequence Number=SeqID_124040
atgagccaatattctggaattcagagccatattgtttcagctttaactcacatgctggatcaacacaattctcatgctaaaagttttagaatgaccagggatagattggcagatgatcaagccgataatatcaaattgcaactgatagatgctcggggaaaagatggtcgtgtatataatatgcctaacattccggaaattggtgcacttattgttggcgattttcatccaagctcaaaaagagatattattgttgaaactcaaaatggagaattacaaagaatccatgaactgcaccctagttatctaccactacaataccctctactctttccttatggagaagacggatatagagctgacatatttcaccattctacttcatccagcaaaaaaagaaagtga

SEQ ID NO: 32356 - DNA, 354 bp, Glycine max
  Peptide Sequence Number=SeqID_124041
atggcaacccaagcctcatcttcaatccaagaagaaagtgatatggaagattcaattgacttggatgaagatgaagaacttagtctctttgtcaaaagattcaacaaatttcttaggatgagagaaactcaaagaagacaaaacttcaaacctaaaagaaggattgaagaatcatctcaaactccaagatgctatgagtgcaatcaactcagacatctgagggttgattgtccaatctttaagaaaagaatggagaagttcaaaaacaagaacattggagaaaataaggcaaagaaggcctacatcacatgggatgataacgacttagaatcgtctaatgattctgaaaaataa

SEQ ID NO: 32357 - DNA, 471 bp, Glycine max
  Peptide Sequence Number=SeqID_124042
atgtcattaaaattgccatattatcctgaacttgcaaaggtcttctactgcaatttaaaaattcaggatggcattattatttctgaggtgcatggtatttctatggtcattgatcagtcactattcttttctttgactcatttacccagtcaaggtgcaccttttgagggcaccattgttgatgactggaaatttgattattcgagtcatgatgctcgtcgcatgctgaagaaggatgcactccctcctcaagatgaacgtactccttcacctcctcctccacgcgaagattccgcactcatgaatgaagtcctctccgaattacggggtctttgttcttatgttggtgaccgcttcgactcgttagatacacgctttgccggtatggacattcgcctcacacagcttgaagaggatgtcgtatacattcgtcagagtttcgatcttccaccaccacctccgtcttcttag

SEQ ID NO: 32358 - DNA, 516 bp, Glycine max
  Peptide Sequence Number=SeqID_124043
atgagagtgatgagaacatttctcaagaaggttaaacaaaaatcaaaagtatgcctttcatctttgaagatccaaacacctttaatcatgaaaaagaaccatcaaagaagcgaaagggttcttcgagtcggagtcaacgtcattctgagactcaggaaacgccgattccttcctctattccctctgcctaattgttttcatccgaagaacagcagatacgttaaagccttctattcaaacctagaaatccaagaaggcactttaatttctgaagtttatgggattaaaatggtcattgaccaatccctattctatgatttaacccaattatccagtgaaggtgtaccatttgaaggtacattgattgatgattggaaatatgaattctttgtgcatgatgcccgccggttggtttgcaccaaccaagcggatatgaccggaaggcttcttgccggttcattggcttttgagagccacatcctttattatctcattgttcgtatcttgcttccatga

SEQ ID NO: 32359 - DNA, 2247 bp, Glycine max
  Peptide Sequence Number=SeqID_124044
atgaccagtcccatatgggactatcaacgcaaagtattcgctttaaaatggccagtaattagtccgcatttgaattatccgctgatattaaacattgatagcggaacaaataatctaagaggccatgcaatgaaattaaatcagatcgctaaacatctggctctggccggtgttttaacttcgctgtcgctttccgccttcgctgccgcccagcagcaggacgccaccccggcaactcagcaggcaaataacgcgctgtacaacaaactgccgtttgccgataaaactgatttcgataacgcgcataaaggttttatcgccgcgctgccgcagaccatgattaaaggcgagcaaggcaacgttatctggaacccggcaaaatatgacttcgtcaaagaaggtgaaaaagccccggataccgttaacccgagcctgtggcgccagtcgcagctgattaatatcggtggcctgtttaaagtcaccgacggtgtttatcagatccgtaatctcgatctctccaacatgaccatcatcgaaggcgagaaagggatcaccgttatcgacccgctgctgagcgccgagccggcgaaagaagcgatggatctctactacgccaaccgcggtaaaaagccggttgtcgccgtcctgttcacccacagccatgttgaccactacggcggcatccgcggcgtggttgatgaagccgacgtgaaggctggcaaagtaaaaatctacgccccggccggattcatggaagaagcggtttccgagaacattatggccggtaccgcaatgagccgtcgcgccagctatatgtatggcaacctgttgaagcctgacgccaaaggccaggtcggcgccggtctcggcaccaccacctctgcgggtaccgtgacgctgctccagccgaccaactacatcactaaaaccggccagcaggaagtgattgatggcctgacctacgacttcatgatggcgccaggttccgaagcaccgtcggaaatgctgtggtatgtcaaagagaagaaaatgattgaagcggcagaggatgttacccataccctgcacaacacttactcgctacgcggcgcgaagatccgcgatccgctggcgtggtcaaaatatattaacgccgcgatcgaccgctggggcaacgatgctgaagtcattatcgctcagcaccactggccaacctggggtaatgacaacatcatcaagctgatgaaaggtcagcgcgacatgtatcgctacatcaacgaccagaccctgcgtatggccaacgaaggcctgacccgcgatgaaatcgccgctaacttcaagctaccggaatcgctggaaaaacagtggtcaagccgcggttattacggctccgtcagccacgatgtgaaagcgacgtacgtttactacctcggctggttcgatggcaacccggcgaccctcgacgagctgccgccgcaacaggctgcgaagaagttcgttgaatacatgggcggcgccgatgccatcatgcagaaagccaaagccgactatcagcaggggaactaccgctgggtggcgcaggtgaccagtaaaatcgtcttcgccgacccacagaataccgatgcgcgtaacctcgaagccgatgcgctggaacagttaggctaccaggcggaagccggtacctggcgcaacttctacctgaccggcgcgcaggaactgcgtaacggcgtacagaagctcccaacgcctaacaccgccagcccggataccgttcgagcaatgactccggagatgttcttcgactacctgggcgtacatatcaacggccagaaagccggcgcggcaaaagcggtcttcaacatcgatctcggtaaagacggtggtaagtacaagctggagctggaaaatggcgtgcttaaccacaccgctaatgcggtagcagacaacgctgacgccagcattactctgaatcgcgataccctgaacaagatcattctgaaacaggaaacgctgaagcaggctgaagataagggcgacgtcaagattagcggcaatggcgctaagctcgatgaaatgctgagctacatggacaaatttgaattctggttcaacattgtcaccccccttgatggtattccgttgctacaacacgccgccaggatggcgcaggaaaacgggatgcggattaccatcgcccacatcagcaccgactaccgggcgcttaattacgtatccgacagcctgcagaatgatgaagtatcgcaagag

SEQ ID NO: 32360 - DNA, 110 bp, Glycine max
  Peptide Sequence Number=SeqID_124045
tgaatgtgactctagaagcgtttgagaagcttgatttcaaagaagggagtggcagcactactagaaatataagtttctacgacacgatggttctaagtggaccgccttag

SEQ ID NO: 32361 - DNA, 371 bp, Glycine max
  Peptide Sequence Number=SeqID_124046
gtgtcagttgaccttcacgataggtggtttggagagtttaagcgagccattagagctgtttttgagacaaaaggttcacgtattttaaaaagtgcaatgaacaagattagaaatggtcaagataaaggaaagtggataacaactaaagttcgagcagccttggacgaacattggggttctacatatttcctaaataagagctccactgccaaggcgaatcgatctattgatagaggagcctcaacatactgtggtggttccatatctactgcaactcactttgaaaagctggagtttcaaagactaccaactgcttgggaggtgatggagaaaactaagaaattgaagtcgagagaatgggtcaatgacag

SEQ ID NO: 32362 - DNA, 723 bp, Glycine max
  Peptide Sequence Number=SeqID_124047
atgttgaaaggttggaaatttgtatatcaacgcagacttgccttagaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctgctctatccctgcattacaaactgtttgaggggacacatgtcccagacattgtctcgacatctgggaaagctgctgcttcaggtgctgtgtccaaggatgctttgattgctgaactcaaggacacatgcaag

SEQ ID NO: 32363 - DNA, 167 bp, Glycine max
  Peptide Sequence Number=SeqID_124048
attatggaaatctatccactattgctttaagtctgaaggaccctgttagtgtgaaggagaggagggaacgttttctgcaggataatcttgtgggctcactaaatcttcctaaggttaaaaattctaccaaaggaaaggttttgatgcaagctatgtatggagttaag

SEQ ID NO: 32364 - DNA, 285 bp, Glycine max
  Peptide Sequence Number=SeqID_124049
atgtcatcacgcatgcattgtatgttggtctcgtcttttgtcacgggaagccggaaggtccatattaccttcttaactgtacacatggggaactgcacccccaaatgcgcaatattggcgatcagaattgccattccttggattatagggttgaaccaagctcatgcttttacgaaaaaggttcatcaagtcaagttgaagtatggaagtaaccatcttgcaaaaattagggcaaaagatggatcgagttacattgctgcttcgtctactgctaagcacatttag

SEQ ID NO: 32365 - DNA, 246 bp, Glycine max
  Peptide Sequence Number=SeqID_124050
atggtcatccgcacaccttttcgcgatccagagacaatcgagtccgatggcacacggagacaaattatgttcatccgcacacttttgctatctggggcaaacgagcccgttgacgtgaagagaccgacatgtcttatgcacctttggtcatccagggacagcgagtcaggtggtaggtggagataccttatggtcatccgcgcctttcgtcaaccgaggggaacgaattcggtggtatcaggatga

SEQ ID NO: 32366 - DNA, 228 bp, Glycine max
  Peptide Sequence Number=SeqID_124051
atggcagtgaaaaaagtggcacgtagcgtgttcgctccatgcctgtattttagggacctacatgggagggagctaaaagggtttttagtgataattcccgaggtggtcatatctctcttcatggtctctagaggtatcatccccttcgaagaacatattgcggcagtagggactactagcaacaatatgtcatcaaagagaaaaactctagatgagggttcactataa

SEQ ID NO: 32367 - DNA, 784 bp, Glycine max
  Peptide Sequence Number=SeqID_124052
ttgggtaacgccagagtttcccagtcacgacgttgtaaaacgacggccagtgccaagcttgcatgcctgcaggtcgactctagaggatcccccgttgataatcgatccgtcggcgggtccgagtccgggttccgtttccattcagactgcaggcgcgggcacgggggattcgggtattcacttgtccgggcctggcgcgctgacggtcgatagcggcgtcacgatctcgaccacgggaggcgggcatggcgtttggctggcgagtaccgccgcgacggcgcagatgataggtacatccatcaccacgacaggcaatggcgcgctcggtttcctgatttccgcttccggttcgacggcctcgctcgaccgcgtgacgattcgaacgtcaggcgcgaatgcatatggcgtggcgctgaacaatggcgcagcggccgccatagacctcaaggatagttctatttcaacaacgggtgctggcgccgatggtctgatgatcgcaacaccgggcaaccaggtaaatatgcagcgggtgacgattacgaccgtgggcgcggtgggcattcgcaaccaaggcggctcgataaatatctccgatagctcggtatcgacgcaaggcgctggtggaatcgggattgcggtcctgggaggagcatttactggcaactccgtgtcagtgacaacatcgggcctcgggggcagcgctattggcatggtcgcgcagggcggcgcgcaggtttccttggcgagaccggtcatcagaaccttggcggcgaccggcattcgg

SEQ ID NO: 32368 - DNA, 262 bp, Glycine max
  Peptide Sequence Number=SeqID_124053
gctctggggaagtcggaataggagagcactcatcttggggtgggtttactacttagatgctttcagcagttatccgctccgcacttggctacccagcgtttaccgtgggcacgataactggcacaccagaggtgcgtccttcccggtcctctccccaacccttggaacatactacagacccaggtggcgaagagccgacatcgaggtgccaaagcttcccgtcgatgtgagctcttggggaagatcagcctgttatccctag

SEQ ID NO: 32369 - DNA, 72 bp, Glycine max
  Peptide Sequence Number=SeqID_124054
atgacgaaaatccaaggcctaaaagctccacatggagctacatcatgtggttctatcatttttcagtcataa

SEQ ID NO: 32370 - DNA, 189 bp, Glycine max
  Peptide Sequence Number=SeqID_124055
atggcgattgggaagattcgtatgcgaaactctcgtcatggctgtcataccctaatttcgtccggggacctttgcttgatgacatacgacttttctttggtccttgtgaggtgcttggcacccatcattaggcaatttgtgaaattccaggacatgccggaaaaccaaaaaaatattgatgcacaatcc

SEQ ID NO: 32371 - DNA, 231 bp, Glycine max
  Peptide Sequence Number=SeqID_124056
atggaggcgactcatatactgttaggaagaccatggcagtatgacaccaaagcaatacatgatggcttcaccaataagatttctatccaacaccatgaccagaaaattattcttaaacctctatcccctagagaaaatttaaagatgtctttcccaaggagattcctcatggactgtcaccttcagaggcatagaacatcaaatgactcttcaatgagcttcattgcctaa

SEQ ID NO: 32372 - DNA, 696 bp, Glycine max
  Peptide Sequence Number=SeqID_124057
atggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacaattagttcaaattctttcagaagcgaatgctttagaatattccattcttgtagcagccaccgcttcggatcctgcacctctgcaatttctggccccatattctgggccgtggcatatcgacaaatgtcattattgttacgccgaccaccaggccgtgaggctttcccaggcgatgttttctatttacattcccgtctcttag

SEQ ID NO: 32373 - DNA, 201 bp, Glycine max
  Peptide Sequence Number=SeqID_124058
atgagaagtcgtggagaagaagagcaggttctgaagatctcccatgaagacaaagcaagtagaggtagaggtagaggtaatggttcatgcctcagaggaggtcgtcagaggccccgagcattctctcataaacttaacgagttgagcaagaaggcagaagtgggagtagcatttcgtgcgttcctgacaattccggtttaa

SEQ ID NO: 32374 - DNA, 693 bp, Glycine max
  misc_feature (54)..(54): n is a, c, g, or t
  misc_feature (113)..(113): n is a, c, g, or t
  misc_feature (150)..(150): n is a, c, g, or t
  Peptide Sequence Number=SeqID_124059
atgagaaagcgccacgcttcccgaagggagaaaggcggacaggtatccggtaancgccagggtcggaacaggagagcgcacgagggagcttccagggggaaacgcctgggggncggagcctatggaaaaacgccagcaacgcggcctttntacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccattgcacgatgaccaatgtcctcctggattatgggcattgcttttatcgggaattcactgacttattaattccaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 32375 - DNA, 589 bp, Glycine max
  Peptide Sequence Number=SeqID_124060
gcttttcgtcttacagacagcaaaaaagaatgtttatacggataaccactcgggtatctccgcccgtcagcgtgactcaaatgtcagtatgacagatcttgtgagcgcggaagatgacggcgcagaagacgacgttcagtctgcgcatgctatcaggcttttcgtcttacagacagcaaaaaagaatgtttatacggataaccactcgggtatctccgcccgtcagcgtgactcaaatgtcagtatgacagatcttgtgagcgcggaagatgacgtaaatctccgggtgtcaatgggcttgtcggccacgattgacgaaggcgcagaagacgacacagcaaaaaagaatgtttatacggataaccactcgggtatttccgccggtcagcgtgactcaaatttcagtatgacagatcttgtgagcgcggaaaatgacataaatctccgcgtgtcaacgggcttgtcggcgcgattgactaagggcgcagaacacgacgttagtctctgcgtgctatcaggcttttcgtcttacagacagccaaaaaagaatgtttatacggataaccactcgggtatctccgcccgttag

SEQ ID NO: 32376 - DNA, 231 bp, Glycine max
  Peptide Sequence Number=SeqID_124061
atgccatatggaaggaggaatctgggtaaagagaagataccgcagctgattgtccaactagcggaagcagtcgggaactggagctggagcgaaagaccagaaccggagctcgcagacgagacagtgcgaagagatgagatgattaagtctgcttcacgcttggctacccgcatcaagaacgcagtggaacggaagaaagaaagaacaggagctattcttgaggattgctga

SEQ ID NO: 32377 - DNA, 309 bp, Glycine max
  Peptide Sequence Number=SeqID_124062
atgcggcatcagagcagattgtactggagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccttaaaactgaaatattag

SEQ ID NO: 32378 - DNA, 240 bp, Glycine max
  Peptide Sequence Number=SeqID_124063
atgatgcacaaagagattgagtctatgtggatgagcatgatcgctaagtccaagactgaggaaagaacatctcgtcaacttgcagaagttgttcgagagactgcagaaataccagttgagattgaaccccgccaagtgcaccttcggggtcaagtcaggaagatttttgggtttcgtcttaagtcagaaagggatagaggtggacccggaaaaggtgaaggccatcctcgagatgcctga

SEQ ID NO: 32379 - DNA, 201 bp, Glycine max
  Peptide Sequence Number=SeqID_124064
atggaagtgtcgcaacgtgcccttcgcgggcgagcgagggcaagactcacgggtgcgctttccaaaggaggaaagatgcgcggagtcgccaccaacgtttatttgtggaaaacgtcggaaaaactgaaggaaaccggtcgacaaaagcggggcttttgctcctacgtaccctcctttggagaggaaatcagacctacgtag

SEQ ID NO: 32380 - DNA, 327 bp, Glycine max
  Peptide Sequence Number=SeqID_124065
atgactgaaaaaggctttaaatacactctcagtataatgtcttttgagagtcaatgtatcaccatgaaggctatcatttactattgctatttggcgttgctgcggaagtgctttgattatatctttgaagcctcaaagtcagaggtactaaatatacaaggtagaaaccagcagactagcagaagcataggtcctacgaatcaggtgatgcaatcctaccccgcaagggcattggttagaagactccaagtagattgggctagagatccaacgaaaggccctagggttctcatgagccttagggtagatttcgagcccatgggctaa

SEQ ID NO: 32381 - DNA, 351 bp, Glycine max
  misc_feature (25)..(25): n is a, c, g, or t
  Peptide Sequence Number=SeqID_124066
atggtcttaacattggtttcacttngaagtcatcatggagactctcttggaaaacttgttgcaaaggctgatgaggctatctttcttggttattcattacatagtagggcatataaagtattcaataaaagaactctgaatgttgaagaatttgtacatgtggtttgtgatgaaaccaactctattgttcaagaaaattctttagaggaagatgcaggttttgaggaaaaggattctactcttgaagatgacatcaaggctgaagaacttgaacaaaacaaagaaatctctacgacaatgtgtaaagaatttcctagagaatggagaactcaaaaattttggataacataa

SEQ ID NO: 32382 - DNA, 885 bp, Glycine max
  Peptide Sequence Number=SeqID_124067
atggattgtttttcaaatgagagttttgaatgcattaaggcatttgaaaactccaatcttattcctttcatgtctttaaaattgcctgtgtactctgatttagtcaatgccttctattccaacctagaaatccaagaaggcactttaatttctgaagtttatgggataaaagtggtcattgaccaatccctattctatgatttaacccaattatccagtgaaggtgtaccatttgcaggtacactgattgatgattggaaatttgacttctctgtgcatgatgttcgccggttggtttgcaccaatcaagcggatatgaccggaaggcttcttaccggttcattggcttttgagagccgcatccttcattatctcattgttcgcatcttgcttccaagatcttcaaaccttgcacaggtttctgaagaagatcttattgttatgtgggcttttcataaaggcctacaaattgattgggcacacttatttcgatatcgcatgcataagacattgcgattaaatgctccattgccatatccatacctagtcaccctcttccttcaacactttaacatccctcttgattctgaaccttgtgttccaatcaagagatcctttctaataggcgttgctgtcattgcatcctttggttatcaaaaagagcatgatggctcttgggtgaaaaaggattcctctcttcttcaaaagattttggatgggttcgatagtcttcaaacctttgttggtgaaaggtttgatactttggagttacaagtagacatgcgtttcaatgagatggagtcaagaatcaccaaggtcgaagaagatgtttcttacattcgtacaagctttgatctaccaccaccaccgccaccatcatcttag

SEQ ID NO: 32383 - DNA, 66 bp, Glycine max
  Peptide Sequence Number=SeqID_124068
atggaaattcttcatcgttcttcgtcgttcttcaccgttcttcatccgttcttcgttcttcaacgg

SEQ ID NO: 32384 - DNA, 864 bp, Glycine max
  Peptide Sequence Number=SeqID_124069
atggcgaatcaagaggagtgggtcccgtttatggacgtattagcattgctaatctttggggttttcctctttccaaacgtggatggtttggtggacctagccgcaattgatgctttccttgcatatcaccatagcaaagagagcccagtggtagctatcttggcggacttatttgacacatttgaccgaaggataggaggcagaacagtcaactggtttccacgatggaaggaaggaaaagagggagttctcttctcatgtgggggctacccaaacatcccgttgataggaacgaggggttgcattaactacaatcccgcacttgctataagacagttagggtaccccatgaggggggcaccgacggaagaaagcctctctcatttccttgtaagagattttggcacgcaaagtttcaaggttatacaaagagtacataaggcgtgggaaagcccgttaaggaaagataaagaacttaggggcatccgtaatggcatcatcggtggttatcatgaatggctgaaagtccgtacacgagggttagattggctctccaggttaaagattatcaacgaagagaactttgaagccccggaagaggatggagaactccgagctctaaaaaccgatctaggaaaagcgagacttgccaaagaaaaattcaagttggtcgctacagacgtccggaaagagtgtgccgggttacgagaagaaaatgcagctaccgcaagagccctggaacaagaaaccaagagggctcgcaaggaagagcatggtcgtgacaaattccgtggagctttgtggggaagcaacagtgagctcaagcttcgaaagggaagagagcgaccaatcacgagcacatag

SEQ ID NO: 32385 - DNA, 228 bp, Glycine max
  Peptide Sequence Number=SeqID_124070
atgacggtgaaaactctgacacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 32386 - DNA, 417 bp, Glycine max
  Peptide Sequence Number=SeqID_124071
atggctacctcaccaaaagaaacttcagctcctggttcaccctctgtaccatcatctccgcaccaggaacaaccagaattcaacatccaacccatacaaataattcctggtcaagcttttgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccaccccagatgttgctgtccctgaagctgatgaagatgtcccaacatcttccaccccgaatgtttctgtgcctaatgttgagaaagatgttccaacatcttccggcccaaatgctgaa

SEQ ID NO: 32387 - DNA, 180 bp, Glycine max
  Peptide Sequence Number=SeqID_124072
atgaagattacgactttcagcctccagttccttttaatggaagaactttcatgggcagtgaccttgtcaaagaatgcttgggcaatgatcattggttatttatggatatctcatcaaagttcttggcctggccggcttggagagtcaagtcttgtatgcagccacgagtcacgactttaa

SEQ ID NO: 32388 - DNA, 321 bp, Glycine max
  Peptide Sequence Number=SeqID_124073
atggttgccgcccagctcgcccaggcgagccaggttgcttcctccagaagcaacagccttctggaggaatcttctggagggcccaagtgggcctgggaaacttacgaatttcgtaacgatacttgttttctttccgtaatgttacggaaccttgcggattacataatcatcccctttttgacttacggaatgttacggaacctcactaattatgcaacgatgcttccatttgatttccggtgtgtcacggaaccttacggattgtgcatcaatattttcttttgtttttcggcatgtctcggaatttcacaaattgcctaa

SEQ ID NO: 32389 - DNA, 159 bp, Glycine max
  Peptide Sequence Number=SeqID_124074
atgggggttcaaatagcaaccaggcccacttgggccttacaggatgttcttctagaaggcggttgcttctggaggaagcaacctagctcgcctgggcgagctgagctcgcctgggggaaggaaggaagaacaaaaatgttcaaccctcctggtatctaa

SEQ ID NO: 32390 - DNA, 159 bp, Glycine max
  Peptide Sequence Number=SeqID_124075
atggcctcctatggtgtggcgtctcctctctctcttcctttatccattccgctgccatttatcttccaagaagcaaaggaatccattgatgaagaagatcctaggcctacaagctctaatggagcttacatcatgtggtatcagagcatcttcatctag

SEQ ID NO: 32391 - DNA, 214 bp, Glycine max
  Peptide Sequence Number=SeqID_124076
ctggccttttgctcacatgttctttcctgcgttatcccctgattctgtggataaccgtattccgcctttgagtgagctgataccgctcgccgcagccgaacgaccgagcgcagcgaggcctaagatcaggccgaagggcgtagtcgatggacaacaggtgaatattcctgtactaccctttgttggtcccgagggacggaggaggctaggttag

SEQ ID NO: 32392 - DNA, 273 bp, Glycine max
  Peptide Sequence Number=SeqID_124077
gtcgactctagaggatccccttcccgaggttacggatccattttgccgacttcccttgcctacattgttccatcgaccagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 32393 - DNA, 288 bp, Glycine max
  Peptide Sequence Number=SeqID_124078
atgccgcaatcagggggtggatcaagaatggggtggtatgtggaaacccaatcccatccgaatggggtcagggtgtggcatcaaatttcagttccattggggattgagggcattttggtgttggggagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 32394 - DNA, 633 bp, Glycine max
  Peptide Sequence Number=SeqID_124079
atggctccgaagaaactctccacgaagaggtctagaagagacaccacaggagaagggtccagtgccgcccccgagtttgatagtcatcgtttccggagcgccgagcaccagcagcgcttcgaggccatcaaaggatggtcgttccacagagagaggcgtgtccagctcaaggaggatgagtatacggactttcaggaggagatagctcacagacgttggacgtcgctggctaatgcttggctcacagaggaaggagtgcgagacatgcgttcatgggtgacgggtcagtggattccctatgacgcagatgctctcagccagttcctgggtgacccgctagttttggaggaaggccaacaatgtgagttcagccagaggaggaacaaggccgacgggttcgacgaggaggccattgcccagctgttatgcacaccggggcaggatttcgcccggaccgctacagggaggcgggtgcggatcatgagcaccagcatgatcactttgacccagacgtggatgacattgctgctcaacaatgtcttgcctagcgatcataactccgatctccccctgcctaagagccagttggtgtatgccatccagacacggatgagcgtccacgtggcccagtga

SEQ ID NO: 32395 - DNA, 276 bp, Glycine max
  Peptide Sequence Number=SeqID_124080
atgatgcgtagttgccaagggagtcgggtctgcttcggcagatccgcaatgacagctggcggcatgtatagagcaaagatccatccacatggtctgcctctgaaagagtcggggcccaaatccttccacagccctcaatctttcctcaggagatcgagcttcctcctttcttcagttgccgggggcggcccttccatagacaaaactattggcgatgctgcgatgttgggttggggcaacgtgcctggtgccggcccttcggggatcgggggataa

SEQ ID NO: 32396 - DNA, 249 bp, Glycine max
  Peptide Sequence Number=SeqID_124081
atgacgaagaacgaacgaagaacgatgaagaacgctggaaaatcttcgcgaaattgcccacggacacgtctcggaagcgttacggaagcgcctcggcttggattttcttcacggaaacaatttttctcactaattttaaggggaaaaagggaggtggttgctgcccagctcgcccaggcgagctgggttgcttctaccaaaaggcaccgccttttgttggaacatcctggaaggcccaagtgggcctga

SEQ ID NO: 32397 - DNA, 528 bp, Glycine max
  Peptide Sequence Number=SeqID_124082
atgaatcttgttgatgattgtgtgtatcataaattcagtaggagcaagagattcagatacaccgagattatctcggggtattctaggattatcacaaaggagtattcaaaaaggtacttaaaaggtttggcatgcaagaatgtaaatccagggatactccagttgctaagggagacaagtttatctcaaacagtgcccaaaaggaaattgaaattcaggaatgagaagtattccctatgcattagctatagggagtttgatgtatgcccaagtagtatgcgtcgatatagcatacatagttggggtattaggagatatttaagacaagtgtccaggaatggtatcattggaaagcagccaaaagagttacaaggatgcttaaatagtttgagatccacttatatttggagcttcatcaaatggatgtcaagacgacaatttctcaatggaaacattgatgagacaatttatatggtgcaaccagaaaactttgtgtcaagagacccaaagaatatggttgcaaactga

SEQ ID NO: 32398 - DNA, 519 bp, Glycine max
  Peptide Sequence Number=SeqID_124083
atggggttgaacgaatctttctctactatcagagaagaaaagcaaaaagaggttggtgcatccacgtctagaacttctgctagtgaggtttcacatgcttttgcattcaagaattcttttgatgcaagagacaattctgataatcgctccaaaggctcttccaagaaccaccccttgtgtgctcattgtggtatgctgggtcatactcaggatcgttttttcaagttgcatggctatcctccaaattataagaagactggatattccttaaaggtcaagaaggaatcttcttcctcctctgaaccatcacacaaggttgctcaccaagtgtctgttgatatgcctcaatcacaaccctcttatgttgacttgggttcacagtttcaacttactgctcaacaatatagtcaattgatgaatcttttacaaagtcatgctaccaatgttgtcattcctcacagtgtttcttcctcaagtgtgacattatacccattcttgccattggttcagtttgcttaa

SEQ ID NO: 32399 - DNA, 614 bp, Glycine max
  Peptide Sequence Number=SeqID_124084
agaaaaagaaggatagtaaggccttgtcttcagaggccaaggagaaggaaaaggaggaaaaggattcctccaagaatattgttaagaaggaaaatcattttgcaacaaaaggtgatattaaaagagcactccttcttaaacaatctttcaaccttctcctatcaagggaaacatcccttagcaccgccatacctcttgagcttgaggttattcctcaagcaaaggagttgttggatgagggtttggtttacaagagcttaaatccttgtgctttgttggtgcctaaaataggtattattaggcaccaaatccctatgataggtggtatgatgaatgtgttgagtggtgcaacactcttttggaaaatcactcacgcacccaacatcttcatgatttgtgtacatagggactcattaggtaggaataatcaacatgaaaataaagaaaaaggtatgttttattccattactttccttaactttttaaatagtgatcaagggcttcccatggatcctaagagaataaaggtcattcctgagtggcctactccaccaagtgtgaggaaagaatttaatgagttcaagaatgatcgaggtcgtacccgaatcaaataa

SEQ ID NO: 32400 - DNA, 601 bp, Glycine max
  Peptide Sequence Number=SeqID_124085
gctagaggacgagtatgcaaaggtatcagtcctgcaagcagaaagggaagcgagggagaaagtgatcaattcattgcctagagaagcaatgatgtggatggataggttcgttttcaccttgaatgggagtcaagagcttccaagactgctagccaaagctaaggcgatggcggacatatcctacccatccctctgccataaaccaagcaaaccaacccaccccgaacatggtgggataaggaggggaggtgttgggcagtaccggtggtccacacatgggcaaccccaacctgtaggaggcgcccatgaagaacctctgaagcgtgctcaaggggacttcgacccatgtcccactttcaccgccgagggatcgacatgcaatgctatgcctcaacccaataccgtgggggttcctcaaccccgccctttgcaaccgctgtatttctcaataggggggtcgcctctggtagaggaagggagagagaaacttgatctcattgtagagagattaagggctatcgaagggtttagggattaccctttcaccgacatgataaaattgtgtttggtacctaatgttgtcatccctccaaagttcaag

SEQ ID NO: 32401 - DNA, 315 bp, Glycine max
  Peptide Sequence Number=SeqID_124086
atgggggtgcaaatagcaaccagggccacttgggccctccagaagattcctccagaaggctgttgcttctggaggaagcaaccctgctcgcctgggcgagctggggggagaagtgaagtgaaaaagggttcagcccctgaggcacttctctctctttcgaatttgcttggaaaaattgtttccgtgaagaaaatccaagccgaggcgtttcccaaacgtttccgtaacgtttccgtgaggaatttagtgaaggtttcgaccgttcttcgacgttcttcattcgttcttcatcgttcttcaatcttcaacgggtaa

SEQ ID NO: 32402 - DNA, 288 bp, Glycine max
  Peptide Sequence Number=SeqID_124087
atgcatgaggacgaatggcacggagcgtgtttgctctttgcccctatttgggaacctataggacaatatctaggggtctctaataactactccccaacaattcataactcacacggctgttttctagaggtcgacaaaagcggggctcttgctcctacgtaccctccatcgaagaggaaatcagacctacgtagttcttctttaagggtgaatcacacgatttctttttacttgaaaggtgatcatttaaaggtgttggaccttaaaaatgatccattaacttggtaa

SEQ ID NO: 32403 - DNA, 320 bp, Glycine max
  Peptide Sequence Number=SeqID_124088
gatccccctacggccgtggaggatttaaacgaagagcaacaaccacctgctgaagaagttgttactgatgttgaggatttttcagtttggaatggagaggaacgtcttaagctgaaactatcttcttatggaaggaagatgactaagttcgggaggcctgctccaaagattgaaggccttgtggctgccatcggactaaaggtaactatcaccttggatgatgtggcgtcgttgctacatttgcctatcgtaggggcgttccatagcttcgagcaacttcatgtagacacgctgtcaatatgttggtggaattactcgag

SEQ ID NO: 32404 - DNA, 324 bp, Glycine max
  Peptide Sequence Number=SeqID_124089
atgggtgaagtaaaggaggtgcaagagcagatgaaggccgacatggatgccatgaaagagcaaatggccacaatgatggaggccatgatgagcatgaagaagataatggaagccaatacggttgcaattgtcgctaccggcgctgttgctaaggtgaacccgacgcccccatctggcctcaaccaaatgaatcattcaaccttagatatggtaggcaaagatttgggaagtacgggcgacccccattatgtgcaaattcaaaacaagcatgccttcccgccatatggcttgcctcccaactatacaccacccaatgtgtcgtaa

SEQ ID NO: 32405 - DNA, 346 bp, Glycine max
  Peptide Sequence Number=SeqID_124090
atgactagaggcaatccaggtgatttacaaccctttgatcctgaaatagatagaacctttcatagattacttaggcatagtgtgcatcctgatcatcctgtgcattttgagcattctgagtattttgttgttggtgattctgaacattttgattttgagcattcgactactaattttcatactgagaacatggctcaacctccaccttgtgagaggactcttagggagatggttgcacctgatttcacttatgaaagcttgtgcattcaatttcctgatgaggatgttccatatgttctcaagactagactaatatatttgctgcccaagtttcacggtcttgcag

SEQ ID NO: 32406 - DNA, 225 bp, Glycine max
  Peptide Sequence Number=SeqID_124091
atgacggtgaaaactctgacacatgcagctccgagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 32407 - DNA, 222 bp, Glycine max
  Peptide Sequence Number=SeqID_124092
atggagaaaatagttataatgtttgttttcaaggctaaggtaaccatcacgaagcttaatgaggagaggcgcaggaccactcaagaaaaagatttactgctgcggcaggaggaactagacaatttgttgttcagaatttctcaaatttctcaaatttctccattgggtgttcattcatggcttttggaagatgcaataagcaataaatatttacttatctga

SEQ ID NO: 32408 - DNA, 354 bp, Glycine max
  Peptide Sequence Number=SeqID_124093
atgcagctcccggagacgtcacagctgtctgtaagcggatgccgggagcagacaagcccgtcagggcgcgtcagcgggtggcggtgtcggggctggctaactatgcggcatcagagcagatgtactgagagtgcaccatatgcggctgcgcaactgtggggaagggcgatcggtgcgggcctcttcgctattacgccagctggcgaaagggggatgtgctgcaaggcgattaagttgggtaacgccagggttttcccagtcgactctagaggatccccggttcaaacgttgcttgtgggaagatcaactttgaatttggatgatgtgactgtcgctcttaaagaaaatgagtga

SEQ ID NO: 32409 - DNA, 177 bp, Glycine max
  Peptide Sequence Number=SeqID_124094
atggaagcttgcttgtggggcttctatggaggttggatctttgagcttcaatggggtcctttaatggtgattttccaccatggagatgcagcggaagacaaaggaaaagagggggagtctaagaagatatcgggaatggtgtcaagaatacttgtaaagtcaggagtggctggttag

SEQ ID NO: 32410 - DNA, 376 bp, Glycine max
  Peptide Sequence Number=SeqID_124095
atggcagaatctttgaagaagcgaaagggatcatcctccaccaccgctgctgctagccatcgccaccacaaaccatctgaagcacccacagcacctattcatccttccttatcatctccaagatcatccactctgttttcttcagatgatcaacgtctacggtacctttctcaattttcttctaggatcattctagaccctaagtacctagacatagatttcttcaatgatgagacatttgactgttatcaagtgtttcaaaactctggattgattgatttcatgtctttaaaattgccttactatcctgaacttgttaaagtcttttacaacaatttaaaaattcaagatggtattatttcttctgaggtgcatg

SEQ ID NO: 32411 - DNA, 366 bp, Glycine max
  Peptide Sequence Number=SeqID_124096
atggattcctcaagccacagtccatttagaggtctgggcaatcgtagtttgagactgaaaagttacataaagagttggatgcagagttcaaaacacgatgtctatcttggagcctacctgaatggcggatactggcagatggtggtcattgtgcccaaggaacacctagttgtctggttttgttcattgcataacaggccagacaactaccttaagggaataattaacagtctaaatcaaaggctcctgctaggtggattgtcgttaagtgtaatagacaaaaaaggaagtactgagtgcggctattatgtcatgcactggatgtccaccatcattttagaaagtttcaggaataactgggaagcg

SEQ ID NO: 32412 - DNA, 363 bp, Glycine max
  Peptide Sequence Number=SeqID_124097
atgttggacatctttatcagcatcagggacagaaacatttggggtggaagatgttggaacatctttatcagcatcagggacagaagcattggcaaaatgctagtcacgatactgcggatcttcttatccatctccgtgtctacttccctaggacttgttgcaaggctaggtttttcaggaacaggggctggaccaggaatcatttgtatgggttggatattgaattcaggtcgttcctggtttgatggtgctgaggtggatgaaggagatgatggtacagagggtgaaccaggagctgaagtttcttttggtgcggtagccatggagaagcagagcctttggagtggtttcgtaaatctctga

SEQ ID NO: 32413 - DNA, 186 bp, Glycine max
  Peptide Sequence Number=SeqID_124098
atgattggtacctcaaagccttacactggggcaatgaggggcaccgtgcatgagcctcaagggggaggggacaaaccctggaatttcaatggattgattaaacgtcaaacgaattcattgccgtcactccaaaatggtcaagtgactaaatcaaacagaacatacactctgagggagttcccgtag

SEQ ID NO: 32414 - DNA, 396 bp, Glycine max
  Peptide Sequence Number=SeqID_124099
gcattacgagtcaatgcacctcttccatatcctcatcttgtcactttgtttcttcagcatttcaatgttcttttagaggatgaaccttttgttaaggttaaaagatcctttgctattggtgttggtgctattacctccttcggataccagaaggatatggatggccaatggggtacatcctttgtggtacaagtagagggtacatctacttgggttgttgtaactgagaataagagagggtacatctcctgtggatcagttcaagtggagggtacatccacttggttgttcaaagagaacaagggagggtacatcccttgtggatctttgcttgtaaaggattttacaaggttgaaaagaaatttcaaggaccgtacggtcgcttggggactggat

SEQ ID NO: 32415 - DNA, 399 bp, Glycine max
  Peptide Sequence Number=SeqID_124100
atggaaaaacgccagcaactcggcctttttacggttcctggccttttgctggcctttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 32416 - DNA, 192 bp, Glycine max
  Peptide Sequence Number=SeqID_124101
atggcggttccagagtcagaacagatgcagagacaagatgaaactaacaagaaacaaggattagggtttcgttctctaccgaaaccgcaagccaagttggaagattctgcttcggttgaagggttcctcttggtgtggggtttcaatggagaacaacgatggtttgtggtggctaatggtggctgtgggtga

SEQ ID NO: 32417 - DNA, 201 bp, Glycine max
  Peptide Sequence Number=SeqID_124102
atgtcgcaaatcccaacggtggtcgtgtgcgcaattgaatttcgaacaacatatccaaatttcatattcccaacggtgaacgagtccgagatcgtcgtttttctgagacaagttaggtggcctgcggaaaaaagagaggattttgggagaagagagaagaaacgaaattgtgaggttgaggaggctgaggagtcagtctga

SEQ ID NO: 32418 - DNA, 513 bp, Glycine max
  Peptide Sequence Number=SeqID_124103
atgctcaacatcttcctcggccactttctcaacgccgccttcctcaacgtggtgggcgagcgcggtgaagcggtgatcgtgaagtccgagcggaccagctcgacgatgaacgagcagtacatctggcgctacgaagcggtactgcgcactgccgaaggccgcgatgtggaagtggtgttccacaccaacaccgcctcactgtggccgctggagaatgccatccgcatcccggcgcccgaccagccattcgtggtgaagtacacgccgggtttcccgcgcaacttcgtcatcctcaccaacgaatccccgcacggcatcgcccaggcccgtgccactgcgcgcgagcgcgtggaggtggcggcacgcaagctgcacttcagcccgggcaatgccggtttccgcgcggactatcgccgcgagctggaaacctggctgcgcgaccacggcaacgatccgcagcagcagcccgacgcgctgcgatatcgcgccgaactcgacgcgctcgaccgctag

SEQ ID NO: 32419 - DNA, 384 bp, Glycine max
  Peptide Sequence Number=SeqID_124104
atggctatgttcgggaggcctactccagagattgaaggccttgtgactgccagcggactaggttctttgatcgaaactagtagtttccatttgcccgtcagagaggtgactatcaccttggatggcgtggcgtcgttgctacatttgcctatcgtaggggcgttccatagcttcgagcaacttcatgtcgatgacattgtcaatacgttggtggaattactcgagtgttggatctacaaaaatttcccgtctgttggttctgccctaactaccgaggattatgacaaaaggagaccacgtgcaagccaatggatctctagcaaggcattacccgtgtcaacgtatcgtaggcgtctagacagactgacccctgatgttgtgtga

SEQ ID NO: 32420 - DNA, 585 bp, Glycine max
  Peptide Sequence Number=SeqID_124105
gactccttagaagagcaggtaacgcagggctcatttgtaccccatggtcggcaagacattctgaacactgcgattggccgacctgaccatgggggtcgcgttcgggcagcaggctcaggtgtcactattactcagtactacggaaaggcatcaaggacatgcagcagctcatccacatccatcagccaacaacaacttgatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttgtcaaataaaggatccccagagctactccaaattcagtcggacatacaacaagtagctgcgcgtgtcagcacacagggaagtaatgttgttaccaatgtccaggcttcacaagaacatcatgctgatgccataccattgatgggactgtatgtgcagcttaaggatggtacaacaaggtttgtagaaatattaccttacttacaattaactcgggggatgctctag

SEQ ID NO: 32421 - DNA, 1002 bp, Glycine max
  Peptide Sequence Number=SeqID_124106
atggcctctaggaaacgcaagagtatcgataatgtcctggggagaaacatccagccagagaggaaggtggagctctaccatactgagtttgatgattttaagactgagttggagaggcgtaatctccataaacgcctcaccaatttggttgatgggagcatagatttggctttggtgaaagagttctatgaaaacctatacttctctaatggaccttcaccaaagcaagccagggtcagaggccatctagtgaagatcgacgctgatggcttcaacacattcctagagacacctgtggtgttggtagagggtgagactttgcccacatacttcagatactgcaggctgccttcagatcctagggagattgaggctgccctatgcataccaggccgagggttcatcttgaatgctaagggccatcctgggaggatcctgaggaaggacctgacaactttagcccaggtgtggagtgttctctcatactccaacctggcccccacatcttacacatctgacctgacagtggacagagctaggttgatcttttgtctagtctctcatatggacatgaacataggagctctcatttctggccagatgacttctatagcccaatctaactcttctagacttgggtttcctactctgattatcgccctatgtagagccagaggggttgtctctgacagcctcacttttgagcgcctgtgcccgatcattaacttggcctacatcaggaagaactgctggaatccttatgatctgacagtttttatccgaggggctagaagggcgagcgcgaggccagttgagcttccttccacatctacagctcctactccagcatccacttcaatagctccttcagttccagctcagactgattctcagtgctttgaagccatacttcagagcattcatcagggacagatcattttacttcagagtttacaggtggtgcaccctctaggatccattccttctgtgagcagtttctga

SEQ ID NO: 32422 - DNA, 339 bp, Glycine max
  Peptide Sequence Number=SeqID_124107
atgttgcttagcaaacattctgtccagggaccgcaataccgatctccccctgcggaagtatcagttggtctctgccgttccgacatagggatcgtgcccacaaggcacccagtggactcggaggagcccaacgggaccctagggtttcaagctctggttacgggccccgatcagtcctaccggatgcccgtccccccagcgagggatcacgcccgcaagacacccagtggacccaaagaagtccaacagggtcctagggtttccagctctaattacgagcctctgttagttctacggagtgcctgtcgcccccagcaagttcatcagcccccctattaa

SEQ ID NO: 32423 - DNA, 111 bp, Glycine max
  Peptide Sequence Number=SeqID_124108
atgaactcgctaagcgagcatgctgcgctaagcgagttcatcagtactcattgttcacgcgctaagctgagcttgcttgggccaagcgcgatttgttgcggcatccgctga

SEQ ID NO: 32424 - DNA, 741 bp, Glycine max
  Peptide Sequence Number=SeqID_124109
atggagaggagtatgattgatgctgccagtggtggagcccttggtgatatgactcctgttgaggataggaatttgattgagaagatggcttccaactcccatcaattcagtgcaagaaatgatgttattgtccttagaggagtccatgtggtggccacagattcatcttcatctgctgaaaataaaaagcttgagggaaaacttgatgccttggtcaacctagtaactcagcttgccatgaatcagaaatttgcacctgttgctagagtctgtggtctatgttcttctgcagatcaccatacagatctttgtccttctttgcagcaatctggagtcaatgagcaacctgaagcttatgctgcaaacatttataatagaccccctcagcagcaaaaccaacaacaacagaataattatgacctttcaagcaacagatacaatccaggctggaggaatcatccaaatctgagatgtacaagtcctccacaacaacagcagcctgtccctcctttccagaatgttactggtcgaagcaagccatatgttcctcctctaatgcagcaacaacagcagcaacaacaaacacaacatgcaactgaggcccctcctcaaccttccttagaaaagttagtgaggcaaatgaccatccagaatatgcaatttcagccagagacaagagcctccattcagagtctgacaaatcagatggggcagatggctactcagttgaaccaagcttag

SEQ ID NO: 32425 - DNA, 598 bp, Glycine max
  Peptide Sequence Number=SeqID_124110
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaggcaccttgtttaatggtctgcttcttcaacccacttctgttacaaagccctttgctattcgagcattctgtgatgctgactgggcattagatgtggatgacagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 32426 - DNA, 510 bp, Glycine max
  Peptide Sequence Number=SeqID_124111
atggcttgcgacctcattcgaaagttacttgatgcctccgctggtggaaagatcaaattgaagacacctgatgaagctatggagtttattgaaaacatggcagccaacgattcatccaaagaagtaaactacatggccaatcccaattgtcaagggttccatcacagaggacctcctggctacaatcaagggggaaatttttctcaaggccaaggttggagatcccatcatgggaataacttcaacaaggatcaaggtggcccatccatccgaccttctaatcaagggcccaacatgtatgagaggaccaccaagctagaagaccctctgactcagtttatgcaagtgtcattatcaaatcacaagagcactgagtttgccatcaagaatctagaggtgcaagtggatcaactagccaagcaactggttgaaaggtccacagggagttttgtggccaacactaagaagaatccaaaggaagaatgcaaggcagtccttaccagaagctag

SEQ ID NO: 32427 - DNA, 318 bp, Glycine max
  Peptide Sequence Number=SeqID_124112
atgctgacatctccggaaagggtgcagatgaccacattggcctctgcttgtcaatcgaacttggggtctccgaatgacgaggtgtggataaccggaaggtgtctctgcatgctatcagactcttgggtcaggatagcaagaggtggggtggtcgacaaaagcgaggcttttgctcctacggtttatggtaagttgggattttggctcaaggcttgtagaacggctgaacatgatatatgtcaggatgttggtttggccagcggtttagggaaaaaggagatgtctcacattatttccatgatacacatgcaacactga

SEQ ID NO: 32428 - DNA, 351 bp, Glycine max
  Peptide Sequence Number=SeqID_124113
gcaagcgagccgttgacacgcggagattacgtcgtcttcggcatagactacctctggcaaccactaacccgtgagactaacgtcgtcttctgcaccctttgtcaaccagaggcaagcgagcacattgacacgcacataacgcctgatagcttgcagagactaacgtcgtcttctgcaccctttgtcaacatgaggcaagcgagcccgttgacacgcgagatttacgtcgtcttcggcgcagactacctctggcaaccactaacccgtgaggagggcaagcgagccattgacacgcggagatttacgtcgtcttcggcgcagactacctcttggcaagcactaacccgtgag

SEQ ID NO: 32429 - DNA, 468 bp, Glycine max
  Peptide Sequence Number=SeqID_124114
atgagattccttagtgggcaggcacttcacacttcttgcttggccgacacatctggtcaagtctttatcacagcaggtagttgtgtctccgtcaaaaccacctccaaagccagatccggaggggaattcgatattgaggattccgagccacaccatggtcaaagtcgtcccccatgggcaatcgtcaggattctgagtcctgaaagttacatagagacttggatgcagagttcaaaaccctggatgtcctatgctgtggagccactaaagggaaacgatcctgagaccggtgactctgataggtgcggcttgtacatagaagcagatcctgcacgcctggttgccatcgggagagtttatgagggatccactgttgttcatagcactcctttgttgcctggccaagtaaaggtgagtgtggaggaggttagagatgcagatgctccagttcctgtacccactgatgag

SEQ ID NO: 32430 - DNA, 578 bp, Glycine max
  Peptide Sequence Number=SeqID_124115
gtgccactgggagacgaagcagtttccatcttcctgtgggggaggtaaccatcatgctggacgacgtggcatctcttcttcatttgcccatcatgggcgagttccataccttccaacctctgcacgtggacgaggtggtgctgatgttagtcgacttactactagtctcaccagaggtagccaggaccgagacaggacattgtcatggaccagtgcaacctatgttcatgttgtgttcttggatgctctgcgtgaccttagtcagtctgggaggtatacatggggagctactgccttggtgcctatctacgatcacctgaatgatgcttgcatcagcaccggccaacatgttgctgaatacgatgaaaagcatatccacagagacgtacaggaagtgcctggatcgattgaggattcccgatgtctgctggatgccatatggggagcactgacagagagggtcatgcgccagtttggatatgtccagagtatttctaccccgcctgtcgattcatgggtgtcatttgatgagataaacgacaggtggatgcactactcaaaccatcttgcgctagcag

SEQ ID NO: 32431 - DNA, 381 bp, Glycine max
  Peptide Sequence Number=SeqID_124116
atgtccaagttgcttgagatgttagaagccgataggcaagagaacaaagctcaattcgaaactctagaggctgcgatggactcattgctaaaaccgaacaacaactctggcgtgaatcttcatatgaacgtagcgggaaacaactccattggaggttcaccatttccaccgtttcaggtgtgcaatgtgaaacttgactttcctcatttcgatggatctgaagttcttcagtggattttcaaggctgagcaattttttgactactacaacactccggatactcaacgtcttaccattactgcaattcacacggagggatcctctagagtcgacctgcaggcatgcaagcttggcactggccgtcgttttacaacgtcgtga

SEQ ID NO: 32432 - DNA, 597 bp, Glycine max
  Peptide Sequence Number=SeqID_124117
atgaccaccctgactcagatatggatgactttgctgctcagcaacatcctgcccaccgatcataatttcgacctccccctgccgaagtgtcagttggtgtacgccatcctgacgcggatgagcatccatgtggctcagttaatcgctgatgccatctatatttttgcaggtatggcgcctaccaggcaccctctggaccctgataagtccaacaaggccctgggatttcccgccttgatcacgggactctgccagtcgttcggcgtccccgtcacacccagcaaggtcgcggacgcgccgccacctcatcaggctggcccagccggattgtttgatacagagcagtatttgcggcatttggttcgccagcaggcggccaaccaccgggcacatagccagggctttacttcttttccgtgccctactctggaccagttcagggcagaggtcgaatggcctggagattggcctgaggcccaggcaggagaggcaccagcaggggcaccagcagaggctcccgacgaggcagatgaggcccgcgaggacgaagagatgactgatttacttgatttcttaggagggagcggggccacatga

SEQ ID NO: 32433 - DNA, 240 bp, Glycine max
  Peptide Sequence Number=SeqID_124118
atggagaaagagatgatcacaataatagtagacacattaccagtgttttactatgaaaaaatggtggggtacgcaccttcaagctttacggatttggtcttcgtcgaggatgagaatgagggagaaacccttgctatgactgtcattcctacacggtcaaatttcccatcagcccaacaatgtcattactcagccaataacagtccctctcacccaatcatccacaaaggtcatccctaa

SEQ ID NO: 32434 - DNA, 109 bp, Glycine max
  Peptide Sequence Number=SeqID_124119
accaaaatcttgcttaaggccattgatgaccagttcatcacttcagataaggctttagcaagcaccctgatcacgaagttctcctctcttcgactcactagtgtgaaag

SEQ ID NO: 32435 - DNA, 207 bp, Glycine max
  Peptide Sequence Number=SeqID_124120
atggaattctctgtaagagctgcggaactaacaactctattagaaagtagaattaccaacttttacactaattttcaagtggatgagatcggtcgagtggtctccgttggagatgggattgcacgtgtttatggattgaacgagattcaagctggggaaatggttgaaaaaagacataccaactaccaacctacctttagggaataa

SEQ ID NO: 32436 - DNA, 107 bp, Glycine max
  Peptide Sequence Number=SeqID_124121
atggctggacggaatgatcgtgcgatatcggatgcccttcaagccttagctcaggctatagggaatccgaatagaggagaaactggtggagttgttgagtacctggg

SEQ ID NO: 32437 - DNA, 720 bp, Glycine max
  Peptide Sequence Number=SeqID_124122
atggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacagttactcttttattttatttgttgggaaatgatccccaataacagttgttgcgagggttgcccaaaggcaatatataaggcatacccagtaaaacttacaagtaaaccagatatagagatggcaattagggttgctgtttccattattagaattctaaagtttcaagatcacaatagatctataggataa

SEQ ID NO: 32438 - DNA, 87 bp, Glycine max
  Peptide Sequence Number=SeqID_124123
atggcgagggcgtgtagccctctgagggtgaggacgtgcggtcctctgatggcgaggacatacagtcctctaaaggtgatagattga

SEQ ID NO: 32439 - DNA, 552 bp, Glycine max
  Peptide Sequence Number=SeqID_124124
atgttggtgcgcatgatccgcactcgtctctttgcagtggcacgggtgaaatcttgccccgatatgcatagtagctgtgtgatagcctccctctctggttgtgctcgcacagttggccctcctccaatatcagggggtggcccaggaaccgttaaaaggaaactactggtgtggatatggagcccactgaaagtgaggacgcgtagccctctaaaggcgagggcgtgtcgccttttgaaggcgagggagtgtagtcctatgatggcgaggacatgcaatcctctaaaggtgagggcgtgtagccctacaaaggtgaaggtacatgaccctttgaaggcgaggacgtgtagtcctttgaaggcgaggacgtgtagtcctctgaaggtgagggcgtgcagccctctgttggcgaggacgtgtagtcctccaaaggtgagggcgtgtacccctacgaaggtgaggacatgcagtcctctgatggcgagggcgtgtagccctttgaaggtgaggacatgcagtcctctaatggcgagggtgtgtagccctctgaag

SEQ ID NO: 32440 - DNA, 277 bp, Glycine max
  Peptide Sequence Number=SeqID_124125
gaaatctctccaagtttgggctcacattcgtgatttggctcttttccgtaggcgtttcacttctttacagtgcattactgactctttaattaggggcagatccaaatcaggtgttcaaggaaaattacattgtttggctatagcaattacagtctactacatctggctgtctaggaacaagctgatttttgaagattatcaattttctgtaatagagattattagcaagattaagtctcttatgtatagacaagcgcacctgttgcatttttcttag

SEQ ID NO: 32441 - DNA, 339 bp, Glycine max
  Peptide Sequence Number=SeqID_124126
atgcaaaaatctggtccagttcctgtacccactgatgaggtagttgtgtctcctgcaaaaccacctccaaagcccgatgatccgctttatctgatgacattgaccatcccagagcttttctcgaggccttatcaggttagatgggatgccaccgtgttcggggtctttaatccagatttccccctctacataaagcacgaagacctctccaaaatcgcacacggtggtcaatgtctcagcatatcagtgttacagttgtggattttgaatctcactgaaacatgtatgcgagcggggaattctgatatctatggatacctcgagccacagtccatttag

SEQ ID NO: 32442 - DNA, 621 bp, Glycine max
  Peptide Sequence Number=SeqID_124127
atgggtgatcaagaggagacacaggaacagatgaaagccaacatgtcggctttgaaagaacaaatggcttccatgatggaggccatgttaggaatgagacaactcatagagaaaaacgtggccaccgttgccgttgttagttcggctgccgaagcagacccaactctcctagctaccgcgcaccatcctcccccaaacgcggtaggacgagaaaggagcacactggggcacaccagcaacccccatttgggatacaaccaggtggcttacccttatggattaccacctaattacatgccgccagccatgcataatgacgcaggtcatgtcccttcccccacccttgaaggggagcctcctcgacagcccgacgaggttcacgaggatcatcgagagtatgcccaaggggatgtcgatttctaccccccaatccctgtcgaggggccggcacccaacacattgcctcagcacaaccccacagcacaaccaatattcttgtccacagaaggaccacccctggcggcggaagaaagaaggaaactcgatctcctcgaggagagattgagagctgttgaaggctttggtgactatccgttcaaggacatgatggatctttggttg

SEQ ID NO: 32443 - DNA, 585 bp, Glycine max
  Peptide Sequence Number=SeqID_124128
atgttgtgttggccattttttgcagatcagccaacaaactacagatatatctgcaatgaatgggaaattgggattgaaattgataccaatgtgaagagagaagaggtggagaagctggaagatatagccgtgatatttagcaaggctgacaagaaaaattctggaaaattagatcttaaagaatttaaagaagtttttggcgacattattgagaggtatccacaagtgggcatttatttaaagaagaaccaaatgaaagacatggccagcttgctaaagaaatctcaagaaagcaatattatagtggagattgaatactttaaagaagccctttccaaagtagactctcagatgaaaaatcttcctataacagctcaggtagcttcacaacaaggagtctatcttgcaaactatttcaaccgcatggaggagtgtgagaagtatctagaaggccctctcaggttcaggggagttggacaccatcgattccgtcccttcaggtgtgtgtgtgtgtgtgcctgtgtgtgtgtgtgtgtcaacaacacaagctggatttcaaagatagctttaggggaggactattga

SEQ ID NO: 32444 - DNA, 210 bp, Glycine max
  Peptide Sequence Number=SeqID_124129
atgtaccgggacaaatacctaataccgatgacttattcgatgttgatttgcgtcacgcattttctgcggaggctgacgaagaagaagcggggaggcatcggggcagaagaaatcctgatcgccaagcacgaagatgggatcgaccatgtggcacatcctcacggcatcacggacaccaaaatgaatgatttgcatgtctccgtttattaa

SEQ ID NO: 32445 - DNA, 179 bp, Glycine max
  Peptide Sequence Number=SeqID_124130
gtttacagtagacctagtatggagcactggcacgctatgaaaggcgatgcagattggaacactctttcagataattccaaagcaaccagcggctatatatttagcatagctggtggggctgtttcttggctgaaggttaccagtagacctagtatggagcactggcctgctatggaagg

SEQ ID NO: 32446 - DNA, 1170 bp, Glycine max
  Peptide Sequence Number=SeqID_124131
atggtagaggaatttgaagagatcctaggatgtcctctagggggaaggaaaccatacctcttctcagggttctatccctcattagctagaatttctaaggtagtccaaatctcagcgcaggaattagaccacagaaaacaagtcgaaaatgggttggttggaataccgagaaaatacttggaggcaaaagcaagaatcttggcaggtaaaggcaaatgggccccattcatagacattctcgcactgttgatcttcggaggagtcctatttccgaatgtgaatgggttggtggacctagcagcaatcgacgcttttcttgcctatcataaccacaaggaaaacccggttgtcgctatgttagccgacctatatgacaccttcaaccgaagatgtgagaagagcagtacgaggattaatgccaccgttcatgcactagagaaaggaggggcaaattgggaccaactcttagcaaacaaagaaggagcgtctatcaactggttccctcgatggaaacaaggaagagttggagttcttatttcgtgcggaggatttctgaatgttcccttgatggggacaaggggttgcatcagttacaatcccgttcttgctataagacaacttggctaccctatgagaggggcaccactagaggaagagatcgcacctatcatttcgcgaggtttcaataagaccaacgtggagacacttcataaggttcgcaaggcatgggaggtggtgcgaaagaaggacaaagaactcaggggcagtaacaatgggcccatcggtggctaccataagtggttgagagcccacgtgcaaggtttggattggctaccaagtttgagaaccgctaaaagggaggaagttgaggcatcggaggaagacgaagaagtgcaggcccttagggcggaactcaagcaagctcaaacagtcaaagaaaggttaaaatcagcagctctgaagatccgaaaggagaatgccgaactgagagatatgaatacagttaccaccaaagccttggaacaagaaaccaagagggctcgtagggaagagcatggccgaaacaagtttcgaggggctctgtggggcagcaatagaaagcttaagctccggagagaggaaagggaccaatctcgagtagacagtttgatcttgaaagatgagttgaag

SEQ ID NO: 32447 - DNA, 622 bp, Glycine max
  Peptide Sequence Number=SeqID_124132
ggctgcacggcctcaccttcagaggactgcacgtcctcaccttcagatggctgcacgccctcgccttcagagggttgcacgtcctcgccttcaaagggcgacacgtcctaaacttcagagggttgcatactctcgccttcagagggctgcacacccttgccttcaaagggcgacgcgccctaaacttcagagggctgcacgccctcgcctttagagggctacgcgtcctcactttcagtgggctccatatccacaccttaagaggatttaaggcgaccaactgtgcgagcacaaccagagagggaggcaagatttcacccgtgtcgctgcaaagtgacgagggttgcgcccacaagacacccagtggacccggaggagcccaacagggccctggggttttcagctcgggttacgagcctctggtcttggagttgccagctctgattacgggcctctgtcagttctacggagtgcttgtcgcccctagcaaggtcatcaggccccctactaatcgagctttcatcaagaagtactatgcccccaggcaggcgcagggcgaaacaccacagcagcctggggatggccggcagtgggcaatagacgcaccgccaccacctctaga

SEQ ID NO: 32448 - DNA, 204 bp, Glycine max
  Peptide Sequence Number=SeqID_124133
atggtggtcatcttgcccaaggaacacttagttgtctgtgctatcaagggtcttgatgatgctccacagcctaaatcaaaggcttctgctaggtggattgtcgtcaagtattttaacgatccaagaccattggagccagagagattaaaggcattgcggatccagtgggcacaattttatcttcgagttagagatcaggcctag

SEQ ID NO: 32449 - DNA, 478 bp, Glycine max
  Peptide Sequence Number=SeqID_124134
ccgcatcctccattaccttattgttcgcatcttgcttctgagatcttcaaaccttgctcaggcattgcgattgaatgctccattgccttaccctcatcttgttacccttttccttcaacacttcaacattcctcttgattctgaaccttatgttccaatcaagagatctttcctcataggcgcttcagtcatagcatcttttggttatcaaaaggagcatgatggttcttggatgaagaaaggtgctcgacatgttggtgaagaaggacatgatggagaagattcatctatcctttcaaagattttagacatgtttgatggtcttcaaacctttgttggtgagaggtttgacaatttggaactacaagtggatatgcgcttcaatgaaatgaagtcaagaatcacaaaggttaaagaagatgtgtcttacattcgttcaagctttcatcttccaccaccaccgccaccatcatcttag

SEQ ID NO: 32450 - DNA, 535 bp, Glycine max
  Peptide Sequence Number=SeqID_124135
gtggaggttgacctgctttgtgacagatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgcaaggctactagagaaggggtgaaaccagccaagggcgggctccaaggcgacaatagcaatcgagtggccaagc

SEQ ID NO: 32451 - DNA, 210 bp, Glycine max
  Peptide Sequence Number=SeqID_124136
atggcacgtaacgtgtttgctccgtgcccctattttagggacctacaagggagggagctaaaagggcttttggtgatatttccccaagtccccagtggagtcgccaactgtgcaagcctacccttgggaggggagcgtgctaaactcgcgaaagggatgcgtgttccacgaaaggaattctacgcagcggagtcgccacaatcttactag

SEQ ID NO: 32452 - DNA, 1131 bp, Glycine max
  Peptide Sequence Number=SeqID_124137
atgggacctctccaaatgcaagccttccgcaaggcgtacggaaagattttagatttgaccatagcagagatatccacagaagccgttgtatcactcacccaatactatgaccagcctttgatatgcttcacatttggagacttccaattagtaccgactgttgaagaatttgaggagattctgggatgtcctcttgggggaaggaaaccatatcttttctctgggtttcttccctccttgagcaagattgcagttgtggtcagggattcggcgagaggattggatcgtgtaaagcaaactctaaacggcacagtgggcctaccacggaagtacttagaaggcaaggcgagggatatggcgaatcaagaggagtgggtcccgtttatggacgtattagcattgctaatatttggggttgtcctctttccaaacatggatggtttggtggacctagccgcaattgatgctttccttgcatatcaccatagcaaggagagctcagtggtagctatcttggcggacttatttgacacatttgaccgaagagtccacaaggcgtgggaaagcccattaagaaaagataaagaacttaggggcatccgtaatggcatcatcggtggttatcatgaatggctgaaagttcgtacacgggggttagattggctctccaagttgaaaattatcaacgaggagaacttcgaagctccgaaagaggatgaagaagtctgcgctctaaaaacagagctagggaaggcaagacttgccaaagaaaaattcaagttagtcactacagacgtccggaaagagtgtgccgagttacgagaagaaaatgcagctaccgcaagagcccttgaacaagaaaccaagagggctcgcaaggaagagcatggtcgagagaaattccatggagctttgtgggacaacaacaatgagctcaagcttcaaagggaagagagaaaccaatcacgagtacataacatggtcttaaaggaagagttagctgcttgctcaagatccaagaggagtttgacccaacacttagaagccacggagcaaagcatgctagctataatagggcagtacaaagaggagctaaaccaatctttggctcatgagcaaaagctagtatag

SEQ ID NO: 32453 - DNA, 473 bp, Glycine max
  Peptide Sequence Number=SeqID_124138
gggaggtggttgccgcccagctcgcccaggcgagctcagctcgcccaggcgagccaggttgcttcctccagaagcaacagccttctggaggaatattctggagggcccaagaaggaaaagctgcaatttcaccatttcatcagttccctgatgaatccctaagtgaagcattggagaggtttagagggggaaaaataaaactgaaaacccctgaagaagcaacggagttgattgaaaacatgtcttccagtgatcacaccattctacgtgatagagtacatcaacccactaagaagagtttactggagttatcatcacaagacgctgtgttggcacaaaataagttacaagttgtaccatatgcggtggtactcttgaatctggcctttgcattccttttgaagagcaaacgcaagaggttagctacatggggaatcaacaaaggtagggatacaatcaaggtgaattctcag

SEQ ID NO: 32454 - DNA, 462 bp, Glycine max
  Peptide Sequence Number=SeqID_124139
atgggaaagcgcaaaaagttgaatatcattcagaatgatggtcaatcacaagcaaaagagcaatcaattgaaagctctactgaagtgaaccaaaataacaactctatacttgaaggaaatgcacaatttgaaggagaacaacacataccagaagatagtcatgttcagtctcatacttctcttgaaagtgcaagtgaaagttcaactaaaggtaaaaagagaaccaggggttatacacatatgctagatgtgtgggacttgccagatggagaattcatacttgttgaagtagatcattggggcaatcctatgggttgggaaggaaaaactttgaatgtaattaggagcttggtaaggagacaccaatgtgctcctatcaattttcttagctggaaagacatgcctaaggactatattactgacatggttgaattaattcaggtctggtataaaactttataa

SEQ ID NO: 32455 - DNA, 333 bp, Glycine max
  Peptide Sequence Number=SeqID_124140
atggtttctgggccaccccctgatattggaggagggccaactgtgcaagcacaaccagagagggaggctatcacacagctactatgcataccggggcaagatttcacccgtgccgctgcaaagagacgaggatcgcacccacagagacacccagtggacctgaagaagtccaacagggccctggggtttccagctctggttgtgggcctctgtcggccctacagggcgcccgttccccccagcaagttcatgtcatcgtggcatagggatcgtgcccgcagacacctagtggacccgaagaaggccaacaggtcttggagttgccagctctaa

SEQ ID NO: 32456 - DNA, 255 bp, Glycine max
  Peptide Sequence Number=SeqID_124141
atggcttcagaaaaagctgtgagatggtcaatgtcattagatatagcggatcatcgacctcatcatccggcctatctgcagatgagtcggccaagcaaggaatgtgttgagagcctgtcccatgaccttaacctctttcgtgggtacaggaatgggagcatctgcatctctaatctcctcaacaccaaccttgacttgatcatgcagcaaaggaatgttgtgaatggttgtggatccctcataaactcttcctag

SEQ ID NO: 32457 - DNA, 555 bp, Glycine max
  Peptide Sequence Number=SeqID_124142
atgtcgcgggggtcaggagacctcggggacgtcagagtgctgtgtaattcgtgtttggcctctggtaatcgattaccaaggctgtgtaatcgattaccagagatgaaaagccttgagatcgtgatggcggcgcaagtaatccatgatcgagtggagatggagtgcctagagggagcttgggagaccctcgaaggcaatgcgaggtgccgatttcggggcacgattcgattcatggctacttcattggtgcatccagaggaacccacgcgcacgcttcagcgcactatggagtggatattacccacgccaacaccatatcgtctagtggagccagtccaagtgatcaaggtgacgtcatctgaggaagaccctgaggaagacccagaggagctacctcctgagcctactgtggatgctcttgactttctagaggatgatgagaacccactccgtgaagtggattctcccgaggacgtcatgtcggcatctgaggcagactcgacggaggagagcggtcctggagggatagcgactagtggaggctcctcatcatag

SEQ ID NO: 32458 - DNA, 506 bp, Glycine max
  Peptide Sequence Number=SeqID_124143
tgacatttagagggccaagaaaggccaggggtaagagatcagaggcccttactacttcagcaccagagacaccagctccttcttcttccacaactccattacctcccactcagactccagttattcctcctacacctacacagataccacttccagctcctctatctgtggcttggccaggagcccagccttctccttctagagggggtggggccttcgcaacccaggagcctgttcttggggagacagcagcagtagagggggaggatgagctcacccctcctgagccttcttattttgatgcaggtatacacatggctcaggaggaggatgcttctacagaccaaattcatgagccatcttctgcacttgtacctaatgatgccacaccatctacaccagcgcctgagttagagcagcctatctctcaggattcaccagttcctcaggtgttggaccttaatgagcatgcacaggagaaaccacatgatgagcaggacatttaa

SEQ ID NO: 32459 - DNA, 477 bp, Glycine max
  Peptide Sequence Number=SeqID_124144
atgccatacgtggaattcgcggaggagtcattagaaacagcctttcagtcttttgaggtggttagcattgcctctgtagattccttctctgggcaaccttgcctgtccgatgcggcagtaatgatggcccgagtgatgttggggaatggttacaagcccggaatgggtttaggcaaggacaacggcggcataaccagcctgataagcactagaggaaaccgtgggaagtttgggttaggctataaacccacacaagcgggcataagtaaaagcgttgcaagaaggaagagcggaggtcaaggctcgcgattgggacaagaggttaaaggaggcctgccctgcgacatcagaaggagctttataagcgcgggtctaggacacgaaggccaagtcgttgcgatatgtgaagatgattcgccaagtgggtcggaattggtatggccatgccctcctagtttccgactaggaaattggtga

SEQ ID NO: 32460 - DNA, 321 bp, Glycine max
  Peptide Sequence Number=SeqID_124145
atgactccccaactaaatgagccctcccaactaaatgctgacccaactattgatatccatgttgctcagtctgaaagcaacaaaacgtcacatgactatcatgctcaaaatgggttttcggatgaagtagttggtgacttcagtgacatcgaagacgaaattttggcagacaacaacaacaacgataatgacatacagttccttttccaacaaacatcaactgaaaatgtctatcatccatatccaaatagtgctgatgttggtgacaaccaattgcctgacaaccccaactataggcattttttggatcaacaacaataa

SEQ ID NO: 32461 - DNA, 306 bp, Glycine max
  Peptide Sequence Number=SeqID_124146
atgggcattagaaaagcagaaggagagcgtagaagtacttcattcccctggaagatgacagacacatatcgagattggcacgaaagggttcactctaacttttggggtatcggaattcggacttacaccggcgagactccctggttacctcctttcaaagacccagaagtcttcgactacctttactttgaagaagaagaagatttagccattggtttggctaccactctagtggagcaccgtgataaggcgcctattactgacttctttttcatgatctcaagacgacttaagcaaaccgattaa

SEQ ID NO: 32462 - DNA, 93 bp, Glycine max
  Peptide Sequence Number=SeqID_124147
atgaagagaaaagagggcttggctgagaatagagaaaaacagagaatagaggcgcagaatagagcaagtcgtaacgctgctcggttaggctaa

SEQ ID NO: 32463 - DNA, 348 bp, Glycine max
  Peptide Sequence Number=SeqID_124148
atgggtgaagtagaggaggtgcaagagaagatgaaggctgacatggaggccatgaaagagcaaatggccacaatgatggaggccatgatgagcatgaagaagataatggaagccaatgcggttatagttgccgctactagcgctgtcgctaaggtgaactcgatgctcccatctggcctcaagcaaatgaatcatccaacctcaaatatggtaggcaaagatttaggaagtacgggcggcccccatgatgtgcaaattcaaaacgagcacgccttcccgtcatatggcttgcctctcaactatgcgccacccaatgtggcgtacactcccaataagaatgtcaaataa

SEQ ID NO: 32464 - DNA, 156 bp, Glycine max
  Peptide Sequence Number=SeqID_124149
atggctatcattgcattattgagtagatctgggatattaggggtggtgtttggtcttggatatgcagcagcgggttttgtggctgatttaggggtggcctttgtagatgattgggtgttcttggctgatagggtggtgggtaatgagaagggatga

SEQ ID NO: 32465 - DNA, 345 bp, Glycine max
  Peptide Sequence Number=SeqID_124150
atgattatgaggagccaagacatttatagtagccaagatgaggctactacgtcaccttcctctagtgaaagcgaagaagcaaaaggggaagaatatagtgaagaaatatacccccaagaagaaggacaacctttaatggttaaggaggagtgtaaggagacacttgttagcactgccacacctcttgggcttgaggttattcctcaagtaaaggagttgttggatgagggtttggttcgtgtcgagggaaggagcccagagtatgaagaacctcaggatttgaggtcaaatcctttccaaggtggaggggatgatgcaatcctaccccccaagggtattggatag

SEQ ID NO: 32466 - DNA, 201 bp, Glycine max
  Peptide Sequence Number=SeqID_124151
atggcaaccaggcgagcaagatctgcttctatgtacaagccgcacctgtcagagtcacccgtctcaggatcgtttcctgagggattaacacaactcccctgtgtgctcactgaggaccggagggaccaaccagagggtcaggaggcactgcaagtccctgggattgcatttgcgactgaagctaggactgcatgtggctga

SEQ ID NO: 32467 - DNA, 528 bp, Glycine max
  Peptide Sequence Number=SeqID_124152
atggacaaaagtatgatagatgcagccagtggtggagcccttggagacatgaaccctgctgaagccagaaatttaattgagaagatggcttccaactcccaacattttagtgccagaaatgatgccatagtcattagaggagtgcataaactagccttgaatcagaagtctgtatcggtcgcaagagtctgtggtttatgctcctctgccgaccaccacacaaaccttttcccttctgtgcagcaatctgaagcaatcgaacagcctgaagcttatgttgcgaacatctacaataaacctcctcctcctcaacctcagcagcaaaatcagccacaacagaataactatgacctttccagcaataggtacaatcccgggtggaggaatcatcccaaccttagatggtcgaatcctccacaacagcagccacaacaacaaccttattttcagaatgttgctggcccaagcagaccatacgttcctccaccaattcagcagcaacaacaacagcaacagcctcagaaatag

SEQ ID NO: 32468 - DNA, 582 bp, Glycine max
  Peptide Sequence Number=SeqID_124153
atgaaaaaggttttacatcaactattcaatagaaatccccaactaagggttttagacttccatggcaaggaagctccttttacaataaagaaagggaatcaagagaaatttcttgcttacataggagggggaatgtctcctccacctcttggcacctcaaaatcactcaaaagctccctaatctctctaaaagttggaaacttggctccttgctctacttcttcgttctctgaagttcacacccaagagctctctgtggctttaaaagggctcaaaaaactagacgtcgcgcttagcgccattttcgcgcttagcacaaatgcccttccagattcccttgactcgctaagtgatcttgtgttgggcttagccgctgatacgcgcaaagcacacggagctcacttagtgcgacatccactttggcacttcttcaaatttgctctttttttgcctgaaattgaagagaatttaacattaattccatataaagaggcttctaatgaacaaagatcaaaacaaagaaaaatttatttacaatcctacaaaagaactataaattggggatttatatacattttgtaa

SEQ ID NO: 32469 - DNA, 414 bp, Glycine max
  Peptide Sequence Number=SeqID_124154
atggaaagaaaatctcatagaggcaagtcctttgaatttgactccttgtactcccttgtttcaaatcgtggtgatagtaacttgattctggatggaattcatgaaaatattttgcagctcaattatcatgacgtagtaatgcagaaaactgtagcatttcaattactatcagataaggagaagaatgatcttgctcaattagttagcacaatggtgtcatacactataacatataaaactgtgaaatcatatattctgcctcaaacccagaggtgtgaagtagctgatggcttggcactatctcttgttcctcctattagcgactttataaatttcaaggattatacttcaaaccattatgtgctttctatagctatgaagcaggttttcgttcatgaggttagacttcattaa

SEQ ID NO: 32470 - DNA, 513 bp, Glycine max
  Peptide Sequence Number=SeqID_124155
atgtctggcctagcgatcacaactccgacctccctctgcctaagtgtcagttggtgtatggcgcctactaggcaccctctggacccagataagtccaacagggccctggggtttccggcgctgatcatgggcctctgccagtcctacggatttcccatcacccccagtaaggccgtaggcgcaccgccaccacctcggcaggccgatgggccactaggcatagagcgttatctacagcatttggttctccagcaggcggccaaccaccgtgggcaggtgcagatacatgagtgtctctaccagttcagcctcagtcagcaggggttgcgttccaccacttctatatgccctaccccggagcagtttggggctgaggtcgcatggcctggagactggcccgatgcccagataggggaggagcctgcaggatcccccggtgaggcggatgagtcccatatggatgaagatatgactgacctgctcgatttcttgggagagagcggagccacgtga

SEQ ID NO: 32471 - DNA, 1134 bp, Glycine max
  Peptide Sequence Number=SeqID_124156
atgggatttactttggtagaccttgataagggaagatcaagtggtgttagtcatcaaaatggtgattcaacactagatatttatgagactccttctttcaccaaatgcatgccttccataattgaagaacatgaagtggataatcttatggctacaccactaagctcccatcttcaatcatctgcttcttcagaatctacatctaggaggcctagacaatccacacgactcaaaatcttgattgctagacacttggataagcccaaggtagtggttcatgtcaaccctgccactaggaaagcttcagggccacaaaaagagaaattttgcagctatttagggatggaaacatttgatattccagaagtgtccaacacgaagaagaaagtcatttcatcaatggcgatactatggaggcaatttaagtcatccttggccactaaatatgtatatgcaggcaaggaagggcaagattatcagaatccttgtaataagtatggcctagatccaaagacttgggaggaatctattgcaagccataaaaccctttcttggaagggaataaaaaagaaggctcaaacaatccaaaagcaaaatgattgttcacacttattgtctcgtgggggactccttacaagatcagatgacaaaaggaagctttgtacccatggttgtcaggatatactaactactgccattaggcaacctgagcactcaagtcgccttcttgttgtggaattcggtgtgattattagccaatactttggacatgcatcatatggctccattaggcaacttgagcactcaagtcttgttcgtgttgtggaatttggagttgagggagttcctgatgaacaacttgagccaaaaggtatcccaacaacccctccagttaaggaagatatagaagtttatggtgcccgtgtgagcataaaggggaattgtgttgatactattgtgaatccctcaagggaggaacctcactttgatatcatttgtacaatggggttgtacgttaatgatgaccattctacccgcccggtggcattgggaaaagtatataagggggcatcaaccgtacaccacgtgcatttggccgatgatgtggtcaaggtggttgttgaagaagtttga

SEQ ID NO: 32472 - DNA, 690 bp, Glycine max
  Peptide Sequence Number=SeqID_124157
atgggcgtggttgctctagtaaatttgggatatatgttacttacaagcattggcctatacttagccaattctgccgcacacacattcatggattccattgaggagcaggcttcgcagggatccttcgtctcccatggacgtcaggatgttctcaccgcttctattggatgtccagagcaccctggacgtgttcgtgttgctggagctggtgtcaacatcaagaaatacttcggatcggctccacagacatcccatagctcttcctcgctacctcctgaagaattgcagtatgactcggcagctcatggcatcgttcagtcagatgcagtcccagttttagttccagatgcaatctcagggacttgcactgcctccggagcctctagaaacgatcctgagacgggtgactcagagaggtgcggcttgtacatcgaagcaaatcctactcacctggttgccctaggaaaagtttatgagggatccactgttgttcataacactcctttgttgcatgtccaagtaaaggtgggcaattcacaccttccttgcttggtcgacacatctggtcaagcctttatcacaatagttgtgtctccggcaaaaccacctcaaaagctggatccggaggtcgatgatctgctttatctgatgacattgaccatcctagagcttttcttgaggccttactag

SEQ ID NO: 32473 - DNA, 174 bp, Glycine max
  Peptide Sequence Number=SeqID_124158
atgtcggactccaatggaagatgctccacttcacggcggtcacaaaccccaacacgaatgacgaagatgaggaaggctgaaagggagaagaggaaggctgtttgcgatactatagcagggtcttacggtgaaatgcttcctctccaaatgaaattcggaaatggcaatgattga

SEQ ID NO: 32474 - DNA, 159 bp, Glycine max
  Peptide Sequence Number=SeqID_124159
atgtgtttgcatatcagaagggagggctatcaaactaaggtgtgcataaaggtgattggtgagaagagtgcggagatgatgaccaacgaaggtgcaatatatgttactgcaaacagaggttacaactggagggatgcttgtggaagcaaagcttcatga

SEQ ID NO: 32475 - DNA, 376 bp, Glycine max
  Peptide Sequence Number=SeqID_124160
atggtggtgagtactataacagatatgatggatcgggagaacaacgttcaagaccttttgcattttttctcaaaagagtgtgaaattgttccgcaatacaccatgtcaggaaaacctataatgaatgagtcgctttggcgagaagccttaaagaccatagcttacatccttaataaggtgtcaagccaagaaagaaccaccacaaacgtggcgagcgccaccaccgcagcggttgtggctttagagagcggccctgggtggcatagacgtggaaggcgtctcccaaagcacatcgtttatgataatgagaatgctgggaaggctatgagggtgatacaactcactatggtgcatgctagggctgttcggaacgcag

SEQ ID NO: 32476 - DNA, 423 bp, Glycine max
  Peptide Sequence Number=SeqID_124161
atgcagttggctagcttagaatttgaaggatatgcattggtgtggtggaatcaaatccaagtggatagagaaagattgagaagacatagagtggacacttggatgaaagataaagacacttccaagaaggatggttcttcttcacaacatcttgaaaagaagtcttcaagaggtaatcctacttctcctactcaaccccctcccaataaaactagttccattaaatgttttaagtgtttgggaaagggtcatattgcatcccaatgtcctaacaaaaggaccatgattgtgttggagaatggagaggatgatggttttcttccaccgaaagaggaagatcttttgatggtttgttctctaatcattgatggcggaagttgtaccaatgttgcaagcactagattagtggagaagcttggctaa

SEQ ID NO: 32477 - DNA, 2949 bp, Glycine max
  Peptide Sequence Number=SeqID_124162
atgacacttgggagcattataacttgttacctaaagtctgaatcatggaatactacattcttctggagcagggctgcaaatataaagaaagctcggggatcttatttttcagaggagtgtttgtttggctgggggacaatggaaggaaagggaggggagggtgaatttggacttgcaaagcttcttaatactgaagaccttacttccccggttgttggaactctaaactacatgtgtcctgaggcctttgctggtatgccttatggttataaatctgatatgtggtcactcggttgctgcatgtttgaaattgttgcacatcaaccggcatttcgtgctccagacagggctggacttatcaataaaataaatagatcatccatatctccactgccaattgtttactcttccacacttttgaatcttccaaatgcttattctgatggatttggagaaatttgggccttgtctcttggtcattctagccatcagtgccacatcagcactttactaaatagaacagaaagccggcaaaagaaacaacttatcaagagcatgctgaggaaaaacccagaacatagaccaacagcatctgaattattaaagaatcctcatttacaaccttatgttctacgctgtcgtaatgcatcatctatttttctaccagtacatcttataaatagtaactcaaaggataaaacaaaaaccaaatctagtagtggtagcaaagaccattgggaaagggaggcagcattggctggattggtaaatcgtttggatcgactttatccattagagggaaatggagatgtacagtcacggaattggcataatgatggcaagctagcagtgtcaaccagtgcagaagacaaccttgagactaaaatggttgatttgaccagctatactgtggagttttctactagtattagcggctcgaaagatggatcaacaacatctgaatcaactgtctgcagtgtgtgcaaggaaggagactctaaaaatagacttacaagggacacagctgacagtgagatcacttcaaagagtacaatggattctgggcttgaagaacaaggacttgattgtcacaagtcatatgcaattgacataaatacggtgattaataaagttgaagatactttttccaatgaagatttcaatacagatgaagcacttagtgaaggtgtcaaacctgaggactccagtaaatcaataatgtccagtgaagacagcaacggtaatgataaagatgagttaattgatgagatcacatcaaagagtactctagattctgtgcatgaaaaacaaggatttacagctgaacattttcagaagtcagatgtgattgacacaagtgcagtgtctacaaagattgaagataattttttcagtgaagatagaacagaagcagagagggaaaatgccaaacctgaggactccagaaaatcaatagtgtcaagtgaaaacagcgatgttaaggataatgagggatccattaatgagatcacttcaacgagtatgctagattctgtgcatgaagaacaaggatttacagctgaacattttccgaagtcagatgggattgacacaaatgcagtggctataaaagttgaggataatttttccaatgaaggttttgaccaaacagaaacagagagggaaaatgccaaacctgatgactcccgaaaatcagtagtttccagtgaaaacagtgatggtaatgataacgatgggtccattgatgagaacacattaaagagtacgctcaattctgtgcatgaagaacacgaatttaccgctgaacattttctgaagtcagatgtgattgacccaaatgcagtggcttcaaaagttgaagataatttttccaatgaaggttttgaccaaactgaaacagagagggaaaatgccaaacctgatgactccagaaaatcaatagtgtccagtgaaaacagcgacggtaatgatattgttgctgttgatgagaccacattaaagagtatgctcaattatgtgcatgaagagcgagggtttacagctgaacttgttcaaaagtcagatgttgaaataaatgcagcggcttcaaaagttgaagacaaattttctaatgaaggatttgataaggctgaagcacagagggaagatgccaaacttgagagctctagtaaatcaataatttcctgtgaaaacagaaacgataatgatgactatggatctggctatgagatcacatcaaacagtatgctagattctgtaggtgaagaaaaaagacttcctgctgaactctttcagaagtctgatgcaattgacataaatgcagtgactacagaagatgaagataaactttccaaagaaggttttgatagagctgaaacacaagagaaagatgataaacctgaggactccagtaactcattgtctagtgaagacagcaacagcaacgataaagaggggtccattgatgaggaaaggtcatcaccaattgcacatgcggttaaggttgagcatgacactgacactggaaacagcttgaaggaaaatgaaaaccctaaagtgttgacagaagactcatgcatggacagcttggcttctgagagtaatgaaatgcgtccaggtaaggatgaaggccaagcagatacacacacaatcagttgttcaacgcataaagaagttgacaatgctgtcatggctgataagccaccaaatggcgtttcattaaggacacgcatatcaagaggtggtgataatacttgccatcaaagagctgatgctctggaatctctgctcgagttatgtgcgcagctacttcagcaaggaaagcttgaagagcttgctgctgtgctgagaccatttggagaagatgctgtatctgtatcatccagagaaacagcaatatggcttacaaaaagcctggtggcctcacaaaatcttaatcctgagatatag

SEQ ID NO: 32478 - DNA, 249 bp, Glycine max
  Peptide Sequence Number=SeqID_124163
atgagaaataagagaagcccttctgacctaaccttctctgcttcctctctcgatcgacgctctcctccgtccctcgcacttgagaggaggaaagaggaggctaagaagttgtgggaaggaggaaatctcacctcgtcgccgtcgcgaagagttgtgagtgagagcgagatcgagactaacaccgataatgagagcgagagtgagactgagaatgaggagtgcaagtgccgtgggagtgagagtgagtaa

SEQ ID NO: 32479 - DNA, 351 bp, Glycine max
  Peptide Sequence Number=SeqID_124164
atggcctctggtttccatgtgctgaagctgtgtaactcgagtttgggcactgaggaacccacacgcacgcttcaacggactgtagagtggatactacctacacctactccatatcgacaagtggagccagttcaagtgatagaggtgtcatcctctgaagaagaccctgaagaggacccagaggagttacctcctgagcctgctgtggatgatcttgactttccagaggatgatgaggacccactccctgatgtggattctccagaggatatcatgtcagcatctgaggcagactctacggaggagagcggccctggagggacagcgaatagtggagactcttcatcatag

SEQ ID NO: 32480 - DNA, 282 bp, Glycine max
  Peptide Sequence Number=SeqID_124165
atgctggatactggtaatcgattactaccttctggtaatcaattaccagagagtaaaattctttgtgagcctaaacgaatctccaaaggctcatcaaacccaaggtccatccttggtaagcctcaaggaatctctaaaggctcattaaacccaaggtctgcccttggtgagcctcaacgcttctccaaaggcttgtcaaacccaaggtctgcccttggtgagcctcaaatcttctccaaaggcttgttaaacccaagttctgccgttggtgagccccgatga

SEQ ID NO: 32481 - DNA, 333 bp, Glycine max
  Peptide Sequence Number=SeqID_124166
atggctcgagcatccaacaaagtcgatagttgttctagaatggctttttcaactttctctagtggggtgaaaatatccttatcaaaggacttggacctggggacaatcatactaaggacttcaaagagacaaccatacatgaagaagaagaaggatggacaacctaacgccgccttaacaaagggaaaatcattactcccacaagcctggatgaccatcttacaggagtcttctgggttggccaacttcagtttacgctccaaagccgcgacactcatggaagaagttatggagaaacggtatttcagaatatcatcccttacccacccatag

SEQ ID NO: 32482 - DNA, 369 bp, Glycine max
  Peptide Sequence Number=SeqID_124167
atgagtcatcattcatctagtgttaatggtgaggatttcaaagctcatttggagcacaaaatttcgtgctcttctctccctctcccttcattcatctccttcttcctccaagctcttatccatggcctcctatggtgtggtgtctcctctctctcttccttctccattccgctgccattcatcttccaagaagcaaaggaatccattgatgaagaagatcctaggcctacaagctccaatggagcttgcatcataactcttgaaggcataggtcacatcttagacctcactcccataggagataaaagaaacaaaggactcaagaggctaacattaaccttccatacttccaagggaaggacaatgtag

SEQ ID NO: 32483 - DNA, 714 bp, Glycine max
  Peptide Sequence Number=SeqID_124168
atgcagatcactttgatgccttctttaatcttgctacctttgacctcaactaaattcttaattgaacattgggtatgtttgcactcatgcaccttggagaatgtggtagaggctcagaatggtgagaaggagaaggaagagaatggtggtggtgatgatcagagggagcaagtagcagctggctggccaccttggctaacaacggtgtgtggggaagcgcttagcaggtggattccgcaaaaggcttacacctttgagaaaattgatatgatttgtcaaggaacttatagtaatgtatacaaagctaaagacacattgacggctgaacttgatgcaagccttggcatcaagtttacagagcctcaggtcaggccagcttccaagcttattttgatgatgccaaagactcaagtcaagaatcaagattcaagcaagtttcaagaatcaaagagtcattcaatcaagaatcaagattcaagtgaagattcaagagaagactcaagatatgcaagaacttcaagaaaagcatcaactcaaagatcaatcaagaacaattcaagagttcaagataagaatcaagaagaattcaagactcaagaagaaagtctagagacaagaatcaagattcaaggttcaagatctcaagaatcaagatcaagattcaaggctcaagattcaagaatgaagagaagactcaatcaagataagtattaa

SEQ ID NO: 32484 - DNA, 360 bp, Glycine max
  Peptide Sequence Number=SeqID_124169
atggatgctaaacgacgggataatgaggcaaggaggattaggacagaaaaattggaggaagttatggacattaaggataaaaatagaaggtgtttaatcactcgtgcaaatgctaagagcaggagtgaaaagttccttccaccacatgaagatggacaacttgtctttcctttgggatcttctattcatattgatccagatattgttccttctgatgtttctttgggttcaacctcgtacaccttttcaaaggaaccattccgagcttggttatgtcccattggttatactgctagcattagtgtcacaaagcggaagaaacacactacaggtgatgcattggatttatcaaaatcataa

SEQ ID NO: 32485 - DNA, 324 bp, Glycine max
  Peptide Sequence Number=SeqID_124170
atggaagaggtgcattttcctgtaatgccttatgcagtcggtatcaaacaagatgggcctagtcgatctgatgacctgtttgaagagcccacaacaagattaaatcctcctcagaggcttgggcaagaaaacaatgttgatgacctaggagatgaaagagaaggaggaattggtgttggtgggtcaccagatgttccatggtggcggtggcctgcagcggtggtggtggcctgcagcggtggtggtggaggaggatccttcgtttcttcaacgattttgccatttgaggttgtttcagcaaattctgatcagtgggatttgtag

SEQ ID NO: 32486 - DNA, 339 bp, Glycine max
  Peptide Sequence Number=SeqID_124171
atggcagacgatgaaccttccttagaccgcctggaacgtctcaaggccgccattgctgatctcgttgtagctcaactccactctttcgtgatcctagcctccatggttgccaaactcgatgtcattctcctgaaactccatatctcggtaaccagtcaaccttccccatcttttccctctgtgaaatcaccatcaacagacaactatatggactccacgataacagcaccgatggcgcaacaccacacagaaaccataccgtcaatgtctccaaagaagaagttgaccacaccactcgctccaatgtcgtcgcaaccagtctcagtgccaaagttgtaa

SEQ ID NO: 32487 - DNA, 606 bp, Glycine max
  Peptide Sequence Number=SeqID_124172
atgagcgtaagagaatgtattcttgcaatcagaaggcgtagcaagaataattcaacagctaagtttgatggatgcaacatctcaagttcttttgctagagcttcagttggagtggaggaaaataatgcaattggtgatgcattgccaaacctggacaccacaaagcagtccttgatacaagagattggccaaaaatctcaaacaccaacaactttacaaaaccaacatgggattattgatgagaaccaatttatgtatgatgatcaatacttatggtcagatcttgcatttcaaaatgacccaagtttccaaattgatgctagttttcctctatggtcatatgattttggcaatacactagttgaagatcgtgcaagtgctttaggaaatgccctcaattggaagatttcaatgtttgagaagggtaatgaaaatccaacaaaagcaggaaatgatggtattagttcatttgggtcaagttctatagggttccatccaatgggatcaaatattcagcattttaaagcaccaaacctacaaattgcacctgtccaaaggtatgaacctctccaatatggatttgcaacaaacagtactcattcctga

SEQ ID NO: 32488 - DNA, 221 bp, Glycine max
  Peptide Sequence Number=SeqID_124173
atggcttccattattattttgatgatgccaaagaatcaagagttaagcaagttccaaagaatcaagagtcaaaaagctttgagaatcaagtttcaagattcaagattcatgaacaatcaagaagtttgtgatgacattgctgagaggttggagtgccatctgagtctaggggtggtcacgccaggctcatcgacacatgaggtgatcgaagaatgcctcag

SEQ ID NO: 32489 - DNA, 174 bp, Glycine max
  Peptide Sequence Number=SeqID_124174
atgtgtccctggttgaatctccaaaaggctcatccaacccaaggtctacccttggtgagtcttgcgcctccaaagactcttcatatccaaggtccgtccttgatgtaccctctacttgtaccacaaaggatgtaccctccaatgtgttgggacaaagaattctcaggcggttag

SEQ ID NO: 32490 - DNA, 243 bp, Glycine max
  Peptide Sequence Number=SeqID_124175
atggaaagttggtgtttcccgtcctcttgtacgagggctgagttgacaaccttgtcaactactaagaggtatagaagtagaggtactcctggcttaggtcgactcagtacttgtggtgtggcaatagtcttcttgaaggccaagaaagctttctcgcagctttgggagaaacctagacaaaaatgccaatctagcattcagcttttggacttcctggacattggtagggctgtgcatttctag

SEQ ID NO: 32491 - DNA, 501 bp, Glycine max
  Peptide Sequence Number=SeqID_124176
atggcctgcctgtcatctgcaggactgaatttaaatggctcaagaggagcaagctcatcctcagcatctagcacaagctcctgtgctggcacaggctcttgggctacagaggcctcaccccctctagaaggagaaggctgtactcctggccaagccacctgtgcaagaaactcctccacactcatagttggttgctggccagagctctgcaacctctgtatgatgatgatctggcctctgtccaggctctggagcatggcaaataatgtctttgaagtgaatgaggagggtcctgtaaaaggaactggaactgatggagctggtaagggagctgcaatagaagaagatggaacaatagtggaaggagctgtagaacgaggaatatcagaagatggaggagtcgaagtggatggtgttgttgaagtaaagggagcctcaaatctcttacccctggccttccttggccttctgaatgtcactattggatcatctagattctaa

SEQ ID NO: 32492 - DNA, 675 bp, Glycine max
  Peptide Sequence Number=SeqID_124177
atggctccaaagaagcttctctctaagaaggcaaggaaggatgccataggggaaggatccagtgcggccccacaagcggatatagaatttgacggacaccattggtctttcctcaaggagagatgggtccagctgagagagggagaatacactgagttccaagagaaaattgccaagaggcaatggactcaactcgcagggcccatggctaaatatgacccggaaatagtcgtggaattctacagtaacgcatggcccatagaggaagcagttagggataagcactcctgggtgcagggccaacaggcctcctttgatgatgatgacattaatcagttcttggggcatctgttggacttcaccaaaagtgtgacggggagacgggtgtggatcatgcatactagcatgactaccctgacacagaaatggatgacactgcttctcagtaacatcctccccagcgatcataattttaatattcccttgccgaagtgccagctggtctacgccatcttgactcaagttagtattcatgtggcccaactaatctcggatgccatttaccgatttcaagggatcgcacctcttcgacatccagtggacccgaaaaagtccaatagagcactggggttttcggccttgatcacgagtctctgccagttctatggggtgcct

SEQ ID NO: 32493 - DNA, 243 bp, Glycine max
  Peptide Sequence Number=SeqID_124178
atgaacacaccgtggcacaaccaaagtgtgggtcaaaattgcaagggaatgagaccgtgggtcgagatcggagttctcggaacctctgagaaaagatcgagagagaggagtgagtacctgcagagagatgagttagcgctggtattggagagaggagttctcggaacctctgaggaaagaccgaaagagaggagtgagcgttggtatggagagaggggtgagtatcggcagagaaacgagtga

SEQ ID NO: 32494 - DNA, 623 bp, Glycine max
  Peptide Sequence Number=SeqID_124179
atggatgagtttgatgcgcaggagcctgaaccagagcagccaacagtagaagcaacaaagggggaggatgagctcacccctcctgagcccttttattttgatgcaagtgtacacatggctcaagaggaggagacttccacagaccagatcccagagccatccccagcacctatacctgatgatgccataccatcttcaccaacatgtgagttagagaaacctacctctcaggatttaccagttgctcagccattagaagagaatgagcatgtgattggaattatgactgaaaatgttagtcagtttgttagattgattgtgaaggaatgcattgaccgtatcctggccatgtttgattgtgatagccatttagccaaaaagctgaccatgtgcttgaatgatttatcccttgcaaccagagagcatcatcacaggaagcgtggttcaaagcaaatttgtcccaagtttgggggagtaattatcaagggtagagattttacagacagatttttgacacccaaaaggagaagatttgcacagaattccaaggcacaccacggtgcctatttcgagaaaggaactctggaggcagcaagaggagcagcttttgcagagatacctag

SEQ ID NO: 32495 - DNA, 135 bp, Glycine max
  Peptide Sequence Number=SeqID_124180
atggagatggggttatggtgggaaattaaaagcaaaagaggtggacctctcccaggacctccactgttaggactccctaaccgacggcgagcaccaccttgtcacctgcgtcctcgccttcttcactgcctctga

SEQ ID NO: 32496 - DNA, 126 bp, Glycine max
  Peptide Sequence Number=SeqID_124181
atggctagaggaggtccctccactagagcaatcctattcgagttaggtagaatcattataaacgacaaactctcccttcaaacattcgacgacatttttgaaccgtctttgaagccaacgtcatga

SEQ ID NO: 32497 - DNA, 198 bp, Glycine max
  Peptide Sequence Number=SeqID_124182
atggtttctcctgtcaaggttgagaaattcatcttgagatgtggtgtggagacaatggctctcaatttgttcaacatttccctgcccatcaaagcaaattatgaggtaaaacttcaagcctctagaatgtcttctagcaaagtatgtctgtggagctaccttggtgatgcaatcctaccccccaagggcattggatag

SEQ ID NO: 32498 - DNA, 228 bp, Glycine max
  Peptide Sequence Number=SeqID_124183
atgtctttcatgataatcccatgtgaagcaatcatgatatgttttcaagcaaagcttcatggtgaatcaaaggtgattcaaaggtgttttgatgataacaatgatgatgacaaaggtgatgacaaaaagctcaaagatcaatcaaagaacaactcaagtgaatcaagaacaattcaagagttcaagataagaatcatgaagaattcaagactcaagaagaaagtctag

SEQ ID NO: 32499 - DNA, 234 bp, Glycine max
  Peptide Sequence Number=SeqID_124184
atggatcacgaagatggtgtcaatgctcttaacttagaaacccttgatgatgtcgaccaactttatgatggtctaacgatgggtcccattctcaaatcaaatggattatccattctccaaccttctactttctccttggctgaggggcttcttgtttggggagaagagttacctgttttgaaatatttggctaaaaaagacctatacatcacatactctcatgctggtagttga

SEQ ID NO: 32500 - DNA, 759 bp, Glycine max
  Peptide Sequence Number=SeqID_124185
atgaagaagatccaaggcctacaagctcttcatggagctacatcaggaaaagccatggttgaaggagatttggggaatgatgtcattgatggaatagacagtgatgcggaggttgacatggttgacttggatgatagggataaggaaactgatgatgataagggagataatgataattatgaggaaaatgatagtgatgatagggatgacttggatgctgaatatgatattgataaattagaatatgatatagcaagtgaagaagatgatgactgttatgcactttctatggcacaaattaatggagaagatatatcaatagaaccagtttccaagagatttcaacctcatgaaatgggaagagattttaattttgaggttggtatggagtttgattcaattagtcagttcaaggaagccatcaaagaatatgcaaacctacatgaaaaattgatagaacctttgaagtatacccctaacatgtcaactaatgcagtgattcaaaaagtcagtgaaagctattgtgtaaaaatatctagtaagaagacatattgggcaagaaggattgcaaaggaaaagctagacctaggaattgggagaagcccaatccaattaaattttagagggggagacttctttggaggcactaaatttcatgctcttctcttcctctcccttcattcatcttcttctaccttcaagctcttatccatgtcttcctatggtggtgaacttcttctagactcatcttctacttga

SEQ ID NO: 32501 - DNA, 831 bp, Glycine max
  Peptide Sequence Number=SeqID_124186
atgggttcgaatccggaaacagcctctttgcatatgcaaggcttcccgaaaaaagcagaagacatcccattcggtaccacctcttgtatactatgtgatgactttaacagcacagtttttgtgttcatattcagtgcttcaattggtcagtcattgcctgctttatcttcagtgaagtctgtacagtatacatctgctggacctactggaggcaggcattttgcaaatcacaattctagtgctcttgcatctaatgcatctgctaccgaagcagcagcctttgatccattgattgggaagaaagtttggactcggtggcctgaagataaccacttttatgaggctgttgtaactgattacaaccctgctgatggccggcatgctttggtttatgatattaataaagtaaatgagacttgggaatgggttgatctcaaagagatctcacctgaggatataaaatgggaaggtgaagatcctggcattctccatagaggtggacatggtgggcaaggtggtggaggtaggaaattctttggccatggtggtgattctttaggtgcaggtagagggagaggtcatcccaggtttcaggccagacaagaatttctcccacctcaaaatggtattggaaggagagttttggatgacattgagttgctgaacacagattcactagttaaggaggtagaaagaatttttgctacaagtcctcaagattcaatggagcttgagaaggcaaagcaaatgctgaaagagcatgagcaagcacttgttgatgccattgcaaggattgcagatgcatctgatggtgaaagtggtaataattag

SEQ ID NO: 32502 - DNA, 547 bp, Glycine max
  Peptide Sequence Number=SeqID_124187
tgacatctccaatcatctttcatccttcaagaagatccaaggcatacaagctccacatggagctacatcttacacttcaaagttcatacctcatttgagctacatcttacagtgtttggttctatctaaccttaatcttggaggaatttccagaggtagctttaaggctgaaacgttcgacaagggtgtcaaagttgtcgatggattatggaggaagttctttgtatcatgtcaatgctacccctttgagggatgttgggaaaatacggcacaagattgcatcattgttggtgtagagattggcttaggtgaggaatgcgtccaggttgggatcgtcttgggtgttgatggtgtgtcaggggtgcaattcccctggaatacgttcatgcattgtgtgggcagagtgctcgtcgccttaggggcatctaacatgagcttccaattggtcatgttgtttgtcatggatgttgggggaggaatggagctctctagacgtgtctcacatctaaggataggctgcatgctaaccatcggtgaaaataggtag

SEQ ID NO: 32503 - DNA, 416 bp, Glycine max
  Peptide Sequence Number=SeqID_124188
atgcatactatagagtttcaaaagcgaggactccctcacgtgcatttattactatttctacatccagacaataaatattcatcttcaactgacattgatcagataatatcagctgaaataccttcccatcaagatgacccagaactctacagattggtggagaaccatatgatacatggcccatgcggaattttacaacccaactctccatgcagtcgtttttatcctaaacaatttcagcctcagactcttttggattcaaacggttatccagtctatcgtagaagaaacaatggtcattcaatttcaaagaatggctatgacagggtgactgctgttatgctttctgatagtgataacgcagctcaaaatgtaaatattcaaaatgatgaacttaaagaatatctagattgcag

SEQ ID NO: 32504 - DNA, 273 bp, Glycine max
  Peptide Sequence Number=SeqID_124189
atgaacctcttcggtggcacagagagatttgaacaattaaagttgtccctacttgttgatgggttttcgaaggttagtgtggacaagtggatggatataacggagatgggatatgtgcttgcatcacggtataacgtaatccttgtatcgttgtcccgacaacaaagcatgacattttttcctcttagaagtcaaccaccacctgattcttctgggcaccgcatgatatgtgtcagtcacgtgtttggaaatcattttgttcaggtacattga

SEQ ID NO: 32505 - DNA, 573 bp, Glycine max
  Peptide Sequence Number=SeqID_124190
aagtggttcttccggaatgtttccgaaagaaccacttcttccggaaagttcttccagaaatctcaaaggtcttccggaaagttctttcggaatttcggaattcttccggaagaactacttcttctgaaaatttttcggaagaggtgttccgggagacttctggaaaaagtgttcttccggaagacgtttcgtttcttccagaagaacacttcttccggaatgtttccggaacagattcttctggaagttccggaagaacccctaacgggtctttcggaagcctccgtcgtgagccccctttccccattttttccggcgtcttctcctctcgtcttctaccctaaggttactatcctaaggttccattgctacaacaatgttgtatcatacaagcaaagggaagttagggagactaacctcgttcgcggagaagaagacgagcttcgcgcttggcttgcggagaagaagcagttcacagacagggagaagaagcagttcgcggagagggagaagaagcttcacgaaaggaatgaccaggaagagtttcttccggagagggggggctttttataa

SEQ ID NO: 32506 - DNA, 522 bp, Glycine max
  Peptide Sequence Number=SeqID_124191
atggcatgcgcatctagcgaggctgacaattgctccaagggtctgattgtagtagaacaggaagtggggttcctcatcccgattgaagatcagtggcaattcatcagccatgacgtcagttgccaggactttgtaaaaacagtccttgaagtgatgaaacacgttcaagtcaaactcgagcaacttcttggacacgttgttcagggagacccaaccaatcttgcatccagcgacggtaagaggggacgaaggagacccagcattacggctatgccacatatagcggaaaccctaatgtccccgccactactcctccttgctccccaagaagtagaatggggaaggatcatggtgactagaatgggttccctatctagaaaggcagcaaaagattgcaccctcctacggaggcgagaagtaccttcgccaacacagcacaagccaaccatcctcttagaagaaaaggacttgctattagaagctccatggagagagtctcctcctctgaggagctgccaatga

SEQ ID NO: 32507 - DNA, 648 bp, Glycine max
  Peptide Sequence Number=SeqID_124192
atggaagaaataagtcaagatgaaagaaagaaaataagagaggaagaaagaagaaaaataatgaaagaaatgaaaagagaaaaacatgcctcctatagtagtcataactcttgcaagagcctaagtgaagaacttcgtgactattacgaaggaaggcataggtcacatcttagacctcactcccatagaagagaaaaggaaagaaagcctcaagaggctaacattaacctcccatacttccatggcaaggacaatatagaggctaacttagtttgggatataagggtagagcaacaacttaaaaagaagtctacatcaaaatcttatggctctcactcttatccaaagaaataccaaggtcaaggcatcttaggggtgacaccttctaagcccaaagatgataaggggaagacaatagaaaagcaagcccctaaggctaaggacacattacttctcaatgccctaccacaaaaaactatgattatgaggggccaagacatttatagtagccaagatagggctactacttcaccttcctctagtgaagaaatctacccccaagaagaaggacaaccattagtggttaaagagaagtgtaaggaggtgttgagggaaggagcccaaagtaggaagaagctcaagatttaa

SEQ ID NO: 32508 - DNA, 189 bp, Glycine max
  Peptide Sequence Number=SeqID_124193
atgatgagaattgaatatatgcaggtggagaggaacatcgacttggtttatgtaggaggaagcattgggttgatgggtttaatctcacaagttgtgtttgatggtggatgccacatgttagggagggagaaggaaggaatcaaaagaattctcagacgccatttgatggctcttaaaaaaccaagttaa

SEQ ID NO: 32509 - DNA, 324 bp, Glycine max
  Peptide Sequence Number=SeqID_124194
atgaacttgctaagcgaacatgctgagctaagcgagttcatcaatacttattcgaggctgaatcgcaaagcccaggtcaattcaaagccagctgacccacaatctccagtggtgaatccaccttcttcggctgagcttgaagcggttcccccatctcctcctctgattgtcatttctgatgcatcatcagatgaagcagtagctcctcctgatgcaccaactacagaaatagctgacccccctgtttccccaattagaggaattgttgatctttctgatttgtcatctggagaagttgttgctctcaccaattccccagtttaa

SEQ ID NO: 32510 - DNA, 354 bp, Glycine max
  Peptide Sequence Number=SeqID_124195
atgctccacaagatagcttcctcttcaagctcagttatctcctggtctctccacagccaaaactctcaaaaaaaactccaccccttcaatttcaagattcagcttcaaataggcaattctattgggatgtgtgcacttagcgggagatcatctcgcttagcgcgtcctggaggttcaagtggtgctcttagcaaattgattctcgctgaacgcatcattgacaactcatttgcttccaggatcttctatgcgcttagccatgaactgctgcgcttagcggatggctcgctaagccagaaaattggcttagagagcagctcaaaatcaacacttccaccaaacttgcctaattag

SEQ ID NO: 32511 - DNA, 491 bp, Glycine max
  Peptide Sequence Number=SeqID_124196
agggtacatctacttgggttgttgtaactaagaacaagaaagggtacatctcttatggatcagttctagtggagggactttacaaggttgaaaagaaatctcaaggactgcaggtcgcttggggactggatgtaggcacggacataaagaaagagtgttccaaagatcctgtcttgacgacaaaagtgcgtcaacgacctccactgaagaggaccctagaagataagagactagtgatgggggtggcttgccatatgttgcctcaaaaggggagagtctggtggctgaatgaatggtcgtgttgtaacaccattccgcaagggatagaaactgataccacttggaaggggtgtcgtgcacgaagcatcgcaggtactcatgcgcaacttggtgccgctaaggaggaacaagtcacgctagaagtgtccgacgaagatgggatcacgattggaaaggagactgcgagggaagccattgtccttgcagactaa

SEQ ID NO: 32512 - DNA, 594 bp, Glycine max
  Peptide Sequence Number=SeqID_124197
atgggagagataatcaaacacctagcggaggtgcgacacatggctgtcgagggaggggttgtacaccaagatgtcatcgaagaacacgacgacaaaacgatgaaggaatggtttcaagagcttgttcattgttgcctaaaatgtggagggcacattgcacagaccaaatggcatcactttgtattcagagtgtccttgctgagtgcggaatgcagtcttagcaacatcatcaggcgccatcaaaatctggtgaaacccctatcggagatccagtttggagaaccaagatgccgagccaagttcatcaagaagctcatctatggtcggcattgggaagcggccggaggaaagcatgtcatgcacttgcttctcgatttcagctttttgaaaatgaggatagcggacgtggcggaggaagggtggagggttgttggaacaagtgagaatattgggggtggagagaaggttagtgatggaaatatgaaaaaacgcagatgcggagtgggtctgcatcaggcgccggagctggataagggccgcatagtcagtgatggtgggcccgagttgtttgagccattggatgccaaggacaag

SEQ ID NO: 32513 - DNA, 738 bp, Glycine max
  Peptide Sequence Number=SeqID_124198
atggctgtagcagactcaatatctttccaagaacaactacttcagagggttgcttcagctcagtttaggaagcctctccttcatcttgtgtccactcaagaagacaagggcagatacctcacccaatgtgtcccacttcacaaagcatcactcaaaggtgactggaaagaagctagaaaactattggatcaagatgggtcacttctcaaaacggccataacaaagggggggtgggccacactcctccacatagccgtgggagcaaaccgtgttcactttgtggaggagctgctaaagttgatgcaaccagaagaattggaattgcaagaccacaagggcaacactgcattctgctttgctgcagcagttgggaatgtgcaaattgctgagatgatggagagaataaatgcatcgttgccaaccataaggggtggaggaggactcacccctcttcacttggctgttttacaaggaagaaaagaaatggcatggcatctgttccctaaaactaaggaaatctttgaagaggtggactggactatacttttcattaattgtataaagtctggactatatgatttagccctggaaatgctaaatgagaaggacatgctagcctatgctcggggtgaggagaatcagacagggttgcatgtcttggctcgaactccaggttgtggttgccaactacgatgtcgaaaacacctcctacatttctgtaagtggctatacaattaa

SEQ ID NO: 32514 - DNA, 54 bp, Glycine max
  Peptide Sequence Number=SeqID_124199
atgactgtggacacttcatttgttcacttaactgctgtagtggcaagcttggtg

SEQ ID NO: 32515 - DNA, 138 bp, Glycine max
  Peptide Sequence Number=SeqID_124200
atgacttgtcccgtgcatgggcgactgtgtatgtttgtggcgaatgatcccactgttaagggagggacctattatcccattactgctaagaagcacctcagggcacaggagattgcagctcagtgcaaattgccctag

SEQ ID NO: 32516 - DNA, 183 bp, Glycine max
  Peptide Sequence Number=SeqID_124201
atgggttgtcaatggccaaaggctaaaactgtatcatggaaaggaatttatcaggacacaggacactgttcatttgatcgccaagtgagtcctttcgctaagcgcctgcttcttgctaagtgcataatcacttatgcgctaagccacgagttcaagcgcttagtgcaccaccctggcacctga

SEQ ID NO: 32517 - DNA, 444 bp, Glycine max
  Peptide Sequence Number=SeqID_124202
atgttgagggttatgagacaatttggattgggacaaaaaattccagatgacccaccaaacctagacgaactccatgacatggatatgagatattattctggtcaccaccaccatcaatcacatattgaacccaatgtacctctagtacatgtttctagatatatgccccaacatcatcaaccacatgcacaatctatttatcaatcaacaggcttctttggatatatgtctcaaggatgtcaacaaagactctcacaaaggtttggtaccactttcaacactccgccatctgcatacaacccaccaccatcgagctcttcttattgtccattattacctattcaaatgcatgacatgagttatgaggatgaggatgaggatgatgataacaacaataccaacaataatgatgatggccatggtggtgatggtgctcctcaataa

SEQ ID NO: 32518 - DNA, 324 bp, Glycine max
  Peptide Sequence Number=SeqID_124203
atgatttcaaggttgagtcaacaaattcaagttcaagttcaagagaagtttgatttcaagattcaagaaaagatgaattcaagtttcaagagaagaattcaagaagacatcacaaggggaaagggtacatctacttgggttattgtaactgagaacaagagagggtacatctcttgtggatcagttcaagtggaggatacatcactaggttgttacaaagagaacaagggagggtacatcccttgtggatctttgcttgtaaaggattttacaaggttgaaaagaaatctcaaggaccgcaggtcgcttaaggactggatgtag

SEQ ID NO: 32519 - DNA, 927 bp, Glycine max
  Peptide Sequence Number=SeqID_124204
gcgtcacagggatcattcgtcccccatggacgtcaggatatcctgactgctgccattggacgaccagaacaccctggccgtgttcgtgctgttggagtcgttgtcaccataaagcaatacattggatcggcttcacgaacgtctcgtagttcttcctccatgcctcctgaagacctagaacagcttactcaacaaattagagaccaactggaggagtcaatcacagaaaaagtgactcgaaagatgatggaatcctttagccagatgcagtcccagtttcagtctcagatgcaatcacagggacttgcactacctccagagccagaggttggtcccttaggtcctcgtgtcagcacaaaggagagttgcgttgcaccctcagggaatgatccagggacggttgacaacatccctttgttgcatggccaagtcaaggttggtgttgaggagattaaagatggagaggctctccttcctgtacccactgacgaggttaccttagtggggcaagcacttaacaccttccttgcttggccaacacatcttatgaagcgtttattagaacaggcagctgtgtctccagcaaaacctccagaaatcccagatgaagaggtcgatgatcccctgtacctgatgacattgaccatcccacaactgtttttgaagccgctccaggttatgtgggatgctaccatattcgaggtgtttaatcaaaacttcccgttgtatataaagcacgaagatctctttgaaattgcacacgatggtcaatgtctcagcatatctgttatacagttgtggattctccatctgactaagacaagtgtgcgagcggggaattctgatgtgtatggattcctcgagccacagtccattcagagatctgggcaatcacaatttgaatccgaaagttacatcaagagttag

SEQ ID NO: 32520 - DNA, 339 bp, Glycine max
  Peptide Sequence Number=SeqID_124205
atggttgcggagttagggcaacaaacggtggagctatccaccctcgtcacacgtgccgctaacgataagtcctctgattttttattccttcttaatctactttttgttcatcggccaattggctcaggagattgcagccccagggacagtgctactgataaagggtcctatgagcagagaccatcatcatttgccccaaaagcctatgagatggaagtctcttgcagctccaagattaacaacaccaaaaatgacaccaacttgatgtccaattcttccaacaaagacatgttcctagacagctacaccactagttggcaactacaccagattttctaa

SEQ ID NO: 32521 - DNA, 429 bp, Glycine max
  Peptide Sequence Number=SeqID_124206
atgtcttttgagatggacctaatagcaaaactacattacccatatattgtggagtacaaagatgcttgggtggagaaggatgactacatatgcattataactggctattgtgaaggaggagacatcttgtgttgtgtgcttgggcttgttctagcagtgcttggctattcggcttacacttacccaaaagctaggaatattaatgggtgtctccaaggaaaagaaacactttccgtttatttggaatatgtctctagtaatagtaatgtgttaaaacttgaaagaaatgaaagtggtattcacactggtaatcatgggtttatacgtgattttcaggcaagagatgtccttgcagtagagcttttacagaaggatgcacgacttgctgctagtggggagttgggaaaagcatgtcctggtggaacgtaa

SEQ ID NO: 32522 - DNA, 1213 bp, Glycine max
  Peptide Sequence Number=SeqID_124207
gaagcacttggaagagaaagcaaaagctttggtagatcaaggagagtggacttcattcgttgatgttttagcactgttggtgtttgggatcgtcctctttccaaatgtggatgggctagtggatctaacagtgatcgatgcttttcttgcttatcactatagcaaggaaagtccggtcgttgctattttggccgatgcttatgacacattcgacccaagatgcaagaagagtagcacaagaattgtctgttgcacacccactctttatgtatggctagtctctcacatttttcttcatgcaagtagacccatttgtcccctacaaggtgatcacatggttcccaaacgtccccttgatgggaacgagggttgtattaattataatctcgtacatgccataagacaactaggctaccatatgagaggggcgccatcggaagagagtatcgcacaaggtttcagtgaccctaatgcaaaaatgcttcaaagagtccgaaaaacgaatgcagtgcaaagaaaggataaggagcttagaggaagtagcaacggtgttattagcggatatcataaatggttgaaggctcggatgcaagggataacttggcttccgaagctaaagatttcaagtggggaagagactgaagtccctgaggagagcgaagaagtgcaagccttgaaagcggaacttgaaaggaagcgagtggtcaaggaaaagttcaagacaacaaccataaggatcaggaaagagtgtgacaagctgagggatgtcaacatggccatagccgaagcattagaacgagaaacgaagaggggctttatggggcagcaacagcgaactcaagctttgaagggtcgaaagggacaagtcaaggatggaaagtatgatattagaggacaagttgaaggcttgtcaaagaagctaaacctagctgctatccatgagcaaaagctagaggacgagcatgcaaaagtatcggctctgcaagcagaaagggaagcaagggagagagtgatagattcattacatggagaagccatgaaatggatggataggttcgccttcactctgaatgggagtcaagagcttccaaggctattagccagagccaaggccatggcagacgtatacttggctcctgaggaagttcataggcttttcaattattgtcagcatatgatcgagttgttgtcccacataattaggaaccgctga

SEQ ID NO: 32523 - DNA, 874 bp, Glycine max
  Peptide Sequence Number=SeqID_124208
acatcagtttcgaagcgaggaacaccagtgccattttgaggcaattaagggttggtctttcctcaaggagaggcaggtccagttcagggaaggggaatatgctgaattccaagatgaaattgccaggaggcagtggactcaacttgcggcacccatggccaagtacgatccagaaacagtcatggagttcaacgccaatgcatggcccacggaggagggagtcagggataagcgctcctgggtgcggggccgatggatcccctttgatgaagatgccattaatcagttcttggggcattcattggtcctggaggagggccaatgctgcgaattcagtttgaggaggagccaggcctcggggagttcgcctgaagcgtggcagggagacagcaacatccttcccaacgatcataatttcgaccttcccctgccgaagtgccagctggtctatgccatcttgagtgttcatgtggcccagttggtctcagatgccatctatcaatttaaaaggatcacgcctcccagaaacccaatggacccagagaagtccaatagggcactaggatttctagtcttgatcacaggcctctgccagttctatggggtgctagcgaatcccacaaagcttatatggcctcctattaatagggactttatactgaatgagagcttttaccaatacaccctacatcagcagagctacgatcccagccctttctcgtggcctaccctagagcagttcggggccacagttgcatggttgggagataagcccgattttcaggcaggggtaggacctgtaggggcccccgaagatgaagatggagctcaagaagatgatgacatggccgatgtgatggaatacttcctttga

SEQ ID NO: 32524 - DNA, 393 bp, Glycine max
  Peptide Sequence Number=SeqID_124209
atgactgcaacattaggaccattggtatctatgttgtcaagtctggaaaaagagaaagttgaatccaacaagtggactgcaagggtctgccttgtaggcatgcaattgctgccatcagatacaatgaccacagaccaaaggactacgatggcgcctaaaggaaccaactcgcctgggcgagctgccatggtcccaagtgccctttcatctataaataggcctgaaggggagctgcgggggaggtttcaaggtccaaaaggtgagggaattgagataagagagaaaaaagaagaagaaagaagagaaaacgaggctgaggcgctaccgaatcgcaatcgcgatcattccttacttcgttccttgttttgtgttcttcgtacgatcgtcgattag

SEQ ID NO: 32525 - DNA, 618 bp, Glycine max
  Peptide Sequence Number=SeqID_124210
atgcctaggaggagaaacatttcaactgaaaagtttctatctaaagaggagagtaggatccaagcaccaacaaagccctctaaggaacaacataagattcaaacgcctacaaagaaggctaatgctaatggaactgtggaggaaccagaaaagtctagtaagctaagaacttccattggaaagaaatcaactgaagtttctaacagcagactccctaggaacttggtcaaagttactctaagtaatagaaaagtgacagatgcaaaagtaatgaaacacagagatgcggcacagatagcagcaactgaggctatgcaagaggctgctgctgctgagagtttactgcaatgtctaagcacgagtgagcaccccgaacggaatgcaaagtcagcaccccaaacagcccacgacaatgaccacaaacctagtccttcgagcgagaccgagcacgacttccacaaaccaactcctttgagcacaagttccccaaacaaacaaacaaagaagaagaacaagaagaagacaacaaagactaaggtcgcgaagaagaaaaagaagctatacctaggtaacgtggctacgtttcacggtcacgaagaagttgtacaaagaagctaa

SEQ ID NO: 32526 - DNA, 911 bp, Glycine max
  Peptide Sequence Number=SeqID_124211
ggatagctgtccttgcctttagagggctacacatcctcgacttcagaggactacacatcctcaccttcagagggctacatgtcctagacttcagaggagtacacgttctcgccttcagaggactacacgtcctcacttttagaggattacacgtcctcaccttcggagggctacacgccctcgcatttagagggctacaagcccttgccttcagaggactacacgttctcaccttcagagaactacacgtcctcaccttcaaaggactacacgtgctcgccttcagaggactacacgtcctcacctttagagggttgcacgcccttgccttcatagggctacacaccttcaccttcagaggactacgcatctttgccttcatagggctacacgccctcgccttcagaggactacacgtcttcaccttcacaagactacacgtcctcgccttcagagggttaccagccctcgcatttagaggggtgcacgccctcgccttcaaaggactgcacatccttgtcttaagagggccacacgccatcacctttagaggaccgcacgtcctcaccttccaagggctacacatcctcgccttcaaagggttgaacgacctcgccttcagaggactgcacgtcctcacctgcgaaagactgcacatcctcgccttcagaggactgcacatcctcactttcagagggccacacgtcctggccttcagagggctacacgtccttgcctttagagggctgcacgccatcgcctttaaagggctgcatgccctcgacttcagagggcttcacatcctccctttcatagggctacccatcctcggctttggggactacatgctctcaatttcagaggactacacatcctcacctttagaggcctatgcatccttaccatcatag

SEQ ID NO: 32527 - DNA, 261 bp, Glycine max
  Peptide Sequence Number=SeqID_124212
atggccaacatagtaaagcaattgttggcaaagccaatcaaagaggctaaggcagcaaaagcggccttctacatcgattctaacgacctttctacatcggttatgacgcgtggtggtaatccggggttgttgaatcacaacatcggttttatgaccgtctttgaaagtcgatttttctacatcggttgtctagctacaaccgatgtagaatgggtagctttctacagcggttctaaggctgaaacaatgttgaatgggtag

SEQ ID NO: 32528 - DNA, 1473 bp, Glycine max
  Peptide Sequence Number=SeqID_124213
atggcccgcaccaagaaaacaggggagatgacgattgaggattcctttgaggagcaggtgtcacagggatccttcgtcccctatggacgtcaggatgttctcaccgctgctattggacgtccagagcaccctggacgtgtctgtgttgctggagtcgcaactaacccagcaaatcaaggacccgctagaggagtcgatcacagaaaaagtgactcggcagctcatggtatcgttcagctagatgcagtcccagtttcagtcccagatgcaatctcagggacttacacttcctcaggagcctctggaaacgatcctgagacgggtgactcagacaagtgcggcttgtacatcgaagcaaatcttgcccgcctggttgccttgggaagagtttgtgagggatccactattgttcataacactccttcgttgcctggccaagtaaaggtgggtgtggaggaggttaaagatccaaatgctctcattcctgtacccactgatgagacagttgtgtctctggcaaaaccacctcaaaagccaaatctagaggtcgatgatctgctttatctgatgacattgatcatcccagagcttttcttgaggccttgctgggttacatgggatgccaccatgttcggggtctttaatccagacttcccactctacataaagcacgaagaactctccgaaatcgcacacggtgcggagaattatgatctgtatggattcctcgagccacagtccattcaaaggtctgggcaatcgcagtttggggctgaaagttacataaagagttggatgcagagttcaaaacgtgatgtctaccttggagcctacctgaatggcggacactggcagatggtggtcatcctgcccaaggaaaacctagttgtctggtggagtttgggtgcaacgatggtgtttgatggttgggtgaaggacatatttaatttggtggtcatggagaagtttggggggaaagcagcttgggataagaagggtaagaaggtatcaaacggagcacacagcagtgaagccgacgttggaggctcagaaaaagacagcttcaacttccaacgacatgtgttcgatgttcctttttcgtgtttgaagttctattcacaaaatttgctgtgccaatcttctcgggacgactctgctccaatgttcggaagtgttgttgattctttcttgtctagtgatgaagacacgttttgtgaaacgtatagagaatatagtgaacttccttgccatgacgtgtcactttatgagcatttcagacacgaagagaaaagattggagggtgatgattctgccccagttattgaggctgaagttgtttgtgccacttctggaaactctgcttctagcatggtaccaactaggaaaaatagaataaaatggaccaaagatttgcatgagcaatttgttgcagctgtcaacagccttggtggtcctcaaagtaagttaagttaa

SEQ ID NO: 32529 - DNA, 537 bp, Glycine max
  Peptide Sequence Number=SeqID_124214
atgtataagagcataaattctgctccatgtttcaggaaatttgccaagctcttgttcctccaggttttcaaagaacaaatcgagcaactaaaagaaaaggaaaaagtcctacttgatgaaaatgccaagctcactgaaaatggcaggctctctgagaagatagaagcagtggcaaattatcaaggggacagttacatgggcaaaccagtgaggataaattgtcaaaaggcgattctggtgatgaaatgctcagctctgttctcaagacctttgtctactagccctaatcagttagacggtgacaaaataacaggagctaccaatcataaatccgtgaatttggagggaagcctgttggttccgcacctattcaaggaccacagaagatgtagttacatgatagccaatgcactggataaggatggtaaattcactactgtccaagtctctcgaaaacttaagcagcttggtttgtatcttcctctgcccaaggatggtaaattcactactgcccaaggggtgcttctccttaactaa

SEQ ID NO: 32530 - DNA, 1815 bp, Glycine max
  Peptide Sequence Number=SeqID_124215
atggaggagaagagcaagcgtggacatgaggaacattcgtgtactgaaagcccaacactcaacgtcgacccaccatccccagttgcaagacacttgaagtggaagatcgcccgcactaagcggcatggccaaatgacgtctgaagtggcacaagaaattgtagacaaaattgattcattacaggaacaagcaacacaggggagttttgttccgcatgggcgacaggacatactcaacacggcccttggccgacctgagcatccaggccgtgttcacgtcgcagggacaggtgtcacaataagccaatactttggccaagcctcacgtgcttctaccacatcgtcaccatcgatcaaccaacaacaattggctgatatcatcggtgtaattaaggatgacataagaaagcagctacaagatgagataagaaaggaggtacaggatgagataagaaaggaggtacaacaagaacacaagcagcaacaagaggcttggatgagggcaattgaagaaaaacagtggaaaaatttggagatgatgaagcaagagttaaaaaaatcattgaaagtagagctatctcatattgcatcacatcagtcagcccccattgaggcgccagaaatacaagctctacttgcgcgtgttagcacaaagggtagctgcgctggacctaaaggaagcggattacttaaagagcttttgagtggtggtgacgatctaatggggttgttcgtagttgttggggaaaatactgtgcttgcgggcttgggaaaagtgtttgagaattcatccaccatacaaaatgttcgttatgaaaatgatgttgttaagtttcaggttgtcagaacatacatgcctcacgctgaggtccctattcctacatcagaggttcattatcttgagcaggccgttggcacattcgtcgcatggccgacccatcttgttagggaagtaactaatgaggtggtcgtaggacccgataagcctccatcaaggtctgttggagagccgaacaggttaacatctgtggccacagatgacccactgggagaattggttaagaagtcatatgtggtttacacaaagccaatggagttggcatgggacggggcgaaatttgggttacctaatgcctcaaatggtgacaaatgtttaaacatatttgtactgaagctgtggatgatgtttatgaatgattggagtacaagcattggtttttctccagtgtacggtttccttgagccccagtctatacgctgcataaaggacacgcgtgaagaatgtcaaaagtacatagaaacgtgggtcaaggagtcacatcgagaaatctacttaggaccttacttcaatcaggcacattggcaacttcttgtgttgtgtccacgagagaacattatagtatggttatgttctatacgaagaaagcctgatgttcacattaagtttgcagtgaacaaaaaatatgcagtaatctccaaggcaaggacaatgcacctccacctccaccttaatggattgaggctaagccatgtacaacaaggaggatatgagtgtggatattatgtgatgcattggatgtggtgcatcgttagtgccggtttgaaaaatgaactccacaattatttttcagatggaacagcattagacactgacaccatgacgacaatacacaagaaatgggcagcctattttctagaagttggaaaatggatgtcagcatttgacatgctcctgcttgggtcgttcagtccgccgcaaccttctcatacattggtccaagaaatcatcggaaaagctactcaggtgctgcaataa

SEQ ID NO: 32531 - DNA, 297 bp, Glycine max
  Peptide Sequence Number=SeqID_124216
atggaatgcactaaagaggacatagagcacactaaggataatggtggtcaagaaccttacattggaatgaaattcgagtcaaaggaaaaagcttatcttttctacacttgttatgctaaaatcattggatttggttgcgagaaatgttttttgggtggatgcaaatgtagaaatgactaccaagagtttggagacctcgtttcctttgaaacaacatacattatgatcgaggtgcaaccagcccgtctaatgatcctttacaaggattgtaggtcctatgacaaggtccaagactaa

SEQ ID NO: 32532 - DNA, 2154 bp, Glycine max
  Peptide Sequence Number=SeqID_124217
atgggtgagagcgctgcatcatctggaaccaagggactacctccttgtccaagtgcacagaatttggctatcctggaagagaatgggcaaaggcaccaagaggcactgagcaaggtggccttcttggaggctaaggttgcgaaatggagggctattgctcacacagtctggagaatggagcaccctaaggtagctagtgccaccattgccttcactgaagttatgaagtcgaaccatcaattgtcaaccaaggagaaagatgacttggctggcaaggtggaaagcattagggtggagaaggatgagcttgccaaggtggttgctgaggcccagttgaaagagtcagagtccgagctacgggcgtccaaggagagggaggccaacaaagagcttgaagaggagctaatgatgtacaagaaaaaggatgtgaaggatggtgttctacttgacgaggaagatattgctgctaaggaggaggctactgaggaggagcaggacattgaggagaaacaagaccttggtggtcttgtcactcatttggtgatgcttcctttcgctttacccaacttctccttgatgcttgtgaggagctggtttgatttgcacctagttgaaggtcttgttgaagagtttggtggtagtttgcttagacttgtggaacatggacatttgactatggttgtcatagttcctagggaaccttgcgttcctgtggagatggaacttagtaacaaaggggcttaccaagggactgaccttgagtttaatgagccttggatcaaggacgtgtttgccctgggttttggcgaggctcaccaaggactcacccgggtggaccttgggttttgtgagcctttggagaagcgagactcaccaagggcggaccttgggtttgacgagcctatgagactcaccaaggactcatcaagggcggaccttgggtttgacgagcctttggagaatagactagcaatccatcctaaattttggcgagactcaccaagggtggaccttgggtttgatgagcctgtgagactcactaaggactcaccaagggcagaccttgggtttgatgagcctttggagaatcgaccagcgatgtgtccatcttggattttggcaagacttactaagggcagaccttgggttttaagagcctttggagaagcaagactcaccaagggaggaccgtgggtttgctgcgaccctgaatgggccttcctagttgggaccaagctttctcgctcgggggatcttttttggctatgccttggactcgccatacgaggtcacgaggttgaaaagttcatggttgaacctttgtattgtatcttcttgaagctaaaagcttgtctccttgtcgatagttccttgacttcgacgggatcatgtcatctgtgcaatatacttgtcaagtctagtgctcagagccttgaggattactctattggctacctatgcctgaccgttagtctaagaatgttcaacaaaggtgtcgttgtcgatgacaatggcataagagaggccatacctgcatatgaggtgtttccggcgactagtaaatatttgactgctcctagggcctttggcagtggtcttagtatgtctattccccacatggaaaagggccaaggggagcttaggctgtggagattgttaggaggggaaattcttgtagggggtcattcagtttggtttctcctattctccgaccataacttcctcagtgtctatggtgggagtttagagcattttatggatgatagtcttgaggtgtcaagtctttttggttctagccagcttggagagcaagtctactatggtgttgctctccttgggtatgtagtacatcttaaagcatttgaagttgtcaatgagacttttggcaatgtgagtgacattgtcagggcctttgaggatgattcttgcactgctccccttcacattggacgcataatcaatgtagaggctccaccagtcctgggtgatggcaagcttgtggcagataatgttggggtggattccgagcatgacatcaacgatgtgtcaatgctcatggctggtgagttcttgctgagttgtgtgcattacccgggtttatgtctaagctgcagcttgacaagttcttcgataggctttgggcatatatcagaa

SEQ ID NO: 32533 - DNA, 471 bp, Glycine max
  Peptide Sequence Number=SeqID_124218
atgggttctgcttcagtcaccaaagcaccaccctcttcctcctcatcacccaactcttcttctactgagtcccttgatggcttgaagtttggccagaaaatctactttgaggaagtgagtgttgctgcagcagcagcaacaacaactcaagggggcaacaaaacaagaggtggggtttctgcttcaaagaagggaaggggtggctcagtgcaagctcctaggtgtcaggttgcgggctgcaaagtagatctgagtggtgctaaggcttactattctaggcacaaagtttgtgccatgcactccaagtcccctactgtcactgttgctggtttggagcaaaggttttgccaacagtgtagcagatctcttccgacaaatgtccaaaccaattacgcttattggacacatgtgaccttcaatccattcaagatgcaacatgttctcaggggaaagatagatctcattgactga

SEQ ID NO: 32534 - DNA, 1051 bp, Glycine max
  Peptide Sequence Number=SeqID_124219
tctttcagaggatgctgctattactctaataaagttactttgtgaaggtactcctacaggtaagaaggatgttgctactgctatcttcaacctatctatttatcagggaaataaaccaagagctgtaaaagctggtttagtagccccactgatacaatttttgaaggatgctgggggtggaatggtagatgaagcagtagctattatggcaatccttgcaagccaccatgaaggcagggtagcgatcggtcaggccaagccaattcatattcttattgaggttatacgaactagctctccacgcaatcgagagaatgctgctgctgtcatgtggtcactatgcaccggagatccactacaattaaaactagcgaaagaacatggtgcagaagcagcactgcaggagttgtcagaaaatggaactgatagagctaagataaaagctagaagcatattggaactcttatggtctgaaaaattagaggacctatggcagctcaaaatccctttaaaaccaacaacatttgcttggcgattgatcaaagatacaatcccaactaaagggaatttgcggaggagacaattcttatggggaggaggtatggagcagaggaaaattgcttgggtgagctggaaggaagtatgccaaccaaaagataaaaggggtctcggtattaaagaccttaagaactttaactcagctttgctggccaaatggaagccaagactctatttgatggagggacctgctatcaagtcagcagcaacaacagaaccaggtagtcaaaacgaaaagaaattggaaggtgggaggttgtaccgaatttctgatcaacagaaacaaatcattatgaatatggggaataacaccaatggcggatgggagtggaagctatcttggaggagggcttttttgatagtgaaattcaaatggcagataatttccttggagaactatcacagcagcagattcagccaaatagggaggataggtggagctggaagcatgatcaaagtggatactactcaacaaaaagcggatatgacttga

SEQ ID NO: 32535 - DNA, 438 bp, Glycine max
  Peptide Sequence Number=SeqID_124220
atggagataaaccacttaaaggatgagtacgctgatgcctatgagaacacattccatgcgaagagagtaaagaaagaaaaagagatggaacttgctttgaagaatatgcaaaacaagttgaacacgaaagcaaatcaaagcgagttgaaactaacaaagaaaattgatgaattgacactcgagcgggacacactgaaattagatgttgaaggtctacatctaatgatggttaagcatcattggcaaaagacaaaagagtggatcaagacttgcaaagagatgactgattgcatccaaaattatgttgcgaacttgacaacacaagtccatgaagcagttcaagaatttaatgcaaatcccgaaagaaagcttccctggaagatctataaactcttgaaatattttcaagatctaaccaagagtttttctacagaatga

SEQ ID NO: 32536 - DNA, 210 bp, Glycine max
  Peptide Sequence Number=SeqID_124221
atggctatagtaacaacggtggtgctgaaggtgacggtgctttgcccatgcaagggttgcaacaataggattcacagggcggttgtcggagaagttaagaggaagatagaggctatagtcacaacggtggtgctgaaggtgatgccgctttgcccatgcaagggttgcaacaataggattcacagggcagtgttgaagaataaaggttaa

SEQ ID NO: 32537 - DNA, 99 bp, Glycine max
  Peptide Sequence Number=SeqID_124222
atggcgggaactgattcagacacaactatcattgatggcttgggtgttgatggatggggagttggtggaatagaagcagaagctacaatgcttggccag

SEQ ID NO: 32538 - DNA, 153 bp, Glycine max
  Peptide Sequence Number=SeqID_124223
atggaggttgaggaatcttcgctgggattatggctaccattgcattattcagtagatatgggacaggcgagttttgtggctgatttaggggtggcctttgtggatgattgggtgttcttggttggtggggtggtgggtaacgagaaggactga

SEQ ID NO: 32539 - DNA, 273 bp, Glycine max
  Peptide Sequence Number=SeqID_124224
atgctgagattcaagaagaagctcgtaagaggagagcaacttagaagtatgagtcatgtcacaacctaccctacaatgggagtatgggcgaaaagccaacggagtgtcttccaaaaagaaaaacttgtgggagttgccacccacgtttattcgagggaaaatggagctgcccttgctccaacgtatcctcaggcaaagggtcactttggggcagttgcaactcgcccaggcgagctaaaacttaaccctgaagtagtgagctcgcccaggtga

SEQ ID NO: 32540 - DNA, 339 bp, Glycine max
  Peptide Sequence Number=SeqID_124225
atgggagcagacctagctttggtgaaagaattctatgcaaatttatacagttctgaggattatccaccaaagtttcctacagactacagagagatagaggttgtcttatgcatacctggccaagggttcatcttgaactcaaaaggccatcctgggaaggttcttaggaaggatctgactacactagctcaagtgtggagtgtcgtctcatactccaaattggcccccacatcacacacttctgacttgacaatggatagagctaggttgatctttggcctagtctctcgcttgaatatgaacataggggcattgatctctggccagatgaccttatag

SEQ ID NO: 32541 - DNA, 141 bp, Glycine max
  Peptide Sequence Number=SeqID_124226
atggtgattttccaccatggagatgcagcggaagacaaaggagaagaggtagcttccttgagaagctttcttaagaaaacttccttgagaagcttccttgagaagctagagcttagctacacacacccatctaaaaactaa

SEQ ID NO: 32542 - DNA, 171 bp, Glycine max
  Peptide Sequence Number=SeqID_124227
atggacgcgttttataagaaatggagagagggaggtagtcaaagatcacgagctagagagtggaagctgccatcaagcaacaacaatatgagatggagaaggggagaagatggacaagggaatggaaggagatggagaaggggagaagatggacaatggaagtggaaatga

SEQ ID NO: 32543 - DNA, 295 bp, Glycine max
  Peptide Sequence Number=SeqID_124228
tgacaacaatagtagtagtgataccaatatcgacaacaatagcaatagtgttgatagtgatgtttgcgataacaataataacaatggcaacaatgacaacatggtgttgacggtgacaaaggtgccagtgctagtgttggacaatggcaacgataataacgatggagattgcattagtagtggtggcgatagcagcaatcatgccaatgatggtgatagtagtggtgacaacaaaatggtcattgtcaaatgtaaagagtgtgtttatttaaaactaaaaatcaaattcaaataa

SEQ ID NO: 32544 - DNA, 432 bp, Glycine max
  Peptide Sequence Number=SeqID_124229
atggccacaagcctttggattatggaccgggcctttgaattgatgcagagaagtgacattataattcaagggctgaccattcttgctccagttgactctccaaacactgatggaatagatccagttcaatttgggtctgctggcatgttcatatttgcgatggattctataaagaagggtatgagccattacgtgttcatcgtctatcgtaatgccatcgcctctgtatctcttgctcccttcgcatttgttcttgaaaggaaagttaggcccaagatgactttccggaataatgttggaccagtgcatcgccctcttgggcatgaaattcacgtcggcatctttcctatctgctgttatgaactccgctcactctgttacttttgtgatggctgtcattctaagatttgtttgctacctttgaacctttaa

SEQ ID NO: 32545 - DNA, 378 bp, Glycine max
  Peptide Sequence Number=SeqID_124230
atgtacactctatttgaagcgaaccacaaaggatgtaccctcccttgtgttcactattacaaccaagaagctactcgcttcttacacagaattctcagacgctttgcttccacatacacttacactgttcttgctagcgcttattcaaatggtggggagatggaagattatggtgtctgtccaagcgttgatgagtatgacaagttaatacagtctctgtggttggaggctttggattgggaaatggcagaaaaactacaggaggaaatgaaagagagtggtttgcgtctcaagagcatcacaaggggtttgattagagctgtcaaagagacagacaaggaggttgtggaggctgaaagcattactgtagtggcataa

SEQ ID NO: 32546 - DNA, 102 bp, Glycine max
  Peptide Sequence Number=SeqID_124231
atggtcatttcgttgcgaggctactgtgaagaaggtgaagttgtgggagaagaagttgtcgtcgtgggagtagttcgcacaaagagaatggggttagggtag

SEQ ID NO: 32547 - DNA, 338 bp, Glycine max
  Peptide Sequence Number=SeqID_124232
cgctttccgccatcgccggcaacactggagcaaaaaaaggtaaggttcacggtgctgacctcgacggtggacgcgcaaacctcctcaacgaccgttgctcttcacggaagcttcctcgcagcaccaccgcaagctacctcggcaacctcctcaacgaagaagaagaagaggcacaaagaagacacgcaagcaatgaagaagaaggcgcaggaagaaccaggaagaagaagcaggaagaagaagaagcaggaagaagaagaagagagctgatccgaaagaagaagaagcagaagcgccaacgcggggagggagagagagaggtttcgttttttttttaa

SEQ ID NO: 32548 - DNA, 336 bp, Glycine max
  Peptide Sequence Number=SeqID_124233
atggagagagagatgataacaatgatagtggacacgttaccagtgttctactatgagaaaatggtgggttatatgccttcaagctttgcagatttagtgtttgctagcgagaggatcaaagtaggtctaagaagaggcaaatttgattatcctgctttgatgaataagaagcctggggcaaatggaaggaataagaaggagggagaaacccatggtgtggttgccactcctacaaggccaaatttcccattagcccaacaatatcaattctcatccaatatcagtccttctcattacccaccaccctaccagccaaaaacgcccaatcatccataa

SEQ ID NO: 32549 - DNA, 942 bp, Glycine max
  Peptide Sequence Number=SeqID_124234
atgactaacagtgatggaggatgtgatgcaaaagttaaaaacaataagggagcaacatgtgaactcaaggagaatcccacacgaggccttggcggcaaactaaaaactacagaattagaacgaggagatcagaaggagagcaagggaggtacaagtggtgtgaagacgattggaggtagaggttatggtcgaaccgccaagggatttccaacctctttcagaaatgatcatggtggagaaaattccgcaaagctatttgtttcccatgatcactcgctgcttgtacatggggttgcatgtaagacagttctaggaatcattggttcggcgaaatgttgcgaccatggcagaggtttgatcccatgtaacatgccacatagaggcggaggaggtgtcatggtgtctagttcagtgaatcatgatgttcttgataggcctagggttgttgttgaggctgtggagatgatccctttaaatacaactagaagggcgatcttgaaagacgtaaataatgtcggtttgctaaaattccaaatttcaaccagtagagatgggccaatggaaaagtttgctaggaacaaaggcaatcagcgaaattcaaaacaaaagggaaacaaggacgatcaggggtcaaggccccccacttggggggtcgggaacgatggtggagcccagtggaagttgtatgggttcaagtctgatcaccaagttaacatgttggatctagacccgaggagagattttgaagaatggaggtcgacccctatagaagatttaaaggatattatgatcggagaagggagaatcatcaagattagatcaaccttatctccaaaagtagagtttgaattgcttgagattgagattgattcaaagttcatgtgtcaccaattatctttggatccaaaagctaagccgattagcaaaagtggaggaagttag

SEQ ID NO: 32550 - DNA, 135 bp, Glycine max
  Peptide Sequence Number=SeqID_124235
atggatactgatatgttgtttcatgagtttggtttcatagctgctgggatgtctggggaagtttttgatggacaagatgcaggctatgtgcctgagaaccctgtttcatggcttacaatgattaagctgctgtga

SEQ ID NO: 32551 - DNA, 267 bp, Glycine max
  Peptide Sequence Number=SeqID_124236
atgcctaaaatacccatcagatgcagtatgagaacatgtttgatatatatcagaaaagttagcatcatggtcatacaattccttaatgcactctgtcgcaacgtgcctttttgcgggcgagcgaaggagaggctcacgggtgagctttccaaaggaggaaagatgcgcggagtcgccaccaacgtttatttgtgggaaacgtcggaaaaaccgaaggaaaccggtcaaaaagaaaattctaagtttgggagttgtatttacgcttga

SEQ ID NO: 32552 - DNA, 444 bp, Glycine max
  Peptide Sequence Number=SeqID_124237
atgaccaagaacaacgaagtgacgtcgaggcaagatgcacgccgatcaaggatcgaggtgcatgcaaagtgtggttgcgaagatgaagaagatcatgtgggatgttcgactgtatcattacttttttgtgagaggcatgactgtaatggaagctcacctatacaccaaaactttttagattgtcgtggcacaatcatgaccgagggtccacgtcatgatgttggatcaaaggattccaaggagaccttacctatcgtggaatcacctaggactaagctgaaggctagttacacttttccatcggggactagatgtcctctagtgttggagactagtgtagaagaggcgacatcatctattacgaagcttagggctttagagtcaaaggaagaggaggacatcgagaggacttctcatgacaatcttccaagaagttcagtctag

SEQ ID NO: 32553 - DNA, 243 bp, Glycine max
  Peptide Sequence Number=SeqID_124238
atggagggaggcataggtcccatactagacctcactcccaaagaaaagaaaaggatagaaggtctcaagagtgaagagagaaaagttccattggctacccttagcttccaagggtatgccctctattggtggacttcccttgttagggaaagaaagattcatgggggtcccacaatagagtattggaatgatcttaagagttcccttaggaagaggcacattccctcctactatgaaatgtag

SEQ ID NO: 32554 - DNA, 140 bp, Glycine max
  Peptide Sequence Number=SeqID_124239
gtgttgctgattcagatgatgaggggtctacagatttgaggacaaatcctcttcaagagggaggcgatgatgcaatcctcccaaacccatcaccagagccatggctaggagactccaggaagattgggccagggatgtag

SEQ ID NO: 32555 - DNA, 378 bp, Glycine max
  Peptide Sequence Number=SeqID_124240
atggagttagaagcaactccaatttcaacattagattcagcttcaccaatgataggatccacttggtgtgtgaagaagaatctggagaagggcaaagaagccataaatgagaagagtctaatagcatcacctaccatcatgatgataggcatccgtaggcttgcagctggtgtctcgctaagcaaggcttatgcacttagcgagaatcatgcgctaagccaggcactcagcctacttagcgagttgggagaatttggaggagaatctgagaagcatctacgcactcagcgcgtcatcagctcgctcagtgaggcgtttgtctcttaccgtgctaagcgcgccttgctcgctcaacagatattcactaactcgcgctaa

SEQ ID NO: 32556 - DNA, 360 bp, Glycine max
  Peptide Sequence Number=SeqID_124241
atgagtccaaatgtggctgaagtcctagatatggtcatgaaatatgctgtgtttcatgatatccaaccgttgacaatgcatatagatttaaccggaacagccagtatgtccaaaatctatgatgatggatacatcccgaaacactcggtccttgaacttcagaaagcctggccaggttctgaggtgagatgggtcacaggtgggcatgtctcttctttctgccccatggtgaattcagaagggctattgttgaaggccttaattgattaccgtggaaggagtctccattgtgacagggacattgcacaggcacaagagattgttttgcaaattgtgaagatattgtttttccaattgtag

SEQ ID NO: 32557 - DNA, 276 bp, Glycine max
  Peptide Sequence Number=SeqID_124242
atggcatcaagcaatagtccctggacaaaattagggtatgacagttatggtttagcatatattctttgtaagttgtgtaaatggaagttcaagctctacaaggcttcaaaagaactgacagatattgagacccagagaaaacaggaagcaaatgaattttcattcaaattggaaagcacgaggagaaagttgaaggaggccattgaagagatcgatgagtcaaaggagcttgaaatgaaattggttgtgacaatattagatgttgatttcttgtag

SEQ ID NO: 32558 - DNA, 405 bp, Glycine max
  Peptide Sequence Number=SeqID_124243
atggtgagaaatatgattagtcattcctctttgccaaagtcactttggggagaatccttaaagaccgcagtttacatccttaatagggtgccagacacaactctagtaatagaagacaatgttcaaactattgacattgtttcaaaacaagacaataatgaggttctccctcaaatacctttagagcaacctcaacaacctcaagaagtgcctttaaggagatccattagagagaagagaagtgcaatctcaaatgattatgttaaattttttcaagaacatgaggatggtgttggtttaacagaggatgatccaatcaacttctgtcaagctatgtgcagttttaactctcaaaaatggattgacgccaggaaggatgagatgaagtctatgaatgacaatgaa

SEQ ID NO: 32559 - DNA, 369 bp, Glycine max
  Peptide Sequence Number=SeqID_124244
atgattcctcctacacccacacagattccactaccagctcctctttctgcaggtccaacagattttattttcactcctcaaatgcttcactacatgctccataccatccatagagggcagtccatcattattcagagcctgcagggcttgggctttccctccattatgagcatggaggagtttgatgcacaggagcctatgactaaagagcccacaacaccagtaccatcaccagcagcagtagaagaggagaccactccagctcagaccccacaaccatctccaccatctgcacctgctcctgaggagactcagccatcagcattggatattaatgaagaccagccacaggaggagcaggacgtttaa

SEQ ID NO: 32560 - DNA, 309 bp, Glycine max
  Peptide Sequence Number=SeqID_124245
gtatcatccccttcgacaaacatattgcggcaatagggactaccagcaacaatatgttatcaaagagaaaaactctagatgagggttcactgttatcaagcaagtcggagatccagcatgaccacaaattcacctccactccttatgttcccatggacccggtggagtcgccaactgtcgcaacctacccttcggcggtagggcgacgcgagactcacgtgtgcatcttccaagaaaggaaaatgcgcggagtcgccatcaacgtttatttgaggaaaacatcggaaaacattggaaaaaccggaaaag

SEQ ID NO: 32561 - DNA, 579 bp, Glycine max
  Peptide Sequence Number=SeqID_124246
atgacatcacggcacacacccccgattgaggtagatatacaactattagctgcacgtgtgagcacaaaggggaattatgctgaaactgcggccaatccatcaggggaagagtatgttattgatgtggtgcctaaaatggggttgtacgttcaatgtcatcattgtacttgtctagtggccttgggaaaagtttacaacggggcatccaccatatgtaatgtggcttatgaagatgatgtgatcagggattcacagattcatccaaagaaacccattgaaactattcaaaggtcgaatacccttggtagagttgagcccttgggtgacttgattcataacctgtatgatgtttacgagaagctgcttgagttgttgtgggataagagtaaatttaggattcttaatgtagaagcatccttcttcataatatatgatgtaaatgaaataataccaggtttatggatgagtggagtacaaggttgggtcatggttcggtgtatgaattccttgagcctcagtccatacacaatgcaaaggatagatgtgttaaatgtcaacaatacattgaaacatgggtga

SEQ ID NO: 32562 - DNA, 381 bp, Glycine max
  Peptide Sequence Number=SeqID_124247
atgcctgacccacaaaagaggagttcccgggacatgtgctcatgggagaagggtcagtggattccctttgatgcagatgccctcagccagttcttgggtgacccgttggttttggaggaagaccagcagtgtgaattcagccaaaggaggagccaggcagacaatttcgatgaggaagccatcgccctgctgctgtgcataccgaggcaggatttctcccgaacggttgcagggaggcgggtgcggatcatgcgcaccagcatgactactttgacccagatatggatgacactgctgctcagcaatgtcttgcctagcaaccacaactccgacctccctctgcctaagtgccagttggtgtatgccatcctgaccggatga

SEQ ID NO: 32563 - DNA, 563 bp, Glycine max
  Peptide Sequence Number=SeqID_124248
atggagtcaggtgacatgcggagataccttatggtcatccgcacctttcgtcaaccaggggcaaacgagctcgttggcgcgcagagactaacatcgtcttatgcaccttttgccatccagggacagcgagtcaggtggccggtggagataccttatggtcatctgcacctttcgtcaaccgaggcgaacgaattcgacggtatcaggatgattcgtccggagacatgcaagcccgacgacgcacaagattcttctctgatgggcggggaggatcaagttcgatggcgtagggaagtgtcgtggttgtccccctttatcgctttcaagacaccgaagggggtgcaaatagcagtcaggcccacttgggccttccagggggttcccatagaaggcggtggcttctgttggaagcaacccagctcgcctggtgaggaaaactgtttccgtgaaaaaaatccaagccgaggcgcttccgtaacgcttccgagacgtttccgtgagcaatttcgtgaagattcttcaccgttcttcatcattcttcgtcgttcttcggtcttcaacca

SEQ ID NO: 32564 - DNA, 1113 bp, Glycine max
  Peptide Sequence Number=SeqID_124249
atggcttctaggaaaagaaaggcaccctctacacctacccaagacagatttgatagatccagattcacttcccaagaggctttggagagatacactgacattgtggtgcctcgtaagcttttaccagaaaggaatgtggtagtctactatacagagtttgatgagttcaaggaagaactcgagatacaccattgggatgaggagttaactaactttctggacgataacattgatgttgccattgtaaaagaattctatgcaaacctctatgaccccgaggacaaatcacctaagcaggagttagctgctaagctctgtctcctagggaggggatttgagcttaatgctgatgggcaacctttgaagattctgaggaagaacatgaccactcttgctcagacttggagcgttctttccttttctaacctcatccccatttcccacacttctaatgtcactcttgacagagccaaactcatttatggaatcatcatgaagatggacatgaatgtggggtacctcatctcccaccagatcttcttcatagcacagcatgacacatccagactaggatttcctgccttgatcacaactttatgtaaggctaggggagttcagtcatattcgaggtctctggagagcctgagtcctgccattaatttggcatatattaagaagaaatgttggaatcttgatgatccaataataactttcagaggacctaggaaggccatgggtaagagatctgaggccccttcctcttcagcaccagagacaccagctccttcttcttccacagctccattacctctcattcaaactccagttattcctcctacacccacacagataccacttccagctcctttatctgtagggggtggagcctctgcagcccaggagcctgtgacagaggagccaccagcaccagcaccagtagcagcagcagcagagggggaggatgagctcacccctcctgagcctttttattttgatgcaaatccatacatggaacaggagaagggtaccctcacagatcagatacctgagccatcctctgcaccttctcctgaggagacccaaccatctacaccagttgcggagcataagcag

SEQ ID NO: 32565 - DNA, 528 bp, Glycine max
  Peptide Sequence Number=SeqID_124250
atggccaagtttgaccctgagatagtcctggagttctatgctaatgcttggcccacggaggagggcgttcgggacatgcgttcgtgggtgaggggtcagtggattccctttgacgcagatgccctcagccagttcctgggtgacccactagttttggaggaaggccagcagtgtatagcgcccaccaggcaccctctggacctagataagtccaacagggccctggggtttccggcgctgatcacaggcctctgtcaatcctatggagttcccgtcacccccaataaatactacacgcctaggcaggcgcagggtgatgcacatcaggccgcagacgcacaaccaccacctcggcaggccgatccagctgggtcactaggcgtggagcgttatctacagcatttggttctccagcaggtggccaaccatcgtggtcagcaggggcagggttctaccccttttgtatgccctaccccggagcagtttggggctgaggttgcatggcctggagactggctcgatgcctag

SEQ ID NO: 32566 - DNA, 453 bp, Glycine max
  Peptide Sequence Number=SeqID_124251
atgtcatcggactcgccgtctctggatgacaaaggtgcagatgacgacgttagtctctgcgtgtcaacgggctcgcttgcctctggttcaaaaggtgcggataaccataaggtatctccgtatgtcatgactcaccgtctctggatgacaaaggtgcggatgatgacgttagtctctgcgtgtcagtgggctcgcttgcctctggttgaaataagggggataaccataaggtatctctgcatgtcatcgaactcaccatctctggatgacaaagatgcagatgacgacgttagtctctgcgtgtcaatgggctcacttgcctctggttcacaaaaggtgcggataaccataaggtatctccgcatgtcatcggactcaccgtctttggatgacaaaggtgcagctgacgatgttagtctctgtgtgtcaatgggctcgcttgcctctggctga

SEQ ID NO: 32567 - DNA, 240 bp, Glycine max
  Peptide Sequence Number=SeqID_124252
atgctcttgataccacatgatgtagctccatatggagcttgtaggccttggatcttcttcatcaatagattcctttgcttcttgaggtctgaatgcaatggaatggagaaggagaaagatgaatggagatgccacttcaaaggaatggagaaggagaaagatgattggagatgccacttcaaggagaagatgagtcaagaagaagctcaccaccataggaagccatggataagagcttga

SEQ ID NO: 32568 - DNA, 219 bp, Glycine max
  Peptide Sequence Number=SeqID_124253
atgaatgaagacatgaagcttacctcgagtggcagcgacagtggctgcgagaagcaacacggagtgggagtgagaaagaagatttgtgatatggtggaggcggcacaaaactgcgatgaagatgatgacgtggaggcaacacaaagctgcaatgcacatgaagaaacgctacagacatattttttggacaaaccgatgttaacgaacattatgaagtga

SEQ ID NO: 32569 - DNA, 4435 bp, Glycine max
  Peptide Sequence Number=SeqID_124254
ggctacacaccctcgcgttgggagaactgcacgtcctcaccttcagagggccacccatccttgccttcagagggctatacgtcgtcgccttcaaaggagtgcacgtcctcaccttaagagggttgcacgcctacgccttcagaggaccgcacgtcttcgccttcagagggcaacacatactcgccttcacaaggccacacgtcctcgccttaagaggactacacatcctcaccttcagaggactacacgtcctcaccatcagagggctacatgccctctccttaagcgggctacacgccctcgcctttagagggctgtacgtcctcgccttcagaggactacacgttgtcaccttcagaggacaacacgtcctcaccttcagaggactacacgtcctcaccttcagagggctatatgccctcgccaaggcgagggctacacgccctcgccttcaaaggactacatgtcctcgccttcagaggactacacgtcctcaccttcagagggctatatgccctcgccttcaaaggactacatgtcctcgccttcagaggattacacgactacacgtactcgccttcagagggatgcacgccttcgccttcagaggaatgcaggtcctcgcctttagaggactgcacatcctccccttcagaggaatcgacgtccttggctttagagggctacacaccctaaccttcaaaggactgaacgtccttgcctatagagcacacgtcctcgccttcagaggaatattggtcctcacctttagaggattggacgccctcgctttcagagggctgcatgcccgcgccttaagaaggatgcatgccctcgccttcatagggctacttgacctcacctttagagggatacacgtcctcgacttcaaagggctacacttggacgccctcgccttcagagggctacacgcctttgcctttagaggcctgcacgtccttgccttaagaagggagcacgccctcgccttcagaggaccgcacgtcctcaccatcagagggctacacatcctcgtctttagagggctacatgccctctcttttagaggaaaacatgtcttagccttcagaggactggctgcacgccctcgccttcagagggttgcatgtcctcgccttctgagggcttcacatcctcgccttcagaggggtgcacgccctcgccttcagagggtggcacgtcgtcgccttcagagtactgcacggcgacacgtccttgccttcagaggactacacgtcctcacctttagaggactgcacgtcctcaccttcagagggcttcatgcccttgccttaagagggctacacgccttcaccttcagaggactacatgtcctcgaattgagaggactactcatctttgctttaagagggcaacatgccctcaccatcaaaggaccgcacatcctcgccttcagagggctacacatccactcctttagagggctacatgccgtcaccttcaaagggttgcatgtcctggccttcagaggactgcacgtcctccccttcagagggacacacgttcttacattcagggggctgcacagcctcgccttgagagggctacacgccttcaccttcagaggacttcacgtcctctcctttagaggtctacacgtcctcgccttcagaggactacatgatctttactttagacgactatatgtcctcactttcagaaggctgcacgccctggcctttatagggctacatgccctcaccttcataggactacatgttctcaccttcagagaattgcacgtcctcaccttcaaaggaagacacatgcttgccttcagaggactacatatccttaccttcagagggttgcacgacctcgccttcatagggctacacgcctttgaattcgaaggactacacgtcttcaccttcacaaaactacacgtcctcgctttcagagtgttgcacgccttcgcctttagagaactgcacgatggcacgtcgtcgccttcagagtactgcacgtcctcaccttctgatgggcgacacgtcctcgccttcagaggactacacgttctcacctttagaggactacacgtcctcaccttcagagggcttcatgccctcgccttaagaaggctacacgccttcgccttcagaggactacatgtcctcgaattgagaggactactcatctttgctttaagagggcgacacgccctcaccatcagaggattgcacgtccttgccttcagagggggactgcaggtcctggccttcagaggactgcacgtcctccccttcagagggacacacgtccttacattcagagggctgcacagcctcgccgtgagagggctacacgccctcaccttcagaggacttcaggtcctcgcctttagagggctacacgtcctcgcctttagaggagtacacgtcttcacctttagagcactacacgtcctcgccttcacaggactacaagacctcgactttagaggactatacgtcctcactttcagagggctgcacgccctggcctttatagggctacatgccctcaccctcataggactacacgttctcgcctgcagaggactacacatcctcgcctttagaggactgcacattctcgccttcagagggctgcacatcctcgccttcagaggactgcacgccctcgccttaagagggctgcatgccctcgcctttagagggtttgacatcctcgcctttagagggcttcacatcctcgccttcgtagggctacccaacctcgcctttggagggctacacgactacaccttctcgcctttagaggactacacgtgctcgccttcagaggactctaggtcctcgccttcaaaggactgcacatcctcatgttcaaatgacatcacatcctcgcctttagagggctacagaccctcgcattcagagggctgcttgtccttgcctttagagggccacacagggttgcacgcccacgcctttagaggatcgcacgtcctcgcctttaaagggctacacatcctcgtctttagagggctacatgccctcgctttcagagggttgctcagcctagccttcagaggactacatatccttgccttcagagtacttaacattctcacctttagagggccacacgtcctcgccttcagagggcttcacatcctcgccttaagagggctgcatgccctcgcctttagagggcttcaaatcctcgcctttatagggctacccatcctcgcctttgaaggactacatgtccttgacttcagaggactacatgtcctcgccgtcagagggctacacattctctcctttagagagctacacgccttcaccttcaaagggttgcatgtcctgaccttcagagcacagcaggtcctggccttcagaggattgcacgtcgttcccttaagagggacacacaggactacacgtcctcgccttcggagggctatacatcctcaccttcagattagtacacgtcctgaccttcagaggactacacgtcctcgcctccagagggctacacgtcctcatcttcagaggagtacacgtcctcagcttcagagaactacacgttctcaacttcagaggactacacgtcctcgccttcacaggactacacgacctcaccttcagaggactatcgtcctcacttttagagggttggacgccctggcctttattgggctacacaccctcaccttcgtaggactaaatgttctcaccttcagagaactacacgtcctcaccttcaaaggactagatgagcttgcctttagaggactatacgtcctcaccttcagaggagggttgcacgccctcgccttcaaagggctgcatgccctcgcctttagaggactgcacgtccttgccttaagaaggcaacacgccctcgccttcagaggaccacacgtcctcaccttcagagggctacacatcctcaggactgcagggcttgacaacctcgccttcatagggatagctgtccttgcctttagagggctacacatcctcgacttcagaggactacacatcctcaccttcagagggctacatgtcctagacttcagaggagtacacgttctcgccttcagaggactacacgtcctcacttttagaggattacacgtcctcaccttcggagggctacacgccctcgcatttagagggctacaagcccttgccttcagaggactacacgttctcaccttcagagaactacacgtcctcaccttcaaaggactacacgtgctcgccttcagaggactacacgtcctcacctttagagggttgcacgcccttgccttcatagggctacacaccttcaccttcagaggactacgcatctttgccttcatagggctacacgccctcgccttcagaggactacacgtcttcaccttcacaagactacacgtcctcgccttcagagg

SEQ ID NO: 32570 - DNA, 649 bp, Glycine max
  Peptide Sequence Number=SeqID_124255
aggactacatgtcctcgccatcagaggactacatgtcctcgccttcagaggactagacgtccttgcctttagagggctacatgccctcacctttagaggactacatgtcctcgccttcaaagggctacactctctcaccttcagagggctacacgtcctcgccttcagagggctacacgccctcgccttcagagggctacacgccctcaccttcagaggactacatgtcctcgccttcaaagggctacactctctcaccttcagagggctacacgtcctcgccttcagagggctacacgccctcgccttcagagggctacacgccctcaccttcagaggactacacgtccttgccataagagggctgtacgccctcaccatcaaagggctgcacgccctcgccttcaaagagctacacgccctcaccttcagaggacttcaagtcctcacctttagagggctgcacgcccttgcctttagaggactacacatcctctctttgagcgggcttcacgccctcgcctttagaggactacatgtcctcaccttcagagggctgcacgtcctcgcctgcagagggttgcacgccctcgccatcagagggctccacatctatgccttaagacaactcaaggtcctccgcccttaa

SEQ ID NO: 32571 - DNA, 1047 bp, Glycine max
  Peptide Sequence Number=SeqID_124256
atgatttctgttaatcctgacccgagaagtcaggtggcaggcggagatacccaagtgcatgcaaagactaacgttgtcatctgcaccctttgtcaacaaggggcaagcgagcctgttgacacgcagagactaacatcgtcttctgcacctttgtcatccagagacggcgagtccgatgacatgcggagatacccaagtggtcatccgtacaaaatgatttctgttaatcctgacccgagaagtcaggtggcaggcagagatacccaagtggttatcaagactaatgtcgtcatctgcaccctttgtcaactaggggcaagcaagcccgttgacacgcagagactaatgtcgtcttctgcacctttgtcatccagagacggcgagttcaatgacacgtggagatacccaagtggtggagatacccaagtggttatccgtacaaaacgatttatgttaatcctgacccaagaagtcaggtggcaggcagagataccttatggggcaagcgaggccgttgacacgcagagactaacatcgtcttctgcaccattttcatccagagacaatgagtccgatgacatgcggagatacccaagtggggcaagcgagcccgttgacacgcagagactagcgtcgtcttctgcacctttgtcatccagagacggcgagtccgatgacatgtggagatacccaagtggtggcaggcggagatacccaagtggttatctgtacaaaacgatttctgttaatcgtgacccgagaaagactaacgtcgtcatctacaccctttgtgaaccaggggcaagcgttaccattgacacgcagagactaacgtcgtcttctgcacctttgtcatccagagacagcgagtccaatgacatgcggagatacccaagtgtcaggtggcaggcgaaaataccccaagtggttatccatacaaacgcacttctgttaatcctgacccgtgaagtcaagtggcaggcggaaataccccaagtggtcattcgtacacacgcagttctgctaccccaacctgtgagaagtcag

SEQ ID NO: 32572 - DNA, 108 bp, Glycine max
  Peptide Sequence Number=SeqID_124257
atgactcctattcttgataactcacttttctctcaaaaagacaaactttcaagaatgttaaaaatgaagtcacataaatgggaaaatgcaaggatcatgtatgagtga

SEQ ID NO: 32573 - DNA, 336 bp, Glycine max
  Peptide Sequence Number=SeqID_124258
atggggtcggatcaagcgtcatcttttaagaaaatcttttatcatgtcaaagtcaaaaatctagaagtagccaacttgcgaaaactggggcagcggatgggtcaaatctgggatctgacgatgatagaagtttcagttgaagcaatcgcatctcacactcaatactatgaccaatcactcagatgcttcacttttaaggactttcaattagccccaaccgtagaggagtttgaagggatcttaggatgctcgataggaggaaggaagccataccttttttctgggtactatccttctatggcgagaatagcaggagtggtcaagatctcagaatga

SEQ ID NO: 32574 - DNA, 252 bp, Glycine max
  Peptide Sequence Number=SeqID_124259
atggaaattttgatggccaatacttcaacaccctatcataaaggagatatgatgaatgaaacagggcatggttatgttatgcatgacaaacatatttatcaacttgacacaagaggcctgaaagaccacactttcttattaacaatgcattggttattaccatggtacccaacacatgcaactaagaatgcggtgcagactttcatgcttcattgtgactttgacaacaaagaaaaagaaggcaagttataa

SEQ ID NO: 32575 - DNA, 291 bp, Glycine max
  Peptide Sequence Number=SeqID_124260
atggataagagcttgaaggtaggagaaaatgggatgagggagaaggagagaaggagcacaaaattttgttcctcgaaagagcaagcaacagcggcttgtggtggccaccggtggtcgtgggtggtggaggaggacgtgttagggcttgggtgggcatttggagagaaaaggagtgaaaaatcctgttttcacgctgcagaacatatttataacctgcagatctcgcttagcgagcttgtctcgctaagcgaaagttcacttttggcgctaagtgcaacttttggcacttag

SEQ ID NO: 32576 - DNA, 561 bp, Glycine max
  Peptide Sequence Number=SeqID_124261
atgacttggctccaaaagctaaagggtttgagtgcagaaaaggctaaaatgcctgagaagagtgaaaaggtgcaagccttgaaaactgagctcaaaaagataaaagtagcaaaggagaagctaaaggtggcagtcactagggttaggaaagaatgtgatgagctaaaagatatcaacatgatcgcagctgaagtgctagagcgggaaacgaaaagggccagaaaggaagagtggagtagaaacaagtttcaaggggatttgttaggtagcagtaatgagcttaaacttagaaaatccgagagggaaaaatcaaggatggaaagcatgatgttagaggataagttaaagagttttcagaggtcaaagagatgtttgacagagcagttaatcattcatcaatataaagagaaggtgaacctagctgctagtcacagtcttcgtcgtcgtcatcatcaaaatgtaatcatagtaataaaaaagaatgaatgcgctttacgacacccttaccaaacacgtgccaaggctagaatcatgagtgagatagaggacgttcaagaatag

SEQ ID NO: 32577 - DNA, 207 bp, Glycine max
  Peptide Sequence Number=SeqID_124262
atgaacatgatgaaggtgttgcaagagcataataaaactttcataaactggtttaaagatctaatcttgggtgatgacaatgcttctaaaacattaagactgttagctgttaggacaaatctcaatgtccccacttggaagaaccgtcataaaaatgaagagacatttcatgacgttggatacgatgatagtcaaaaactgtcatag

SEQ ID NO: 32578 - DNA, 432 bp, Glycine max
  Peptide Sequence Number=SeqID_124263
atggatgacttaatactcaatgaagatgcacatgttgttgacctcatggtaagagacaaaactacaagttcaaagaaagatgtccatgcctcaatagtgaatattgccatccaactcgagcacctttctccaattcaagttgagtttaaggaagtaatacccatcaatgagtctaatgatcaaaaggccgaagaaactcaacaagccatagataaacaagaagaaaaacatcacactaccattagagctttcactgagcaacaatggactgagcctgaacaacacacgcaatatatgcaagcatcaatggttgaacagttcaagaatcttgataatggagaaggaagaaagatgattggagatcttcacttcaaggagaggatgagtcaagaacaagctcgccaccataagaagccatggataagagcttga

SEQ ID NO: 32579 - DNA, 339 bp, Glycine max
  Peptide Sequence Number=SeqID_124264
atggctcataagtgtggaagcaatgccttccaaggttattttgatgatgccaaagaatcaagagtcaagcaaattccaaagattcaagaatcaagtttcaagaataatcaagatcaagattcaaaaatcaagagaagaggtacatctacttgggttgttgtaactgagaacaagagagggtacatctcttgtggatcagttctagtggagggtacatccactaggttgttcaaagagaacaagggagggtacatcccttgtggatctttgcttgtaaaggattttacaaggttgaaaagaaatatcaaggaccgcaggtcacttggggactggatgtag

SEQ ID NO: 32580 - DNA, 381 bp, Glycine max
  Peptide Sequence Number=SeqID_124265
atgaagaatggagaaaccattttagaacttcaaacaagactcacccatattgtgaatcaccttcttggtcttggaaaaacatttgaagatgatgatctaaacatcaaaatccttcacttgagttcctcaaaggtagattgcaaagaaagctctattgatgacgaatatgtggagaatttaagcttgaaggtgaagaagtttggaaaatttctcaaaagatccaaagaaagaaaattctctaaatcttcaaagaagatagaaagcaacaacaacaccatcacatgcttcgaatgtgggaagcaaggtcacatcaaatctaaatgtcttatctaccttagaaaacaacttgttgaaaagaaaggaaagaaggatagaaaatag

SEQ ID NO: 32581 - DNA, 516 bp, Glycine max
  Peptide Sequence Number=SeqID_124266
atggggtcgaaccaagcacatgcttttaagaaaaagttttcatcaagccaaggtcaagtatggaagaaagaatgtgctttacagggcccttaccaaacatgtgccaaagctagagtaatgagtgaaatagaggaggtgcaagaacaaatgaaggttgacatggaggccatgaaagaccaaatggctgccatgatggatgccatgttgagcatgaagaaaataatggaaagcaatgcggctgcaattgccactatgagtgccgccactgaggtaaacccgactcacccatcaggcctcaatcaagtaaatcctccagtctcggatatgagcaagattcttttccaccataaggcttgcctcccaactatgcaccacccaatgttgtataggtgcccaacgagaatgcagaccactccgctcttgttccccttgaaagccagcaaccccagttggggcatgcacattttgcttagcccatggaggggacacatgaagtaccccgagaccacactctag

SEQ ID NO: 32582 - DNA, 270 bp, Glycine max
  Peptide Sequence Number=SeqID_124267
atggctgcacttgatttcacttatgaaagcttgtgcattcaatatcttgatgagggtgttccatatgttctcaagattggactaatacatttgctgcccaagtttcatggtcttgcagaagagcatatctttctaatggcttttcctcattctctggagggagtggcaaaagattggctatactaccttgctcccaggtccattttcagctgggatgaccttaagagggtgttcttagagaaattcttccctgcatctgggatcctctag

SEQ ID NO: 32583 - DNA, 258 bp, Glycine max
  Peptide Sequence Number=SeqID_124268
atggactacactccaccaattgtccaaccaaatgatttcctgagcaatgtttatggaactgattgtggcacgccagcatcagctcgtgaatacatgcataagttacagaacaaagtgggtaattttactccaccaagtttcaatttgatgtttaaccaagatgttgaagagaataatccatcattgcatgatataccaaatcaacgcccacgtcgaaatccaggacgtaataggagatgccctccatgtggaacatga

SEQ ID NO: 32584 - DNA, 567 bp, Glycine max
  Peptide Sequence Number=SeqID_124269
atgagtccaaatctctctggcatgcgaacaatcacgaagacaatgaagagtgtcttcctgcgggagaataagccaaaagaaggttctaatcttctctggaatgagaggcttccaaagccatttgaagttggccggggcggtgtcaagatggccactgttgtgccaagagtagcccgacgcagctgtgtgcacctcattggagctatgagaccacacccatcgatcttggaaactgggggacaaatattgcagtcaatggaggctaatctggacaagaagtcctcagaaagcatgggggtcaaagcttgttcattcatcataccagagggacgaatcacgagtgcccaagagaaacttgaaaccaaagagaagcttatctttggctttgaggataccgcgtcagacataagaatcaccctggcgggccttagcactcataaagaaggagtgaatcaggtacttgtgtataagaacacgaacccacaaggtgtccttcctctcaaccatgttccacacaagcttgccaagaagagaggtgttggtgttacgagctatgcggatacctaa

SEQ ID NO: 32585 - DNA, 258 bp, Glycine max
  Peptide Sequence Number=SeqID_124270
atgatagccctcatgaccctcattgttgccccccacatgactgtcatcattgctgtaatgacaacaacaatcatgttagtgggggcggcagcgattaacaatcatggtgatggttgtggtggtggatatgatagttgtggcagaaacggtcatgataatgggggtggtggtggtcatagtgataatagattcttggagtctaagtgtgaatgtgaagtcccacatcgggtaggaatgagaatgttgaacaccacataa

SEQ ID NO: 32586 - DNA, 321 bp, Glycine max
  Peptide Sequence Number=SeqID_124271
atgtgtcttttcaagaagctttttctgaaattcttcattggtaatcgattacagagcgtaaagggcacctgttattgggttacaaagtgggttggggtgcagagccaggttcgacttggtgaccggctcgggcgagtaagatggcgacagtggatccttggcctaggaatctcttgtatcgaaagtcttcccggcgatggattcaggtggcatgtcccgtgggtggagcagcaatgcaagtatctagagcatgtgggctctaatggtcaccttggaaatactgatgaaaatggctaccatgtgaatgagactcatacttga

SEQ ID NO: 32587 - DNA, 369 bp, Glycine max
  Peptide Sequence Number=SeqID_124272
atgtcgcgggggtcaggagaccttggggacgtcaggtggggtgctattgcccaaaaccaagcttggccaatcccgacccaacccgggcatagtcagtcagtgagaacctgtgatgtacctaaacaggcgagctcctggcagtcaaccaataaaagaacaaagtccacaaagcaaggaggcttgtgtggcggctggccatctatttatcttgggtgttatctgaaaaataccctctgggcactggtaatcaattaccggttgtgtgtaatcgattacatagtgttacctgctactggtaatcgattaccatttatgggtaatcgattacacagtgtaacttttaggttccaatgtgcaaaggctgtgtaa

SEQ ID NO: 32588 - DNA, 1089 bp, Glycine max
  Peptide Sequence Number=SeqID_124273
atggacttgaaagaaaattgtacttatgtcatgcacaattttaaagtgctaaaaaacaatggtcagtacagagtgtgtgatcatcaatttaaattggtgtttattggggttactattgtggctgaccagtttaaacctggactattggttgatgttattggtgttgtggaggaggttgtctttcgacaagtttcaggaaaaggtagaagggtagtcttcaaactaaaggacttgagccagcaattgctatcttgcattttgtgggatgattattgctcacagtttttgaagttcttagatgattatgaaggtgatggcccaattacagttctattgagccattgtaggatcaaggaagcacatggatcttatcctacatcgatcaacaattctttcaaggcttcaaagttaattattaaccagcccgtgatggagattcaagaattcaatgaacggcttgtagagttaggcattgaggcccagtcaggttttaaatcccatggtgaagggagtacacagctttcaggttctatccaattatcatcaaaagaatcattctttggcaaggctgaggcaaagactattgctgacattaacaccatctctgaagaaattgtttgtgtcactgttgacacaattactaggattgttctggacaatcattcatggtataggcttgaggtgatgatcaaccagggaaatgaaagcacaaaattcctactttgggaccgtgaatgtagtgaattaattggtcaatcagttgatgcaattaataagcttaaaattgaagatggtgatgttgatttgaatgcttcaccccaagcacttgataagctgttgggttatgaacttgctttcaagataaaggtgcaaaccaagttcaggaattctgctgttttgaagtgttcagctgactcgagcttaataaatgttgtgatggatatgctagctgatgctgagacatcttcaaaaatgaatattccagtttctaattccaatcattctgctcaacatgaatctcaatccctgtctgtgacaacataccatgatccactgcttggactccccttgacgcctacaaagcggtag

SEQ ID NO: 32589 - DNA, 219 bp, Glycine max
  Peptide Sequence Number=SeqID_124274
atggcagcggaatggagaaggaagagagagaggagacgccacttcaaggagaagatgagtctagaagaagctcaccaccataggaggccatggataagagcttggaggaagaaggagatgaatgaaaggagagggagagaagagcacgaaattttcccactaatccaagatcaattccaagattctccactaagtgtgcttaggtgtcatgaggcatga

SEQ ID NO: 32590 - DNA, 207 bp, Glycine max
  Peptide Sequence Number=SeqID_124275
atgaagatgctcttgataccacatgatgcaagctccattggagcttcggaatggagaaggaagagagagaggagaggccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 32591 - DNA, 354 bp, Glycine max
  Peptide Sequence Number=SeqID_124276
atggcagaattgggcctagtgtacggcgtggtcattcctccgaagttcaaggtgtcggactttgataagtacaagaggactacttgccccaagaatcacttgaaggaagcctgggcaaatgaagagaacaagaaggagggaggaacccatgttgccattcctacatggccaaatttcccaccagctcaacaatatcaatactcagccaatattagtccttctcattacccaccacactatcatccaaggacactcaatcatccacaaaggccacccctaaatcagccacaaaaaccacctgctgcacatccgataccaaacaccacccttaacacgaaccaaaacaccaactga

SEQ ID NO: 32592 - DNA, 492 bp, Glycine max
  Peptide Sequence Number=SeqID_124277
atgtgtttccctgtgggtatggtcgaacgtgatgttccaatcagcagctaccaaatcctttgtacaatgaaccagagcatagtgaggatggtagatgtggttatccttcagaatacgatccatagaggaaagggagtcagtttcacagattatgtgcctgaaccccagatcccatgcgtgttgcactccttcatagatagcaaaaactcagcaaaggactctctggatcgtgtgattgttcttattttgtttctagaattttggaacagtgtaataatttacaaacataatatcatgctgattagagatttcatgaacaagactcattctcttcatatcttgagagagggaaatagtgttgcagatagcttggctaagttaggttcttctgatcaagataatagctggattgcgtttgatgactgcccttctagctcaaggatccatcttatagcggatgctgttggaactcgatacttaagactgagatag

SEQ ID NO: 32593 - DNA, 210 bp, Glycine max
  Peptide Sequence Number=SeqID_124278
atgtttttatcttcacaacatgtaaaatcaatatcgctcttagcattccttctgatgcaagctccattggagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 32594 - DNA, 177 bp, Glycine max
  Peptide Sequence Number=SeqID_124279
atggtgattttcctccatggagatgtagcggaagataaaggagaagaggagcttcgccaccaagaatgtgtcttggataagaagcttgaagatgatgcttcaatagaggcaaagccagagagagaaagagagaggggaagtacggaattgaaggaggaaaagggggagagaagttga

SEQ ID NO: 32595 - DNA, 318 bp, Glycine max
  Peptide Sequence Number=SeqID_124280
atgcggggctaccttagggttactcgcacctttcgtcaaccaggggcaagcgagcccgttgacgcacagagactaacatcgtcttctgcaccttttgccatccaggggcagcgagtcagatggcaggcggagataccttatggccatctacgcctttcgacaatcgaggggaacgaattcaacggttttactctcgtcgtccagaaacattcaagcccgacgatgcaagagattcttctctgctgggcagggacgatcgagtgcaatggtgtagggaagtgtcgtggttgtccaactttgtcgctttcaagacactga

SEQ ID NO: 32596 - DNA, 651 bp, Glycine max
  Peptide Sequence Number=SeqID_124281
atgaggaagccatctcctagctgttgtgcataccagggcaagatttcgcccggaccgctacagggagctgggtacggatcatggtgcaccagcatgaccactttgacccagacatggatgacactgctgctcagcaatgtcttgcctagcgatcacaactccgacctccccctacctaagtgtatggcacctactaggcaccctctggaccccgataagtccaatagggccctggggttttcggcgctgatcacaggcctctgccagtcctacggagttcttgtcacccccagtaagaagtactgcacgcctaggcaggcgcagggtgatgcacatcaggctgtaggcacaccgccaccacctcggcaggccgatccagctgggccactgggcgtggagtgttatctacaacatttggttcgccagcaggcggccaaccaccgtgggcaggtgcagatacatgagtgtctgtaccagttcagcctcaatcagcagggcaggtttggggctgaggtcgcatggcctggagactggcccgatgcccaggcaggggaggagcctataggatcccccggtgaggcggatgaatcccatatggatgaagatatgactgacctgctcgatttcttgggagggagcggagccacgtga

SEQ ID NO: 32597 - DNA, 165 bp, Glycine max
  Peptide Sequence Number=SeqID_124282
atgatgatgataaaagatgatgacaaaggtgatgacaaaaagctcaaagatcaatcaaataacaactcaagagaatcaaagagacaagaatcaagattcaaggttcaagatctcaagaatcaagactcaagattcaaggatgaagagaagactcaatcaagataa

SEQ ID NO: 32598 - DNA, 237 bp, Glycine max
  Peptide Sequence Number=SeqID_124283
atgtttgacaacactttcaacactccaccatctgcaaataatccaccaccatcgagctcttgttattgtccatcattacctactcaaacgcgtgacatgggtcatgaagatgaggaagatgatgatgataacaacaataccaacaataatgatggtgatgatgatgataacaacggtggcgattgtctttttcaacaacaacacacaataacacatgagcatcctaaaacaagatga

SEQ ID NO: 32599 - DNA, 291 bp, Glycine max
  Peptide Sequence Number=SeqID_124284
atggctgctgacttcgatttgaccaaactccgctctgagaaaaatttcatggcaagtgtcacttctgtatgcggcaatgaatatatgttgttcattctccaaatagtttgtggaaaaacaacagtcatgagtgcattggatacctttcaagatgagtctttgtctttgatgagaatcctgaaactggccaaatacaggctaaagtcccaagtggagaaggacgaaggcctaagtggaaaaggacaaagcccccgagtggagaatgatgaaggcccaagtggaaaaggatga

SEQ ID NO: 32600 - DNA, 192 bp, Glycine max
  Peptide Sequence Number=SeqID_124285
atggcagcgcagctgatccgtgattgcgtcgtgatggagtgcctagaggctcaatctgaaggaaattatgcggaagctttacagaattattatgatattatgccaacacctgaggcttactctacagaggagagtggtccgggagggatggcgaataacgacgactcttcatcacaacggacggttccttag

SEQ ID NO: 32601 - DNA, 237 bp, Glycine max
  Peptide Sequence Number=SeqID_124286
atgattgaaattattacattggttgaaaggggacaacttccttgtaaggacaactcaaaggacaacatttatagagggctatccaaagagcacaaggaactagaaaaacttcatgagttgaaggggccaatgacaaggtctagatccaagcttctacaagaagagatggccaagagaatcaaggatggactactcatcaaagaaaaggaaggagaaaatcacaaggagctaaattga

SEQ ID NO: 32602 - DNA, 1011 bp, Glycine max
  Peptide Sequence Number=SeqID_124287
atgaaagcctctttgaagttccgagaagaacacaagaaacccctcttccgtgcaaaagtcccactgagcatcctcggcaagcccttccaatccggcatagtcgctggcgaatccaaagaactcacactcaacctttgcaccttcttcgaatcgggtccttctctcaaagtcgcgtatcgccccaacgactccaagaaccccttttccttaatagtgaaaacgggaactggacccttcggttcccctcttaagagctccatgctcatgagctgtgagttcagtgttcccggtagaaccggttccccgttgttcatgcttcatttcaaaccccgcttcggcgacttcactttcaagaagacgcagtcttcgatttttgatgggaaagggtttgggtctctgaacacacaaaacgacgccgttgaacttgagaacggaaccgttgaaacgccgttgatggaatcggcgaaggtttcgattctcggcgacggtgcctccggcgccgtcgctgggatgttctccggcgtggaggtggcggctcggacgacgctgccggtgcggggacgcgccgccgtaaagttccggtggggagttagggttccgtcggagttcaaggggaacaacgcgtttcagaaaattccgtttctcgtgatggataagatcggcgtggaacacatgatggagtgcggcgtttcgaaggagaaggttagcgccggagagaagtctagggttccggcgagcgctgacgtggcggaggcgtgttttgcggtgaagcggcagatggaggttctgcaggcggagaacgggttgctgaggaacgccgtggaggatctccggcgagaaatcgtcggcgttcgaacctcaagttcggttatgggcaaaagccctaatttgagaaagaatgagaagaaaacgacgtcggattatggtaattttcccgggaaatcgacggaggctgaagcgagcgagaagttgaagaaagcgttgatgggagcggctgctggtagttcttga

SEQ ID NO: 32603 - DNA, 1121 bp, Glycine max
  Peptide Sequence Number=SeqID_124288
atgggggtgtacttaggaaaatttagagatgtaaataacaagtgccccacatcaatccaaagtcctaattccaatcctttccctatacgggcgttgctaggtgcacccagcaattcaatgaattggcatcctccattgaagctgttgttcgtttcttctgccatcaagacgaaggttcttccgcgagaagaaccttcttccgcgtgtgtgaaagtggcttttgggtactgtagtggaagaaggtgttcttccgcgggcggaagaacgttgtcttctgcggatcccgcggaagatcctgcagaaccttcttccgcaggctacattttgttgtcgcggaagaacctgcggaagcttcttccgcagggtacatttccttctcgcggaagatcctgtggaacttcttccacggatcatgacgtcacaaagagacctgaggatgtgcctcaaatgcatgaggatgttcctcatgtgtctgatgccaccccagagatgacaggcgccgccgatgctgttcagacagagggagtggctactaatgggagcttggggtcacctgctgcagatgagggttcctcggaacgacccgatctgaagttggtctcccatggtagaaaagtagataaaattgggagaccaacgcctgagatcgaaggcatgattgttgccaccggattgagtccactgatcaggtgttctgttatcaccactgatcctggactcatatccgccttcgtcgagaggtggcatcgcaagactagcacgttccacctgccagtaggcgagttgacgatcacgctggatggcgtggcgtcactcctacacgttcccatcactggcgctctgcatacgttcgagccgctggttacttcagacacgattggtctactgacggagcttcttgagggccagatgatgggttgtagcagctcacacgtatctggtccacttggtgggttgtactcttttcgccaacaagagttcaacccatgtacatgtcgtgcacctggaggctttcaagaacctggcccaggcagggggattcgcctggggagcggctacattagtccacatgcacgagcatttgaacgacgcgtcgcaggcctctacacggcagctgggcg

SEQ ID NO: 32604 - DNA, 456 bp, Glycine max
  Peptide Sequence Number=SeqID_124289
atggtcctctataacttcctcaatgatgacagcgtccagtccctctcgcagttccacaaggagtgctcctccactattaccgtatctccagccagaatgatgatcgcatcaccctctccctcgacctctccctcctcctccatgccctctgtagcgtcatcgccatcgcctcctttgaagtactgctctagagtggaggcgttagggttgagaaagatagacaaagggaatagggaaggatgttcaagaaaaacaatgtgtggtttattgccggaaggtcaggcgaggtaccagctgttggaagtcttggtaggacaaaaagctttagtcaaggttcctccctacaattacaaagaggcgcaatttatggtcaaaaggtcaggcttggtcctcaggagtaagaagtctttgaagcatagtttaaagattcggttcaaccaggatccgatggcataa

SEQ ID NO: 32605 - DNA, 4416 bp, Glycine max
  Peptide Sequence Number=SeqID_124290
atggctcttgaagctccaagggagcctcggcgacccaaaactcattgggaccatgtcttagaagagatggtctggttatcaaaggattttgagtcagagaggaaatggaaattagctcaggcaaaaaaagtagctttaagagccagcaaaggcatgttagatcaggctacaagaggtgaaaagaagatgaagctgtatcttgtacaggaagaggagcagcggttaagaaaggttgcacttaatatttctaaggatgttaagaaattctggacaaaaatagaaaaactggttctttacaaacatcaaatggaactcgatgagaagaagaaaaaggcacttgacaaacagcttgagtttctattagggcaaaccgagaggtactcaacaatgttggctgaaaatcttgtagatccttataaatcagcagagaataattctgcagagcaccacatgagtattcaatgcaaagatgtacatgatgttattaatgaacctaaggaagctgatgttgtagagtatcaatcagatgcagctgacaatgatgaagaatatgatgtacaatatgatgatgaatcggaggatgatgagcgaacaattgagcaagatgaggctcttataactaaagaagaaaggcaagaggaattggccgctttgcgtgatgaaatggatcttccaattgaggagttacttaaacgttatgctggggataaaggagaatctgtaatgaaagaaagtagtccagagcatagtgaagatggtgggaaaatagttagagctggtgatggtaagaaaggactagcatcagaaaacggagatgatcttttatctgtaagcaaaattggcacaagcaactccagcatagtctctggtcgacgttgtgatgaaagtaatggtgatgttgctacaccaacaaacaatttatctcaatgtgagaatggtcaatctgaaaatctaaaagaggttcccagtagttttggtggacaatgcgacatccatgagggagagaggggtgataagcaagtggtgttagaagtaggtctcttatctgaagatggtgactttttgcttggcatagaagataaggatgatgaaacaaccttatctgaggaggaacaactggaaagagttgatgcaattgatcccaaggacgagattgcattgttacaaaaggagagtgtcatgcctgttgaggaattgcttgcaagatataaaagggacccaagtgacgatgaagatggggaatatgaatctgattatgcttctgctttatcagagaacaattcggattctccagtccatgaggatgctgggcagaaggatcctgccattcctatggatgaagatatcaagtctggtgagcacctggctgccatacagtcccaggaagaacagtgggaatcacctcatgaaaatttagaaaaaagagaaagtgaggatataattgctgatgcagcagctgctgcaagatcagcacaacccactggaaacaccttctccacaactagtgtgcgtacaaagttcccttttcttctcaagtactctcttcgtgagtatcaacatattggattggattggcttgtcacgatgtatgaaaaaagactgaatggaattttggcagatgaaatggggcttggaaaaacaattatgactatttctttgcttgcacatcttgcttgtgataaagggatttggggcccacatttaattgttgtaccaactagtgtaatgcttaactgggagactgaatttctgaaatggtgtcctgcctttaaaattttgacttattttggaagtgcaaaggagcgaaaacttaaaaggcaaggatggttaaaacctaactcctttcatgtatgcataacaacttatagattagttattcaggactccaaagttttcaagcgcaaaaagtggaaatacttgatcttagatgaagctcatctcattaaaaactggaagtcacaaaggtggcagacactcttgaatttcaattcaaaacgacggattctcttgactggtacgccactacagaatgatctcatggaactgtggtctctcatgcatttcttaatgccccatgttttccagtcgcatcaagagtttaaggattggtttagtaatcctatatcagggatggtagagggtgaagaaaaagttaataaggaggttgttgatcgccttcataatgtacttcgtccattcttacttcgtcgacttaagcgagatgtggagaagcaacttccaatgaagcatgaacatgtcatatattgtagactatcaaagaggcagcggaatctgtatgaagatttcattgctagttcagagacccaagccacacttgcaagtgccaatttttttgggatgattagtattatcatgcaacttcgtaaggtttgcaatcatcctgatctatttgagggtcgtcctattgtcagttcttttgatatgcgtggtattgatattcagttaagttcttctgtttgctccatgcttttgcctagtcccttttcaacggtggacctaagaggtttgggtcttttattcactcatcttgactatagcatggctgcttgggaaagtgatgaagtacaaactattgagacccctgtgactttaatcatggaacgtactgatatggccgaactagaagtaattaggccacataaatgtcaaaaaaagttgcaaggaacaaacatttttgaagagatccaatgggcgatctgggaagagaggctaaaacagacgaaggaacatgcagcagctattgcatggtggaactccttgagatgtaaaaaaagacccatctactcgacaactctaagggatcttgttgccttaagacatcctgtaaatgatattcatcaggtgaaagcaaaccctgtttcatacttgtactcatcaaagctagctgacattgttctctccccggttgaacgatttcagaagatgactgatgtggttgaaagcttcatgtttgcaattccagctgcacgggcaccctctcctgtatgttggtgcagtacaagtgagactagtgtgtttctgcacccatcttacaagcagaaatgctctgaagttctgttaccgctgctgtcaccaatcaggcctgcaattgtccgccggcaagtgtatttccctgacaggcgtcttatacaatttgactgtgggaaactgcaagaactagcaattttgttgaggagattaaaatcagaaggtcaccgagctttgatattcacccagatgacaaagatgcttgacatattagaggcattcattaatttgtatgggtatacatacatgcgcttagatggatcaacccaaccggaggagagacagaccttaatgcagcgctttaacaccaaccccaaatattttcttttcatcttgtcaactcgtagtgggggtgttggtatcaatttagttggagctgacacagttattttttatgatagtgactggaatcctgctatggatcaacaggcacaagatcggtgccacagaattggtcagacacgcgaagttcgtatctatagattgattagtgaaagcaccattgaggagaatattttgaaaaaagcaaatcagaagcgtgcacttgataatctagttatacaaagtgggggttataatactgagttcttcaagaagcttgatcctatggaactattttcaggtcatagaacactttcaataaaaaatatgccgaaggagaaaaaccagaacaatggggaagtttctgtaactaatgcagatgttgaggctgcattaaaatgtgtagaagatgaagcagattatatggctttgaagaaagttgaactggaagaggctgtggacaatcaggagtttacagaagaagtcattgggagatttgaagacgatgaatatgtaaatgaggatgatgagactgcagaattaggtgaatctgttttgaatttaaataaagagaatgcgttaatgttaaatggaagtgatcataaggaagatagaccgccacactctgttgctggcaaagaagatgatcctgacatgctggctgaagtcaaacagatggctgcagctgcagctgcagctggacaagctatctcagcatttgagaatgagctacgccctattgatcgatatgccattcgttttatggaactgtgggatccaattatagataaaacagccttggaatctgaagtcaggattgaggacacagaatgggagttggatcgcattgaaaagtacaaggaggagatggaagccgaaattgatgaagatgaggaacctcttgtatatgaaagctgggatgctgattatgcaactacggcatatcgacagcatgtagaggccttggctcaacatcagttaatggaggaactcgaatatgaagctagacagaaagaagccgaggaaacttgtgattctaaaaagtag

SEQ ID NO: 32606 - DNA, 903 bp, Glycine max
  Peptide Sequence Number=SeqID_124291
cattagagtcaccactgttcgtggaggagctcatggaggagcatcatcgttaggagattcagccaattcggtaagaacattcggtgtccaccatggtgccgaaggaaaactttcctttcgaccactaggtcacgtgaacgggaatccaccacgtcaaggatggctgccatgggagcccctgaaaaggggaacccagcaaacaaagcgagtccctcgtggagtagtacttgaagcttcaaaaggaccaaaatgcaaattcggtcacaatggttgcaacccactagacccatctgacaaggaccaacgaggttcatatgatgagtcacaacttctacctggatggaagacgctaaccattgatcattacaatgggctctcaaacctggatgaacacgtggacgcattcgtcacacagatgagtatgcttatgaatgacaatgcgattatgtgtcgagtgttcccaaccaacttgaaaggcgcaacacttcattggtacactcatttgctgagaaactccaccgattcattcgcaactattaagatgtgtttcaaagtgcaatatgcgataagaataccacatcacttaatagcaatggaactcgctaacattcaacaagatgagtatgagtccttaagagacttcatggagagacaacctgtgcaagaaattacctacaacattggaagagttgagagcaaggactgccagattcatccagatggaagagatgaccagattcaaagagaaagtatgtggctaatcatcaaggaaaccaatggagtgagagatcaagatctagagtgtaacacacccgattgtcaacttctcggtggttctcacattactacacttcatatgatgacacttcactcaacatgcttgttggttagaaccctccacaa

SEQ ID NO: 32607 - DNA, 140 bp, Glycine max
  Peptide Sequence Number=SeqID_124292
aggtcgcatggctcagggattggcccgaggcccaagcaggagaggcaccaccggaagttcccggcgatggagaggaggcccacgaggacgaggagatggccgatttgcttgacttcttgggagggagtggagatacatga

SEQ ID NO: 32608 - DNA, 279 bp, Glycine max
  Peptide Sequence Number=SeqID_124293
atgtgggagcatattggagggttagtaccaaaaaagggcgttttggataggtggagttggaactaccaaactgaaaaggtaatattacgggattgtttggcttggtggactatgtgggtttttgtgatatgggctttgtggctgctccataatgaaattgtgttctggaatgcacaatgtgactcagatttggtctttgatagcgcaaagcttagagcgtggaaatggcttcgaaatatggggaaagggttcaatgcatctcttctaggacaattatga

SEQ ID NO: 32609 - DNA, 72 bp, Glycine max
  Peptide Sequence Number=SeqID_124294
atggattctccacctgcctcccctcctcctcctcctcctcctccttcagatgcatcagcttcaccttctgcc

SEQ ID NO: 32610 - DNA, 324 bp, Glycine max
  Peptide Sequence Number=SeqID_124295
atggagaattggaggagaagagagacttttgcgctggaacccttgatggctacgagaagaagacttgagttggagaagaagagaacaattgaaaaacggagtgcattggaggaagaagagaagaatgaaaaagatccgtggggaggcccgctggagattcatgcgaccgactccgccacgaacgacgagcacagccagaatctccaggagctggaccgaggcgctttagacgagacccaacagagctggctcttgggcgctggagaacagaaaaagaagaagaaaagctacattgatcttggctgcatcaacttcaacccttag

SEQ ID NO: 32611 - DNA, 705 bp, Glycine max
  Peptide Sequence Number=SeqID_124296
atgacatctaaggcctttaatgctctaccattagatgccatagttcatctttctcctccacaatggacttgtccagtgcaacccaacttttttaatgtctcctcattggcttgctcctgctccttcttccatggcttattccctagtggatggcgccgcctcttacctcttctcctttgtcttccgctgcatctccatggtggaaaatcaccattaaaggacctcattgaagctcaaagatccagcctccatagaagctccaccagcaagcttccatcaagtcttcagaagttaaaggacaagaaaatctctcaaagcagcatctccaaggatctatttggaaaacacaaagaggaccctttgcaaaaagtggaacccccaaatatagagtttcagaaggtgtacctatggacgcccattaccaaactcttactagtgcatccagttaatcttaatctttccaaagaagatagcttatcctttggcaaatcgaatgaacaaatgtacctaagagaccaagccattgcctacctttctgatctgcacatctcaagggccactaatattaagatggttgctgataaagtgagtttgtgtctactagtttgggatgctacaaagaaaaaaggatttaagctttactacaatgaagagatgcccacagggaaaatgagagtagatattgttaattttccccacaattag

SEQ ID NO: 32612 - DNA, 444 bp, Glycine max
  Peptide Sequence Number=SeqID_124297
atggggttgaaggagaagcgactaccccagcgtcgtgctacgcgactttcgattgccactgcggaggacgatgccgtcattgaaggaggagcagtcaccgccgcgccgccgttgaagtttcatcgaggaatcaccgtcgtgctgctatttaatttcgccgcatcgcgccactcgaatccagatttgactctcaccccttcttcgaaaccgaaccaccccactcaattgaaggctgtctcaatatctatggcatcaaatcaacgcccaacacacccttctctgaatctcaatgttgttgcaaacaaggaaccccctcctaaacacccaattgaatttgttattgaaaggattaggaaggggatgaggacatttttggaacaaaatgtcattaaaaacccatgtgccagtgacatgagagcttctgtcaacagagtcatcaaatga

SEQ ID NO: 32613 - DNA, 651 bp, Glycine max
  Peptide Sequence Number=SeqID_124298
atgaaggagaagaaaaagaaacaactggaggaaactgctaaatctagaagcattgacactgtcattgatcctccatctcctatcaaacgacaggtgaagtggaagatgacccgtaccaagaaaactggccaaatgacatctgaggcaacaaaggaaatttctaaaaagattgcctcacagggttcctttgtcacccatggacgtgaggatgtactgactacacccattgggcgaccagagcaccctattcgtgtgcgtgctactggagtcggtatcatgatcaaacaataccttgaatcggctccaaggacctcccacacgtcttcgtccatggctcctgaagatttagagcagctgacacaaaaaatcaagggccagctggagaagtcgatcacagaaaaacctgaggttggtccttcagctgctcgtgtcagtacaaaggagagttgtatggatcccttagggagcgacctaaacacgggggttcacaacatccctttgggaaatgatcaagccaaggttggtgttgaggaagttagagaggcaggtgctcacattcctgtacccactcgagaggttcagttagtggggcagacacttatcaccttcgttgcttggccgacacatcttgtcaagcgtttcctagaacag

SEQ ID NO: 32614 - DNA, 318 bp, Glycine max
  Peptide Sequence Number=SeqID_124299
atggctttatctcacttaaccattcaccacgaatcccttccctccaaacactctaacctcgcctctaaggttaagaccttcctggactacctcaaccacctcaccattgtttccatgaccccaactctgccccttccttccccacgtcctcacatcaaactcgaagttctaaggtttgatggccacgaccccttggtgatgcaatcctaccccgcaagggcattggatagaagaatccaagtagattgggccaaagatgcaagagaaggccctagggttctcatgagccttagggtagatttcggacccatggactaa

SEQ ID NO: 32615 - DNA, 378 bp, Glycine max
  Peptide Sequence Number=SeqID_124300
atggatatctctgaagatactgacatccctataatcttggggaggtcgttcatgttgactgcaagctgcatagttgacatggggaagaggaagctggagttaggttttgaagaccagaaaattgattttgacttgtttgttgaagacaagcctactccagaacacaatgtttgcttgcgggtaatgggagaaggtcaagaggttctgaaggcgagaaccaaaactcctttcgctaagcgcataatcgttcatgcgctaagccacgagtttcaagcgcttagcgcacaaccctggcacctgagatcgctgagcgatggctttaccttggctaagcatgacccagtgtcgccaagcacaattcattgcggtcagaattga

SEQ ID NO: 32616 - DNA, 768 bp, Glycine max
  Peptide Sequence Number=SeqID_124301
atggtcccagattgtaatgacattgagagcacgataatctacacacatttgccaacaaccgtatttcttcttcaccaaaagcacgggggaagagaaagggctatggacattgatagggctggtggagggggaaagagagatatggtggactatatgtcgaggtgggggaatggtcgtgggggtgaggaagatgggggaaaatttggtaatgaggtcttggatttcgggtatggggtgaggcagttctgggcacgggtttgggttgttagtggagtggataggcctagatgcaacatccgtgcaaagctccacaaaatgacccaagtggttaaacttcatggaaagagtggtgtagttagtaaccttggtgcccaattccttcaaccaatcaatgcccaacaccatatttgcgccactaatgggatggacccattggcaatgatgaccctcaatggtgaaattgcctccatgagtagtgccaagaacttggcaactcgaggctggatgaagctatgggtactgccactattgataaggaaagtgagcgcgaagcaaggaatcactcagtgttttgatcaagaaaacaaaaggataccaaggaagggggcaaaagccgtgatgggggaggggtttaaggggttccaaggttcaagagttgatagaagaaagaaagaagaagaaacaaagatgaggcgctaccgaatcgtgactgtgatcattccctacatcgttttcttgttctgtgttcctcgtgcaacaatcggttag

SEQ ID NO: 32617 - DNA, 1427 bp, Glycine max
  Peptide Sequence Number=SeqID_124302
gacgggcgggggaagaagctggtggtgctgacggagcccacgggccgggacatcggcctgcggaggaattagcatgcaagagtatttccaagaagaagctacgaacggctattgatattgaagacgtgaggagggaggtggagatcatgcggcacctgcccaaacacccgaacgttgtgtcgttgaaggacacgtacgaggacgacgatgccgttcacctcgtcatggagctctgcgagggcggcgagctcttcgaccgtatcgttgcgcgcggccactacaccgagcgcgctgccaccactgtcaccagaaccatcgtcgaagtcgtgaaggtgtgccacgagcatggtgtgatgcatcgtgatctcaaacccgagaactttttgtttggaaacaagaaggaaacagcacccttgaaagttattgactttggattgtcggttttattcaaaccaggtgaaagattcaatgagatagttggaagcccatattacatggctcctgaggtattaaagcgtaattatggccctgaaatagatatctggagtgctggagtaattctctacatattactttgtggcgttccaccgttttgggcagaaactgaacagggagttgctcaagcaattattcgatctattgttgattttaaaagggagccatggccaaaggtttctgataatgcaaaagaccttgtgaagaagatgctcgatcctgaccctaagcgccggcttactgcacaagaagtgttagatcatccatggttacagaatgaaaagaaagctcctaatgtttcattaggagaaactgttagatcaaggctcatgcaattttctgtaatgaacaagcttaagaaaagagccttgagggtgattgcagagtatttgtccttagaagaagctgctggaataaaagagggattccagctgatggatacaagcaataaaggcaagattagcgtcgatgagctgcgtgtagggttgcataaactaggtcaccaaattcctgatggggatatccaaatacttatggatgctggtgatgtagacaacgatgggtacatagattatggcgagtttgttgccatttccattcatctgagaaagatagacaatgatgagcaccttcacaaagccttccaattttttgatgagaaccaaagtggatatattgaaattgaggagttacataatgtcttagctgatgagattgaaacaaacagtgaagaagtcatcaatgcaattatccatgatgtggacacagataaggatggaagaataagttatgaggaatttgccgcgatgatgaaggcaggcacagattggaggaaagcatcaaggcagtattcaagagagaggttctctagcctaagtcagaaattgatcaaggacgggtctttgaaactaaacaatgatgacggtagatga

SEQ ID NO: 32618 - DNA, 246 bp, Glycine max
  Peptide Sequence Number=SeqID_124303
atgtacaatatgataaagatgattgtcaagtgcacccgatgtttggtggggttcttgatgaggacaaggcaaaggaataagagcaaggaacctttagaaggacttggaggacctatggcaagggctagaacaaagaaggccaaggaagctcttcaacaagtgttaaccatgctatttgaatttaggcccacgttacaagtggagaagcttcggattgccaattgcatcatgttccaagaattgtag

SEQ ID NO: 32619 - DNA, 750 bp, Glycine max
  Peptide Sequence Number=SeqID_124304
atgttgaatgatcaaacaccttccacaagccatggcacagagcaacaccacaatgagagtgcagaaaacgaaccacaaatcagagaaatctacgccttaactccacccccaagaagagaaccaaactttgaaacacacacacatagccacagccacgactcatcttctgtgtccatagaaggtggttccagcgagaacttcagcatgagtagagaattcagtgccctcgttctagcaggctcaagcatcgaaaacaacatcaccaccccaagtcaaatgagcttgaacacgatgcatggcaatgaagaaggtgttaatagttacactaacagcaacaacaattataataacaataacaatattaataataatagctacaacaacttggggaggattggagaggatgagatgttgatgatggaggagactaaccctttggcgattgtggcggacatcaaccctttggaggcggtttcgtcgtcgtcccctccgaggcgtggtggagggacttcttctggttcaggtggtgctcttaatgaggtgacagtgcagagagtgaggaaggaggaggttgaggcaaagatatcggcgtggcagaacgccaaggttgctaagatcaacaacaggttcaagagggaagatgctgttatcaatgggtgggagaatgagcaggttcagaaagcatcttcatggatgaagaaagttgagcatgcaattcaagggcttgatcttggtcatatgcaagcttaa

SEQ ID NO: 32620 - DNA, 372 bp, Glycine max
  Peptide Sequence Number=SeqID_124305
atgaagtggaagatgacccgcacgaagaaaactgaccaaatgacatatgaggcagcaaaagaaatcgtagacaggattgtaaagcacccaggttgtgtccgtgctattgaagtcggtgtcaccatcaaaaactactttggatcgactttaaggggctcctgcacctcttcgtccatcgttgctgaagacctagagcagttgacacaaaagatcagagaccagctggagaagttgattacacaaaaagttgaggttggttcttctgctgctattgtcagcagaaaggaaagttgtgtcaatccctcggggcaggacccagaaatgggagactcggacaaatttggcttgtatgtcgatgacagtcttccctga

SEQ ID NO: 32621 - DNA, 204 bp, Glycine max
  Peptide Sequence Number=SeqID_124306
atggccagccttaagttacgtttgcatgcagtggaggaagccctagtagtcgtccactgtgtggaggctaggacgagaactgaagaagtggaggaattagacctcaattcgagaactaacgatgacaaccaggtgaagccaataaaaaggacatctactttcaggctcagaccttccggcaagtgcaccggatcgcacaaatag

SEQ ID NO: 32622 - DNA, 414 bp, Glycine max
  Peptide Sequence Number=SeqID_124307
atgatggaggccttgaaagatcaaatggccacaatgatggaggccatgatgagcataaaggagataatggaggtcaatgcggctgcaatagtcgctaccagcaccattgctaaggggggcctgacccccccagatggcgtcaaccaaataaaccatccaacctcagatatggtaggtttggaaggcaaagagttgggaggtacgggcggccctcatttagtgcaaaaaacaagcatgccttcccgccatatggcttgcctcccaaatatacaccacccaatgtggtgtacactcccggtgaggatgtcaataacttcgttcccatactcattgaaagccgacaatctcaaactgatcatgcacatgtctctcaagccacgggggagacgcatgagataccctaccataatctag

SEQ ID NO: 32623 - DNA, 930 bp, Glycine max
  Peptide Sequence Number=SeqID_124308
atgatagcattgggagctgcagctgatacaaacaaaggcagtgaagaaaccttcaaaatggcaataatagaagctatcaaacttggctacaaacactttgatactacatcattctatggatctgaagaggctatgggagaagccatagctgaagctcttcaacttggcctcatcaataatttttatggtataatatctaagaagcacgggcgtggcacatcagtggcgtgtctcgcgtcagactcgcaccgaacacgaatgcgaacacgactccggtgcgacgcggtgtcaggtgcttccgccgtcaccagacatgagatgagtgcttctagtcatagtcaagctaaagaacaagatgatgataccaaacctttatggacctatgttacaaagataaaaagtgtaggtggtggtggaaattatgagataaaatgcaatatttgtgatgttagctttaataggtcttacactagagtgagggcacacttgttgaagattactggaaagggagtcagaggttgtcaaaagataaaaaatgccaaacttatagatttgaagaagatagacaatgaggctacattgagggtggagaagtcaaaaacaaaacctgtgtcattgcctccggtttctactcaacaccaaatgaatacaaacactcttggtgttgatccaaaaaagagaaagacattaactgtagaaagtgtctttaatttgcaagctagagatacacttgatcatgaaattgctaggatgttttactcttcggggctgccttttcatttagcaagaaatcctcattataggaaggcttttgcctatgctgccaacaattatatcggtggttaccaacctccaggttataataaattaaggacaacattacttcaaaatgagaggagacatgtggagaacttgttacaaccaatctaa

SEQ ID NO: 32624 - DNA, 114 bp, Glycine max
  Peptide Sequence Number=SeqID_124309
atgacttcctcaaatggaaattttccagcatctatacataagtggtgcaagaaggggttcaagaacctgaaaagaacccaactgatgcatagaaggtggctcgctatgatttga

SEQ ID NO: 32625 - DNA, 1200 bp, Glycine max
  Peptide Sequence Number=SeqID_124310
atgggagaagcacctacattcatacctcaagacctgcagaatggaacatgcaatgggtttgaattaaaaagtgggacttttgaaactgatactattgttggcaataaaaagtatgtcattggtggaacctatggtgaaaccttttcggttaaagatcaaattcttgacaacaatggtctaggggaatgggttgatctcattcagctaggtaccaaacccatttcatgcaatggccactcagccgtgcttttgaaagaccgaatactaattcttaagaaaaatgccaagccagatgattgtatatggtttctggaggtggacactccatatgtcaggcagcagaaaaaaattttggggattgatgttgttgcatggagtaacggtgtgataggaaatgctgagaaacctgttgttatcagtggtccttctggagtaggtaaaggaacattgatatctatgctgatgacggaattcccctctatgtttggtttctctgtgagccacacaacccgtgccgcaagaggcatggagaaagatggggtccattaccattttacagagaagaatgttatggagaaagaaattaaagatggaaagtttctggagtttgcttctgtccatggtaatttatacgggaccagtgttgaggctgtggagatggtatcagatgcagggaaaagatgtattcttgatattgatgttcaaggagcaagatctgtgagggctagttctctagaagccatgttcatctttatctgccccccatcaatggaagagctggagaaacgacttcgtgaccgagggacagagacagaagaacaggtcctaaagcggttacgaaatgctcaggctgagattgagcaagggaagtcatcaggcatatttgatcacatcttatataatggcaaacttgaagagtgttacgagaatctgaagaaattattgggacttgatggatatgtcactcctcccaagtcagcaccaaaaaagatgaatctcccaagggatcattcagtgtcaaaaattgatgacaaaatcatcataggctgcatctcttcaggactagaaaaggaatcaaagaacttgatcatgttagatgtctcctcacttaaagggggcgcgcctggacggacaagagggctagattttcaagtcattgactcgttttcagatggcttcaatggcaatgaaccattttga

SEQ ID NO: 32626 - DNA, 225 bp, Glycine max
  Peptide Sequence Number=SeqID_124311
atgacgctgccacctaggacacatagtcgacacaacccccatcttgacagtttggcgataaaggccaatggtcatggggttggtgttgtttggatgtgggcaaggagaaagggtgcaccaaccatattccttgtgcacccaacaataaaagacgaatctggtgtgaatgaagaacacactgattattctgatgcattcaatacttctcaggtgtttgctacctga

SEQ ID NO: 32627 - DNA, 747 bp, Glycine max
  Peptide Sequence Number=SeqID_124312
atggttacaaccagaggtttgggtcgtgctttaggcggagttataggaagagctatggggagagaagataattatgatttagatgaagcttcccaacgacaaaggcccatagcatccgcacctaacgaggtcttccaacagcctcaagaagtagctattgatgcccaaggttttccaagcgggccacatgaccatcaattctggctggctataatgatcatgttgcagtcattgtttggaatggagaggtccagaattgaagctatcctcccatggaaggaaggtttagaaattcaggagtttgaaaggtatgttcaaactatccctccacactctttgggttcaagattattcttagaagatattgatgacaaatggatgcacttctctaagtaccttgcaccgatgggtcagatttgtgttgtgtctggacagtatccagtcaaacatccacctatcgtccaagatgacacatacgtggaaccatatatttctcggtacccggcggtggcaatagttatggaggaagcacctgcacatgcaccttctcatgtggagcagcctcgacatgcagtggaggcttgtcaagcaatagctgaaaggttggaatggttgcttaacctaaggatagtgactaaaggcacaaaaacatacgatgtcatgaaagactgcctaaggatcgctagaggtgtgattgtggatcacaatgtatatgtgcggttgcgacgaaggtggggcatggaagac

SEQ ID NO: 32628 - DNA, 273 bp, Glycine max
  Peptide Sequence Number=SeqID_124313
atgtctcagaaaaataacgatctcagacttattcaccgttggattgtcgtgaaatttgagcaccacgttagcaacccaattccgagcattctcaccgttgggaatttcgatattatgtttgagctaagagaaatacccttcacattggagaaaaaggattcgcatgaagacagtacaagtggaggtttcaatctcttctccgtctctttgacgtttgtgaattctatcggagcagtcggaggaataactgaaggaatctcagggaaccgctag

SEQ ID NO: 32629 - DNA, 750 bp, Glycine max
  Peptide Sequence Number=SeqID_124314
atgtccaaggctttgttgtctggttatgatggatgtgacaatgttgaccaccagaattccattcaagttttgcatccagtcatgacgtatcactttgatgatgtgtgtgtttgttttgtgaaggactctaaagacaacgagttcatctccaagcaaaagaaacttcccatcatcatcaacgacattgtctatgatcttacaaagatggatgagagggattccaaggatcacactgcaaaagaagctgttgaaaaggttgtcaaagaacaagttgaaaaggaagcaagagctgaacaacaagcaaaggacgatgctaccaagattactgaggtccttgttgatctcactatctccggtgcattgcaagaagttgaagaacaagcagcgtcccctgctgagtccaatgcaaaaaaggctgatgaggttgttccaacaagtctatcagaacttgcgtccaagcaggctgacacctcacatgaagccacttcagtggaaaaggaggttctagatgcagtagttgtattttcaagcaactctgatgttgcaccaattaactatgttgttctagctcctatcgtgggtgttgtcgtccaacaacctcttatcgtccaacaacaaccatccattcaacaacaacaatgtccaagtatattgcttgcacctgctgagccaacaccaccatcaccaacatcaataccaccatcgtccaacaagagtgataatgatgtccaatcattattctttctttga

SEQ ID NO: 32630 - DNA, 486 bp, Glycine max
  Peptide Sequence Number=SeqID_124315
atggacattcatgttacttacacacttaatggtatcatttacctatcctacattcgcataagacaagtaaccttaccctcattggctcttgttgccacttgttgggaaattgatgaggacaaaacactgggaaatcttttaccaatgggtcacgagcactccacacaaataaacttgacatcaccttcaacccaagaccttaagacatcaagtttgtggaactctcttagttatattttactcaatttgtcaatttctacccaatgtgaaacttcacctttcatacttgtactccaacaatcttctcctctagtagaacctttccataaccaagctctgaaatccataagagagcctgatacaatccccatgcttccgcttctgatgttgaaggttgatgtgattcttactaggagcggatcgcttgatacaggtcacagagtttggatgacatcacttctagagaggaaagataagtcagggtag

SEQ ID NO: 32631 - DNA, 171 bp, Glycine max
  Peptide Sequence Number=SeqID_124316
atggcttacaacggcaaattgctagtgttaaagctccaggtcatactagaaattgttgtgggtagaggtgattttgtgtatcaaggtgaaaagattaagcttgaaatgaaaaagcaggcagaacaagatctttgtttaaagtgttatgaagcaaaccccaagcaagcctag

SEQ ID NO: 32632 - DNA, 222 bp, Glycine max
  Peptide Sequence Number=SeqID_124317
atgatagtaattcagattgaagggatggaatggaatcttgtgcgttttccaccttcagaagccgccaaggtgttctctttctcggaagatgaatcaggtcccaacgcaactgattttcacgttaacgttttgaaaagaccatattgcccttctggcagtgaagtttcttttgttttcataacgggaacaatgactataatatacacaggctattttgcgtaa

SEQ ID NO: 32633 - DNA, 222 bp, Glycine max
  Peptide Sequence Number=SeqID_124318
atgaccaattcgaaaggtaaaaacattccagaaagggtgtacgaagcaattggaggtgcaggaagtaacaaccaataccttaagggcgggttcgggtttggggttgggacgggtctagtaatcccatacctgtacccatacccgacttttggttatcggggaaaactcaaacccgaacccatacccggtcaactcgggtattacccgtcaaagtcgggatga

SEQ ID NO: 32634 - DNA, 2748 bp, Glycine max
  Peptide Sequence Number=SeqID_124319
atgcagatcatgtttagtgagctcgtctcgctaagtgaaacttcacttttggcgttgagcgtgacctctagcgctgagggtgaaattacgcttagtgcgcttgtctcactaagcgaatttccctctcgggttgggaattatgctaagtgcactcgtctcgctaaggtgacgagttggtggagtcccccgtatggacaagtgttattcggtgccgagagtggtggcctcggtaagagtgagacttgcaggtgtgtgcggggcattcacgacactcatgcatacgtgtcacttgtggagtgggcaagtattggagatgtgatgtgtggttcctccttggagaatactctccatggtgcctctgacagtgaatcctctcattctgagagggagcctatctcggtcatcgtgattctccccccttctacttctggggagcaaggagaagcgatagggacgttagggcatctccctgacgatgttcataagtataagtcctccctcacctttgcggtgattgtcgttgctctgcaatgccaggtgaagctggcaaaccctaattactcttacaagatactcgttgaggcttgcgggaatgatgacttccccttcttgagggcggtgtcgggcaatccgcccttcttcttcatgtacaggtgtctgtttgaggtcttggttcttgctccccgcttgaccgattttcagtgtgctcttcttgagcacttgaccatgggcccttcccaactcccccataacagttgggccatggtgagggcttttgagattttgtgccctttcttcaacatccgacctagtgtgccgattttcttgaatttattccagatgaagcttattgttaagattgattgggtcttcttgaataacgtgtccaagaagttagttgagtttaactcaaatgtcttttttcgcttcaaggactgtttcttcaaggtcctggctactgatgtcgtggctgatgaaagtggtcaatatgctgctgagattggccttattatcggtgttgctgaggttgccccctatgccccttcctctattttggccaagaggaaacaagatgacgttgatgcaccagccacttttgctggtcctgtcacgactcattcatccaacatcgttgtacccttgtttagtgccggtgtggcgaccacaagtgctcctgcaatgccgcctccttcttcttcagctccactgattccacctactgttgtgttagcttcaacaccctcttcctcctcttctcgcccccatgtgtcattggatcacctgtacaccttcaacaatcctgattcactatgggaacactatgaattctaccaaagtcttcctctagaaaagtttggcgattctggaggagaatggacaaggacaccaagaggctttgcgcaaggtgtcatccttggaggtggaggttaccaaatggaggtcaaaccaccaaactgtcttctaaggttagcagtgtcttggccaggcattgtggcagagagggacgagctttccaaggtggttactgagttagaggctcagctaaaagagtcaaagtccaggctggaggagtctgagctgcgggtagctaaagaaagagaggccaacaaggagattgaagaggagctaatattgtacaagaaggaggtcaatttcttcgccaatgaccttgacttgggtctttttgaccctttcaaggacgtgaaggacggtgttctacttgataaggaagatattgttgctgaggaggaggctggcgaggaacaagatgctgatgatgtcaatgaagaccttgttgatgtaggaaggaaggccttggtggtcttgtgtgaagtcttatcaaacagtccggtgatagttcatcttatggaacctggacctttgattgtcattgtcgtggttctcgaggagagattgaccaagaggggtgccttgggttttgaaagaatgcataacaagggactcaccaaggacggaacttggattttgcgagccctttggagaaccaaccagggaattgtccgtcctgggttttggagagactcaccaagggtagaccttaggtttgacgagcctttgggactcaccaagggcaaaccttgggttttgcaagccctttggagaaccaaccagggaattgcccgtcctgggcggaccttggattttgtgagcccttttcaaaccgaccagggaattgttcgtctgggtttcggagagactcaccaagggtggaccttgggttttgcaagccctttgaagaaacgacctggccctgaagatgactttgttggctgcctctgcctagccattggtctaaggatgttcggcagaggtaacaagcacttaacaagagtgtcgaagttaccgatggaccttggagggagtccattgtaccaggtcaatgccacccctttaagagacatggggaagacacaacataggattgcattgtcaatggtgtacagatttgtctggaggtatgtcatcttccatgatgcggttgacaaagcggtgtcgacaagtagtcaaccttgtaggacggtggacatggcagagacttggatcatccagagtgttgaatgtgcgtcacagcctccagctgatcatggtcaacctttagctttcctagcttctcctcatggtgtcgctccatctccgaaatgtggttttggagttgttagagagtatcaatatctggcatggctgttgcaggaggattggatccttcaaaaggggtcttgcgtttga

SEQ ID NO: 32635 - DNA, 471 bp, Glycine max
  Peptide Sequence Number=SeqID_124320
atgggtaaagagcatgctcttgtcatatccaatcacagaagtgacattgattggcttgttggatgggttttagctcagcgttcaggttgccttggcagcacacttgctgtgatgaagaaatcttcaaagtttctaccggtcattggttggtcaatgtggttttctgaatatcttttcctggagagaagttgggccaaggatgaacgcacattaaagtcaggcctacagcaactgagggatttccctcttcccttttggttggctctctttgtagaaggaactcgctttacccaggccaaactattagctgctcaggagtatgcagcctcagctggattgcctgttccaagaaatgttttgattccaagaactaaggaaaacaagaaaattgaaaggtcatgggtttttgaagaattggcaattaaggtgttggctaaggatttcgaaaagattgagctgattcttttctaa

SEQ ID NO: 32636 - DNA, 258 bp, Glycine max
  Peptide Sequence Number=SeqID_124321
atgaggattccactccgattaaaacattcctctgggtatggtggttctgcagcaagcaacgatgacttgtggtggccatcagtggtcgtaggtggtggagaagaagatctcgctaagcgagagtccacttttggcactaagcgtgacaattcttgctcagtacaattccctctcgggttggaatttgcgttgagcacgacaattctcgttgagcgtaattcctcttgcgctaagtgcaacaattctcactcagcgtaa

SEQ ID NO: 32637 - DNA, 840 bp, Glycine max
  Peptide Sequence Number=SeqID_124322
atgaatatcaatagtcaagcttccaccaaaagggaagttcctttctttgacatcgaggaaattaccaacctcaagaggggttattttgcatcaagggagatatctgaccatgagtttgaagggaaagttgtttatcgccacttgaaggatggcgatgttgtgcttgccaatcgacagccaacactccataaacctagtataatggcacatatagttcgcgttctaaagggggagaaaactgtacgcatgcactatgcaaactgtagggttactacagttaataacttctttgttttattttttccccttcgtgatctctgtacttataatgctgattttgatggtgatgagattaatgttcattttccacaagatgaaatttctcgggctgaagcttacaatattgtaaatgctaacaatcaatatgtgaaacctacaagtggggatccaatcagagctttgattcaggatcatattgtaagtgctgctcttcttacaaaaaaggatacttttctaagctatgaagagttcaatcaactactgtacagttctggtgtatccatggctgggctaggctcattctatggcaaacatgggcagaaagttatcagtgcattgctatactatatcaccagaggttcaccatcatttactgttgagaagaatgcaaaaatcccatctaattttttcaagactcggatcaggaaggggaaaagatacactcaagatacatcaaaaaagaaggaaaagcctgatgaggataaattattgatatataaaaatgacttggtgcgtggcatagttgataaggctcaatttggtgactggtatgatacatag

SEQ ID NO: 32638 - DNA, 1710 bp, Glycine max
  Peptide Sequence Number=SeqID_124323
atgggccccaattcaaaatcgaagaaagggactaggataggaaaggaggtgaaagttccagaaggaaaagggaaaggggtcaatcttgaaactttcgaatttgacacaacggcttgtccaaaggcagagggttcactagagcagagtttccttcgcacccttcgagtagaaatcatagcaggcctttccgtttttgggcttcttggattactcatggggaatttcataactttgtggcttctcaatggtatccctctctctctctcttggccttccctcatacagaatttgatagaagatttgcagaaatggaacaaagaagaagagttggatggtagttggagagaatacgagcaagtgttggctctgtatgatatggttaagagaatttttcagtttccttatgtcgataaagatcttaatgagactctcatcactctcatccccaaggatacatcatccttttacttcactcgattctccgacgataccacgaagaaggagttgtggcatcacttcaaaaagtggggcgatgtgcggaaaatcttcatacccaacagaaggaataataatggaaggaggtacggatttgtcaaattcgaaggggttaaagacactcacaacctggcaaaacaactcgacagtatcatcatcggggggactccaagaaacaagccacaggaccaagacgacaacacccaagctgaagttgattgcagcgagaaacaacaatacacaaaccaaggatcatatgctgaggacgcgtgggtagggaggctgacaaaccctgcaatgttcgatagagtggaggaagagctgttatgggaaactggattggatatatcacccaagtatatcggtgatgatctaatcttattactcggactcacagacagtggagctgaacaactcatgaacggcgggaaacatggagggatatcaatgcttgggacccgaagcactttaggcacacactggcagcaatgggggattttggtggaactggatgatgatacagaggagaagaggaggcttgatagggctagggtgctcgtaaagacaccatggagaccaacaatcaaccacacggttgatgtccacataaatggcgaatgtttcaaggtgtttgtcgttgaggacactggtggaggcaaccttcattatcgacggcgacgcagttcgttgagtgggtcgtcggacgacatcttttccgaagacacctctctcgggaatcttactccgagaaccaccagttcccacgacctcgaggacgataagcggctcttactggcgcaggcatgcggagccaacgactccgacgagggtggcacagcggagcctgaatcgaggaagaccgttgaggatgaccatcaggaattccttttacccagtgggcctcgtgacgacagttacccactgggcaatgccgctaatctgcgtgtgacagaaagaagagagaattatcacgagaaaggaaagagtggtgagggagaatccataggggtagcagatgcactgaaggagaaagaaaaagctagtgctgaggtggcagcaacaagtaacgtggcagaagaaaaggaacctgggaacgatgcaagaggggctgccgacaataaccaaaatgattccacaacagagatagcatcaaccaatgaagacatagaggaagctttggaaatactaaattcccaagaggcattcgacatctag

SEQ ID NO: 32639 - DNA, 891 bp, Glycine max
  Peptide Sequence Number=SeqID_124324
atgaaagtttctgttgtaccagtaactgttcttggtggtcagatttgcagtatatataaacttgtaatgaagctatataaatctaaacagtatccagaatatactgatattacccttgaagactgggaggaaactctaaggacagatccacaatcaaattattcaaacagctctgaagatgctcacgacaatggatcagaatctgagaaaaaaggtcaaagtaatgatgaagatgatgatggtgttgttgttgaagacactgaagggaatgaagatcttggatcagatgcacaaaagagaaaactacaaggtactgatgaggaaattgaaggtgatgaggatggcagtgatgttgatgtcaatgagaatgataacaatgtgacagatgctaataattctgaaggacttgaaaaaccctccaaaacagccaagaagttttgcctccaaaattttggaaaggttggtgaatgtaaagctattacatgtaaagaaagtggagtaatctactatggtaaagatgacagaaaaggggatgagatttcagcctttgagaaagaagaaataccagcacttcagacatcagggggagaccatcatcagggaagtacagaatgttttcatatatcagtaaatatccggcacttgaagctcaatgccgactttatgacacactctggtggctactgcctgatgaacagaacggggagcatagcagactcaacatcccttttcatcaaaatgtgctttgagacagctgccaaatttattgttgaagcagcttatcatgggcaagtggacaatttggagacaccatctgctagaatttgtattggtttgccagtgaagatgggaactgggtgccatgacttgatacagaagctggagatatga

SEQ ID NO: 32640 - DNA, 165 bp, Glycine max
  Peptide Sequence Number=SeqID_124325
atggtggtggtggtggtggcatggtcgaatgatgatggtgatggtcaatcacaggttcaatttttaaaattatgggtgatggtggagtggaatagtggtaacggtggccacaataacaatgaaggcactagaatggtggtggtgacaatagtagcgattgaatga

SEQ ID NO: 32641 - DNA, 446 bp, Glycine max
  Peptide Sequence Number=SeqID_124326
gcatgttcacaaatgcaaggccgtatctgctgttagtggcagttcaatttgggtctgctggcatgttcatatttgcgatggattctataaagaagggtatgagccattacgtgttcatcgtctatcgtaatgccatcgcctctgtatctcttgctcccttcgcatttgttcttgaaaggaaagttaggcccaagatgactttccgggtattttcagagattatggcactggctttcttcgaaataatgctggaccagtgcatcgccctcttgggcatgaaattcgcgtcggcatctttcctatctgttgttatgaactccgctcactctgttacttttgtgatgtctgtcattctaagagttgagacttattacccggtacatgataaagggatggggttggaatgcagtggaagtagtttaaccgaaggaggactagttaaatga

SEQ ID NO: 32642 - DNA, 313 bp, Glycine max
  Peptide Sequence Number=SeqID_124327
atgactagaggcaatccatctgacttacaaccctttgatcctgagatagataggacatttcatagattagttaggcatcattttataccttttgatcattctgcgcattccataactggtgaatctgtgcattctgttattggtgattttgaacatcctgatcttgagcattataattttgagcattctgattctgagcattctgattttgcatattctgagaacatggcacaacctccacctcatgagaggactctaagggaaatggttgcacctgatttcacctacgaaagcttgtgcatccaataccctg

SEQ ID NO: 32643 - DNA, 174 bp, Glycine max
  Peptide Sequence Number=SeqID_124328
atgtcgcaacgtgcccttttgcgggcgagcgaggcgaggctcacgggtgcgctttccaaaggaggaaaggtcgacaaaagcggggctcttgctcctacgtaccctccatcgaagaggaaatcagacctacgtagttctttcttatgcgtgaatcaagtgattctttttacttga

SEQ ID NO: 32644 - DNA, 876 bp, Glycine max
  Peptide Sequence Number=SeqID_124329
atgaaggatgttgcgtgtgatacgaaccttatagaaaatatggtcaatgatctcatgggtcacaggaaggaggagtttctgaattcggcatgggaagtggctatgttttctaaccatagtgcaaggatactagtggagtcgggatttgatgctccccaggagaacctgccaccatatgaagatgatgcttcaaatagtgaaagctcactccaacatcctgaagctatttctcaattaatgaaaaccaagagctacttctatgacactaataaggatacaaacatctataatggaaacacctcatgtcttgtagcatgcacaatgagtgacatagatgatgatctttgcaagggttcttttacatatgaagctgaggaggtgggaggaaatgaacttggttgtctcacatcatgtgtcagaacttggtggttccaagttgctgagctactctatggatctacatactatggtttagagattgatctttggtcattgggatgtgtctttgctaagatattaacatcaaagccattgtttcctggaacaagtgatgtagatcagctcagcagaattccaagtagtcttgaagcatgcatgcccaattgctaccctaatgaagtttccctagtgcaaagattggtttgttatgatccaacaaagagaaccacaactatggagttacttcaggacaagtactttagtgaagaacctcttcctgttccaatttctgaattgcgggttcctttgactagaaatggacatgaccaggattcccctggtgggcccaatgaaatggggttagattctgatttggaagagtttggcaccttgaatatcaccacaactagttctgatttatctaaacaaatcccttaa

SEQ ID NO: 32645 - DNA, 663 bp, Glycine max
  Peptide Sequence Number=SeqID_124330
atgggggatctttgttcaaagtctatgaaagctgacaaggtgtttgctaaatcagatggacattctgataagcataaatctgatggtaagaactacaagtccaccaacatgcctagtgatttgacaagtgcaggggatcatggactggacaagaaaaaacaagaagcagctactgctgtagggaatggttctaatgatttctatgatggaatcccatggtttaatgattcttttacccacaagtctagtattaaggccagcatattcgaaacacttggtgtaacatcacttttcggaaaattctccccagtccctgcatttgaagagggtaatgaatctggctaccttgataagaaagatttggacacttgtggtcctgaatctgaatctgaatcacatccaatgagcaagatgaagtcttctaaagacataactccttattgtgaaaccaccacttttttcatgagggggaaaagattgacatcatctcatgtaaaaaattggcaaaatatcactaacaatgacactatacatagattggaagcattaggattgtttttaaagaaaaccggacagcaaggcttcaaagtattcaagttagtcaccataggagaagaaatggattttgccgcaaccatgtcagttttgtgtaggagatcataa

SEQ ID NO: 32646 - DNA, 739 bp, Glycine max
  Peptide Sequence Number=SeqID_124331
atggagtttaagcaacatgaggaaactgagttgaggatgcccgcagcaacaacgagttacgacgacttcggaataccaccttcaagtcaaggcgaagaggagccaacggcggcggcgataccagtggcgattccaatgaccccaacaccacccaccctggctcaaaacaatcacaatgagaagtatcatgagtgccttaagaaccacaccgtcaaaactggcgtccacacacttgatggatgcatcaagttcttgcctctaggcgaggagggaaccctggatgcgctaaaatgcctcacgtgcaactgccaccgaaacttccatcgtaaggagacccccaattacacctacctggtgccttactaccgccactcgtcgttgccgttggcagcgtactatggggagcaggtgggctacccccatgtgcaagggcaacaatgcaccacactggcactcccctccaggtcaaggggcattggtggggcccagtcctcgagggaggacatggaggcagtgtcagacccaacgagtggtgccactcctcatggcgggtccagcaagaagcgtttcaggactaggttcacccaagagcaaaaggagaagatgttggcctttgcagaaaagcttggctggaggattttgaaacacgatgagagtgctgtgcaggagttttgtgcccaaactagcatccaacctcatgtgcttaaggtgtgggtgaacaacaacaagaacaccttag

SEQ ID NO: 32647 - DNA, 186 bp, Glycine max
  Peptide Sequence Number=SeqID_124332
atggtagaaacagtaaaagaaaaaagcgtgaaagctacaactaggctgcaagcttgcaacatcggagaacatgaaaaactgtctttgcagagacagagagggaaagatgtgaaaacccagttacctaggggaattttgcgatccgctccgagtagattgggtcatagatgcaagagaaggccctag

SEQ ID NO: 32648 - DNA, 201 bp, Glycine max
  Peptide Sequence Number=SeqID_124333
atggggtttggagttagggagtggtccttggaagaggaatcaaagaatgagttcaagattgaatcaagaacacttcaaggttcaaagaggaaatttgatttcaagaatcaagaatcaagtttcaagattcaagttccaagaatcaagatcaagattcaagactcaagattcaagaatcaagagaagactcaatcaagataa

SEQ ID NO: 32649 - DNA, 231 bp, Glycine max
  Peptide Sequence Number=SeqID_124334
atgacccaagatgggtatctgtcataccctaatttcgttcggggaccatcgtttgatggcatgcaaccttcgcttgaccgccttgagttccgcgacattttggaagtcaaaaagaggcattgttgcgcaatccgtaaagttccgcgacatttcggaagtcaagaagagccttgttgcgtaattcgtaaagtttcgcaacattccggaaaggaaatgggtgtcgttacgtaa

SEQ ID NO: 32650 - DNA, 180 bp, Glycine max
  Peptide Sequence Number=SeqID_124335
atgagtggaagtaagagatgttgggcttatgtcctttccacaattcatagcctaggatcttcttcatcaatggattcctttgcttcttggaagatgaatggtagtgaaatggagaaggaagagagaaaggagacgccacttcaaggagaagatgagtctagaagaagctcaccaccatag

SEQ ID NO: 32651 - DNA, 507 bp, Glycine max
  Peptide Sequence Number=SeqID_124336
atggatcttaagttgagctttttctttccacctgaggtcttggttgttgcgggtggtttgatcgaggtcgcggtggtcgttggcagcacgcgattatcattgtggtgggtggagtgcctagagggagtttgggagaccctcgaaggcaatgagaggtgccgattccgtggcacgattcgactcactgctacttcattggtacatccagaggaacccgcacgcatgcttcagcagcctgtggagtggatactacctacacctactccatatcgactagtggagccagtccaagtgatagaggtgtcatcctctgaagaagatcctgaggaggacccggaggagctacctcttgaacctgctgtggatgatcttgacttacccgaggatgatgaggacccattctctgatgttgattctccagaggatatgatgtcagcatctgaggcagactctatagaggagagcggccctagagggacagcgaatagtgaagactcttcatcatag

SEQ ID NO: 32652 - DNA, 315 bp, Glycine max
  Peptide Sequence Number=SeqID_124337
atgatgagatgttgcacactgattgattggcctaactctctaaaaaagtctccagtggagtcgccaactgtcgcaacctacccttcggcgggagggcgacgcagggctcacgggtgcgtcatccaagggaagaaggcgcgtagagttgccaccaacgtttattcgaggaaaataacggaggaaaatcttcacggatttgctcatggaaacatctcggaagggttacggaagaacctcggcttggattttcttcacggaaacacgagaaatggggaggtgcttgctgcccagaggcttcttgaggaagatttctga

SEQ ID NO: 32653 - DNA, 544 bp, Glycine max
  Peptide Sequence Number=SeqID_124338
atggatccgcctcctcccaagaaatcgaataggctagccatgtcttcatcttattgggcttcgtcctcgaccctggggccccctgcggacactcatgcaactgcacctgtcctcggtggttggccgcctgctggtgaaccacatgctgtagggagtacaatacttctcaatgaaggccctagtgataggaggtcggatgaccttactgggtataacgggcacttcgtagaactggcagaggactgggtatctcgtgggagtcatacctgcaaaaatataaatggcgtttgcgatcaactgagccatgtgaacgctcattcccgtaaggatggcatacaccagctgacacttcagcaggggaaggtcagagttgtggtcactagggaagatgttgttgagcagcagcatcatccacatctgggtcagggtggtcattctgcaactcgacaatggcctcctcatcaaaaccatcagcttggtccctcctctggctgtactcacattgctaaccctcgagcacatgtgatccaagaactggttgagg

SEQ ID NO: 32654 - DNA, 792 bp, Glycine max
  Peptide Sequence Number=SeqID_124339
atggtatcaaggtatgtgttaaaccagattgctcctgaatttgagcgtgtaaattatgttggcattgacagttctcgttgtggatgtataatgaggactactcatgatcttccatgtgcatatgagttagctagatatgttgttggtagcataccacttgacacaatccatatgttttggaagagaccaagtttttcagacctaggtttatttgagctcgaagtcaccataaccgaagagatggaagctatatcgaagcagtttgaagagcttgatgtatgtggaaaagtgactctaaagagtaaactttgggaaattgcctacctttatctaaattctatttgtcttagtgggatgaaacggactgcatcatcatctgaacaaccaaaaccaaaaaggaagatgcccatgttggatcaatttcatccatgcattcatgatttcattgaaaacattgttcatgtcaaagatgatggtaattgtggatatcctgcaattgctgccttattaagtatgggtgaagattcatggtctttggttcttaaccatttgctgaaaaaacttgcaaagtggtctgatgagtatatgaacctacttggtggcatagacaaatatgaagatttaaagcggtcgctacttgttgatggattatccatggttaccatggataagtggatgattataaccaacatggattatgtgattgcatcaaggtataatgtcatccttgtttatctttctctccaacaaagtgaaaaagatgatggtactcaacaaaccaagggtggttga

SEQ ID NO: 32655 - DNA, 705 bp, Glycine max
  Peptide Sequence Number=SeqID_124340
atgcctgaagtcactcatgaagacatagtgaatgtgaaaagagcaagaaagcacactcttgtatccaaatatgaagcgtttcaaatgaaaaatggagaaaccatttcaaaacttcaaacaagattcactcatattgtgaaccatctccttggtctaggaaaaacgtttgaagataaagagctgaacatcaacatcctcaattgtcttacaagaacttgggaacattacaaggatagttcctgcagtgaggaagatgcaaataatttcaatttgatggtaagaaaatttggaaaatttctcaagaagtccaaagatagaaaattccctaaatcctccaagaagattgagaacaacaacaacttcacatgcttcgaatgcggtaagcaaggtcatatcaaatttgagtgtcttatctaccttagaacacatgttgtagaaaataaaggaaagaaggacaaaaaacaaaataaatcctatatagcttgggaagataatgcgtcaacaacctctaactcatcagtcattgaagaaactaaggtaaatcctgaatttgaagaagttttggaagcatttaatgaaattgatgcaatcctccctaggaagggactagttaccagagccatgagcaagaggctccaagaggattgggctagagctcttgaagaaggcccgagggttctcatgaacctcagggtagatttttga

SEQ ID NO: 32656 - DNA, 426 bp, Glycine max
  Peptide Sequence Number=SeqID_124341
atggaatgtttgccattgattgaatttacttacaacaacagaagattattgatcgaagtacaagtgaaggataacctcacctacaaagcacaacctcagaagattattgatcgaagaatgaagtcgctgagaggaaaggagatcgcgttggtgaaagtgcagtggggacccaacgaggagaaacgtaaggaactggaaccagagaagcggcatgcaaaccgaggcaggattttagcattcaaaaggtcaaacttttctctccttgtggctgagtatgaagtcacctcaaagggaagagctccaaactttgctcatcatttctactccaaattgcaaaaggaagccattttcggagtcgtgaagcgcacctctacgttgtgggacttcgaatttcagaaaactggtagagatgatgaggagagttaa

SEQ ID NO: 32657 - DNA, 2892 bp, Glycine max
  Peptide Sequence Number=SeqID_124342
atgaatggatataaatcaggatctgctctccttgtaaatgctgaggttgattctatgggtggagttgttgacggtggaattggtataggtttgaagatctctccgcgcagagcagcaattgagaaggcgcaagcagagctcagagaggagtatgatgttcgtgaagaaagaagaagagagcttgaatttcttgaaaaaggtgggaatcctctggactttaagtctgggaatgctgcttcagttagtgttcagtctacttcactcactgatcagcttcatgagcagtttgtgaccagtgaagcaaaaggtagttttgcattgactgcctcccctcatggtgactctgttgacagtagtgctagacccggggctcctttggccagtgagcctaatactgctgataatctcctactttttgatggtgagaatgagttgcctgaaactgaaaggaggtgcttgcattcaaacagaaggaataatattgctctgtcagaacagtcttcccaaattgatgggagtcaaaatgctaaggagactgaagattctgctattttccggccatatgcacgaaggaaccgatctagatcaggtcatggtcctcggggagcttcaagggaagtgaaggggttaacgtctgaaacaaatagccaaaagaaccttaatttgtcaactgtatctaagccaaagccttcctgtttaaatggtgatgttggccccaaatatttgactactaataatactctgaataatgaattggttgggatccgagatcatcaatccactagtggcaatgctagtgttcccgaagacaaattggatattacggtgaatagaaacttaaaagaaaatcatggaactctaccttctgaagataatactgttcaagacccagttctcatggcttctggagaagataacatagttgaattaagggagccagtagctgttgtcaatcatgagcctccacctcatgtacctactacaaaacctgaaaatgggccttattgtcagccaaatgggtttggcaatgtagaagtagacaggaaaagtgtactaaatgaaggccaaaatagcattgctacattaggcaagaatttcaatttagagtcctcgtgcacaaaaactagcttagttagagatgtaaatattgatagtgatatgtgtactaatacaaagaatgttgatgctaatggaaataccatggaacaaacatttgcattagagaataaactgaacttcgctggctgcaaagttgtgaaagataggcataagaccaaaaatgcaaatggtgctactgttagcaatgagcatgatgctggttatcaaaatcattctggttgtggtaatattgtcaaagctgaggaagatgtccatattaagagttcttgcatgtcaaatgtcaaaggagtacctcataatgacagtaacatatcaaaagttgataaagataccatcttagtggatcagtccaattttgtcaaggaaaacagctgtgaaagacatcaggttcctgtggatgtgtcactttcagaacctcctaagactgctccagatgtaaagggtacaagcgccgcctctgatgatcaaccatgtcctatgcacaatatgaagttagcagacaaggctcatgaagattcaattttggaagaggctaaaattatagaggccaagcggaagagaattgcagaattatctcttcactccttatccacacagaaccacagaaagtcacactggggttttgttctagaggaaatggcatggctagcaaatgattttgctcaggagcgcctttggaagatagctgctgctgcacaattgggccatcaaacagcttttacttgtcgctcaagatttgaaaaactgaacagacaattagagacaaaaattttgtctcacaggatagcaaaggctgtcatgcagttttggcattcagctaagctgcttctagacaatgatcttggtattaactgcattgttggttgtgttgaatctgggaaagttgatgcaaatgaagctttgagggatcaaagaagaaatagcaatatggagacaagcaaatttttggagggacaaaatcctgaaaaacatgctgcacttaaagtgcatgcatatgctttgagatttttaaaggctaatagatctcatggaatttcctctcaagcagaagcaccaacaacacctgaaaagatatttgactcaagcactgtagatatgtcatgggatgagcatcttaatgaagaaaatcttttttatgaagttcctcctactgcaatggaaacatatagaaaagctatcgaatctcatttcctacagttcgagaaaactgggagtagcattcaagaggaagttgcaacatctgtgtatgatactgcagcagagtttgggtctcaagagaatgcatatgatgaggaagaaggagaaaccagaacttattacttgcccagtgtctacgagggcaacagatcatcaaaatctgcgcagaagaaacataaaaatttgaaggcttacactcctagatttggtgatgctggtgctgattttccttatgtacactatgcaactggaaatcaaccatccatgctgtttgaaaaaagacctgctagtttaaatgttgggtcaataccaacaaagcgcatgcgcactgctactaggcatagagttgtaagtcctttcactgtcaacattgggactgtacaggctcaagctaaggcggatgcttcaagtggtgataccaattcctttcatgatgaccagagtactttacatgttggacccctgatccagaaaagtactgaagttgagtcagttgcagattatgaaaaacagttatctcaggactgtgcagaaacatttgttaaaacaaagaagaagaagaaggcaaagactctg

SEQ ID NO: 32658 - DNA, 312 bp, Glycine max
  Peptide Sequence Number=SeqID_124343
ggaggagcttgccacccagctcacccaggcgagctcagctcgcccagacgagctaggttgcttcctccagaaggcggtaccgccttctggtggaattcctgaaagacccaaaacttcacagattatgcaacaatgcttccttttgacttccggcatgttacagaacttcacgaactgtgcaacaatgttttcttttgacttccggcatgttgcggaatttcacggattgcctaacgatgggtgccaagtacctcgaagtggtcaaaagagggtcgcatcccaacaaacggatggtccccggatgaaattagg

SEQ ID NO: 32659 - DNA, 180 bp, Glycine max
  Peptide Sequence Number=SeqID_124344
atgactagagtaatcaaacttccagtcgtcaacaagggtaccctcaaaagtgtagaggatgacaaggatggtggaattggtgctggggatgctccggtggcttcggtacgtgatgttctaggtgttgcagctaaggtggatgaacccttgcgcttcttggatgattttgccatttggtga

SEQ ID NO: 32660 - DNA, 267 bp, Glycine max
  Peptide Sequence Number=SeqID_124345
atgtgggctcagcgcgcatccactgctaagcgcagcttcagcgcgcttagtgtgacaagggaatctggaagaacacaagaatcaaggttgcgtgctaagcgcgagatcagcttgctaagggagacacttcgagaaagactctggaggcagcaaagaggagtagttgtgcagagaagcctagggttctacatttttagaaagattagtgactttagcatcgggaaatgtactgttgccttagaacttgatagaagcaggactaaatga

SEQ ID NO: 32661 - DNA, 531 bp, Glycine max
  Peptide Sequence Number=SeqID_124346
atgatgcttgatcagctagaactgacaaagattttccacaacgaaggtgcagttttccattacgagtccacaaagttgaagaccttagaagtgggagatgagaaggttgagtacaacttcctttgcaaggaagcaaaactcaagaagaatatttgtaacaagagcttgctacacaacaaagtggacaagattatgcaagagaaagctaataagaagaaaactagaagccaggctcaacaacaagaggaagagttgatcaaaaaagagaagaagactaagaagaaacatgaacaagttggtgtgtccaatcctcctgagattcaaagtgatgtagctctatgtggagcttgcaggaagaaagatgattggagacaccacttcaaggagaagatgagtcaagaagaagctcaccaccataggaagctatggggaccagtccctagagccatgagcaagaggctccaagaggattgggctaaagctgctgaaaaaggccctagggttctcatgaatctcagggtagatttctga

SEQ ID NO: 32662 - DNA, 495 bp, Glycine max
  Peptide Sequence Number=SeqID_124347
atggctaagtttgaccctgagatagtcctggagttctatgctaatgcttggcccacagaggagggagtgcgagagatgtgttcatgggtgaggggtcagtggattccctttgacgcagatgccctcggccagttcctgggtgacccgctagttttggaggaaagccaacagtgtgagttcggccagaggaggaacagggccgacagcaatgtcttgcctagcgatcacaactctgatctccctctgcctaagtgtcagttggtgtatgccatcctgacacagatgagcgtccacgttgcccaagtgattgctgacgccatctatttgtttgcaggtatgccacccaccaggcaccctctagacccggataagtctaatagggccctggggtttccggcactgatcacgggcctctgccagtcattcggggttcccgtcaccattgtttttacgacttaccgtttggtgcgttcttttcgtttaccttgtggttag

SEQ ID NO: 32663 - DNA, 543 bp, Glycine max
  Peptide Sequence Number=SeqID_124348
gggaccaaatccgaaactggagataaactgggggaccaaaaatgcaattttgccaaacaatttaaacaacaaaatttcatacttaaagaactacgtaggtctgatttcttcatcgcatctgaggatatacgttttcctcaaataaacgttggtggcaacttcgctcgttttctcccttggagacaaacactttggcccatctattttggccttttcgcacccccatcgaagggcaggttgcgacaggggctaagggtggtggcagagggttcagagatgcaagagcaggcggtggttgagaagactgacaccaaggttagagaactaggtggtaatggcattttgcatggagagcttggattgctcaatctcttggcattgtcacttggcaaaagattctatggcttgttcaatcatatcttgcacttgatctcaagtgacagtggcaggttatgcatagttgagaggagtggggtcggaactggtagagtaaacgatgacaacattaggttcgcccttatctttagaattagccttatttga

SEQ ID NO: 32664 - DNA, 489 bp, Glycine max
  Peptide Sequence Number=SeqID_124349
atggacaccctcactactaaggagcttgctaaagatcaagaaaaatcagtagcaaagtgcaagtccaagagaaaacaaaggggaagaaaacaaagaagaagaagagtgcctcgtttgatgagaaaaaggacgatatcaatgaagttattgctaacagttgttagtcgtcatttacgactaacttttgtattgaaaaacattatgaaatttatgtctttcccccaatttatagttctttttgtaggtgaaaagatgaagaataaaaaggttgcagtagctggtgtctcgctaagcgaggcatatgcgcttatcgagcaacatccgctaagcgagacatcagctcgcttagcgagtgaggagaatttgaaagagaatctaccatgcatgcacgcgctcagcgcgccatcagctcgcccagcgagtcatttgtctcttctggcgcccagcgctcctgactcgctcagcaaaaaatcagtaacttgcgcttag

SEQ ID NO: 32665 - DNA, 231 bp, Glycine max
  Peptide Sequence Number=SeqID_124350
atgtcatgctgccttggttcaaataacgagcatttcatcttggaaagcaagaaagctgatcttgctttgaaggttaatagtgcatctttcaatggggatatgtatcagctaagaggtttaattcgagctggagttgatcccaacaaggaagactatgatggaaggtcacctttggtaatgcttgcaactgttggatcaagtggcctcagaataattaagaaggggggttga

SEQ ID NO: 32666 - DNA, 390 bp, Glycine max
  Peptide Sequence Number=SeqID_124351
atgatgataacaaaagatgatgacaaaggtgatgacaaaaagctcaaaggtcaatcaaaggatgagttcaagatgttcaagaaggaatcaagaacaattcaagattcaagaggaaagttgaattcaagaatcaagattcaaggatcaagcttcaagatcaagattcaagattcaaggttcaagaactcaagagaagacttaatcaagataaggtacatcctttgtggtacaagtagagggtacatctacttgggtttgactgagaacaaaagagggtacatctcttgtggatcagttctagtggagggtacatccactaggttcaaagagaacaagagagggtacatcccttgtggatctttgcttgtaaaaggatttttacaaggttga

SEQ ID NO: 32667 - DNA, 393 bp, Glycine max
  Peptide Sequence Number=SeqID_124352
atgtcacaaaaccttacggattacgcaatcatcccttctttggcttccgaaatgttacagaactttacggattgcgccttaacacgtcctttcaactcccgacatgtcacggaacttcacggattgcctaacgatgggtgtcaagtgcctcgaagtgatcaagcaagggtcgcaccccaacaaacagatgatccccagacgaaattagggtgcggaatgaccataatttgtctctgcatgtcatcgggctcaccgcctctggatgacaaaagggcacagaatgatcataatttgtctctgcgtgccatcggacacgatcgtatctggatggcaaaaggtgcgcggaatgatcataatttgtctccgcatgtcatcggacacgattgtctctga

SEQ ID NO: 32668 - DNA, 693 bp, Glycine max
  Peptide Sequence Number=SeqID_124353
atgtcgtaccggatgtcacgacatcacgcttcagaacatgcagattatatgtgtccgtatgaacagattaaacaagtggctcacaaaagactcaagtcccaaaactcacaaaataactcttcaatcccggacttggtacagaactcgtgcagcctccatgattatatagccgtgtacgattctgggctgcaactccttgatgctggaggagatctatcttcttctgaaaaatctgcagacatcgtgtccgacatcgtggatcctgcagcttcacttctgcacttgacttttatcttgcattgtatagcaactccagtattctcgggcaggatgtcaggacattgtatccgacatcgtggatcctgcaacttcacttctgcacttgacttttatcttgcattgtacagcaactccagtattctcgggcaggatcatgtggctagccaacaagcggctaatcatggtggtcaggagcagctgaatgagagcttctaccaatacacccagcatcagcagagcaaggaccccagtcctttcccgtggtctacccccaagcagttcggggctacgactgcgtggcctggagatgagcccgattttgagataggggcaagacccataggggccactggggacgacgatggagctctagaggatgacgacatggctaatgtgctggatttcttcacttga

SEQ ID NO: 32669 - DNA, 428 bp, Glycine max
  Peptide Sequence Number=SeqID_124354
aggtcgcacaagtctctaaatcaaagaaggtagagtctagattttctgatgaggagtatcaagagtatttgaagcttaaatccgagaaacccagtaaccaagctcaatcctcatctgtaccatgtttttcaacagcttgtatctctgaatccattgaaggttctagtccttggaaactcgactcaggtgcctctgatcatatttctggtaataagtcctccttttcatccttctcttttccaaaaattcttcaccttgttactgtagccaacggttccaaagttgcgtctcaaggaagtggtcaagaacgtggaacggggcgactgattggagaagaacatgaatcacgaggactttactacttggaattgagtccacctgggcttgttttgcaatctcaaagcccaaacttttgcatgatcgtctag

SEQ ID NO: 32670 - DNA, 288 bp, Glycine max
  Peptide Sequence Number=SeqID_124355
atggacattgttggaggaaacttccttggcctttctccacacatcatagcagctgaactgagaggtcatgagaaattcactgaaaaagtgacaaatagggggttgggaaggtgccaaatagtcgctgatgagtgggaataccagaaggtggctcacgcgccggtgaagaaacggcatgtggcgatggacaacggtgggttaggtggtgttttggtcgtcagagggaggcaactttgggggtgtggtcgtgtcggggtaagggggtctcggtggaatagagacctgtaa

SEQ ID NO: 32671 - DNA, 795 bp, Glycine max
  Peptide Sequence Number=SeqID_124356
atggacatccttgaggaatcaggcctattatatggcaagcttgttgatacacctataaatccaagtatcaagctttttgccaaattaggggatattgccaaatttcaattcaaatggcaactagcgtatatattaactaggtcattgggtaagttacatgtgacaggcacggtgatagctgccactaaccaagcagtccgatggatcactccacttggtcttccagtagtacaaccctaccgacaatttggaagacatcttatcaagacttcccttcagatattgacattacaacgggagactaacaaggtcatggttaaacggcagagaacagcttttcccccaaattttgttcactctcttgatggttctcacatgatgatgactgcagttgcttgtaaaaaagcagggttgaactttgcaggggttcatgattcatattggacacatgcgtgtgatgttgatgaaatgaacaggatactcagggaaaagtttgttgaactctatgatgctccaatattggaaaatttgttggagagcttccaaaagacttttcccgcattgaactttcctcccttacctgaacgaggagactttgatcttcaggagccccaaccatggagaagaaagaagtgtgtgaagcaagaactgggttgccaaattagtaccttcaggaatcttgtacttcttttctacgcctgttttaaacaggcatatttccttgaagagatgtcccatagttggtactccagttgtcttccaaatccactattttatagaggatacaaggaatga

SEQ ID NO: 32672 - DNA, 705 bp, Glycine max
  Peptide Sequence Number=SeqID_124357
atggcaagtaacccatcaagagctcataaaaaggagaagtcctccaaaaggaagcaaggtgaatgctcccaagcaattatcaatcgcttggacacatggttcacggacgaaggaaaaaagagtgactacaaagtgatttatgctataagaaacgtgagggtttcaaagtatttggacttggaattgttttctcagcaagggttcaactttcctaatctgctggaagttcaaaggctgacaaagtgtttgtacacatgtgctcgtgttgaccttgaaggtaagcttttctctactgttaatggagtagatatggtcatatatgttgttgtgtggaaggaagttgatggtttggacatgggtggagtttgcaagtttgatgaaactgcagatggctacaacaagatgcaggcctataagggaatgcttcttgatcctagaaggagattgagacgttgccttagagatgacggattaactgttgaggacaatatgttgatctaccttatcacctacattcttacaccaagattcattgactattttaaggtcgatgtctctaatgagattgtggattacaccaaagcctctagtgagataactgaaagccatctcaggaagtttggtatgaggtatgttgatcatgaatggataatgattgcagagcctgttgcgggaaacattgaaaagatggaaaaagatgattaa

SEQ ID NO: 32673 - DNA, 903 bp, Glycine max
  Peptide Sequence Number=SeqID_124358
atgcttgtgatgttatgtgctgaaattgcttatggaaaactgttagagatgaagggtagagttaacctagggttagaaagtgagaatatgaattccagtacaattttcgagttgatccaacggttaacgaattggaacgaaggaaatgttactgggtccatgatgattggatgtggaattacctggatgttgtggaagcttgggaggattgatggggacccggctttgagaggaacgaggataagggctacgtgggagtacgtgagctcagttggaggtgggcaacaggggatggtgggttatacagtggtacctggagatatgtcgcgggggtcaggagaccttggggacgtcaggcgagctcctgacagtcaacagataaaaggaacaaagaccacaaagcaaggaggcttgcttgaaaacgaggtcaggaagctaggagggcttttggtaatcgattaccaagggagggataggccactggtaatcgattaccagatcgtgatggcggcgcagctaatccatgatcgagtggagatggagtgcctagagggagcttgggagaccctcgaaggcaacacgaggtgccgatttcggggcacgattcgatttacggctacttcattggtgcatccagatgaacccgcgcgcatgcttcagcgtactgtggagtggatactacccacgcctacaccataccgtctagtggagccagtccaagtgattgaggtgacgtcatccgaggaggaccctgaggaggatctcgaggagctacctcctaagcctgctgtggatgctcttgactttctagagggtgatgaggacccactccctgaggtggattctcccgaggacatcatgtcagcatccgaggcagactctaccgaggatagtggcccttga

SEQ ID NO: 32674 - DNA, 231 bp, Glycine max
  Peptide Sequence Number=SeqID_124359
atggcagcagaatggagaaggaagagagagaggagacgccacttcaaggagaagatgagtctagaagaagctcaccaccataggaggccatggataagagcttggaggaagaaggagatgaatgaagggagagggagagaagagcacaaaattttgtgctctaaaagagctctgatatatgaacccactaatccaagatcaattccaagattctccactaagtgtgcttag

SEQ ID NO: 32675 - DNA, 138 bp, Glycine max
  Peptide Sequence Number=SeqID_124360
atgatggtcacatgggaagacatatattcatcatcttctgagaatgaagaggagcatgttgtcaacctgtgtctcatagaagatttagacaaagaagatatgtgctcacttaaaagagcaactttcttatgcgcataa

SEQ ID NO: 32676 - DNA, 294 bp, Glycine max
  Peptide Sequence Number=SeqID_124361
atggaggagtttgaggctcaggtggcctggctagaagaccagcccttttcttctagagggggtggagcctctgtaacccaggagcttgatactgaggagccactagcaccagcacctacaccaacagtagcagaggaggatgagactactccagatcagactccacaaccatctccagcccctgcacatatacctgaggatgttgcaccagttgcggagcctgagcaacttatactggagtcttcagtagctctagcactattgattgtgaaggaatgcattaaccgtatcatg

SEQ ID NO: 32677 - DNA, 1176 bp, Glycine max
  Peptide Sequence Number=SeqID_124362
atggcgaagactcgaagcgctgagaaagccgcgcaagtagatgcggaggacagaaccgatggcctcgaaataatttccatcggttccctctacaaaggatcctgggataagaagtactggaccacctctaggggaaaagatcggtatccatatccagttggttatcaagctgttagagcttataacgggaccacttataagatggaaatttgtgaaggtgtcaatggccctagatttttgatttcttctgatgatgggagttcatcttctgggaaaactcctgaccaagcatgggaggagtttcagaagaaaggttgcccacgaatcaagatttggcatgggaagagactttcatctaagatggatggcttggagctttttgggttcaaaaatcagtttatccagaggttgctccgggaactggtgacagatgtaaatggaatagcagagcggagcttggtatccccaaacatttgtgatggggttactagaacagatcatgataattgcacaaatgtaggcacatatcctgatttactaacttgcctcggaaaaccacgtgttacagggaagagaagcagatgtgaacttaagaataaaaaattaaatgtacgagctagatctcagtctccagaactgacatgtagtagaccttcaattgtacagaatgagaagagtcttggtcagaggagttctacaatccattatggttcagaagtacttgaggtccacaatcagataggcgtgccagtcctattgcaaaggatatcttccgtttgtaaaagcagtaattgcatttcatccaaaaatgagttgctattgaatcctattgaaatctctgatgaaaagaaagtgggagctgtaccttcaagaggatggactggttttctctattctgaagattgcaaaactaccgaactaactgcagaagatctgccgcaggatgtggagttgaagatatctaatttgttggtgacaccagaagacaagaaactgatgcctttatgttctaaagagtctgttggttgtattgatattgatctttgtgctcccgataccatagattttgtgcaaggggatcgtacccatgacctttctgctcttttcttctcccttaaccatctaacccaccttatatctccggcaatattgaacagtgtgttctttatagaatga

SEQ ID NO: 32678 - DNA, 243 bp, Glycine max
  Peptide Sequence Number=SeqID_124363
atggtgctgaaatcttggaatgtcaacttgttgggtgagcctttagcattaaattttgttgcatctatggctgacaacttagccatggagctaaggcagaaggagtgtactgagccagtcaagctaattaaattaagctacaagggtgcagttgtcttccaacaatcagacaaaattttaggaagtttcaatgtgcaattccagttttcagattccaaccttgaggacaaggttgatttttag

SEQ ID NO: 32679 - DNA, 1011 bp, Glycine max
  Peptide Sequence Number=SeqID_124364
atggcaactcttgcagaaaagacacaagatgaagttgtgggtcaaacaggcaatgctgaaatgatgattatgtcttcaaatttaccaaaattagtatacaccagaaaaaagctccgaaatgatattcccttccaagaaaattgttcagtcatggagtgtactgaatatgacaaatttaaacatgttactcctgaaatgtatactgccaaagacactttacatccctcagaaatcattctagtaaacaattctaatgataaaccatgtgaaacagatgatactgcaggtttatgtgttcaaacacctcaaattcgtagtgatgttctgggtggacatagcaacctagtggatcctaacccaacatcgtctcagaatctaaccctgtttgctgatgaaaataagtgctttggtaccaaggaggttcaattaatttcagaaccaatgcccctgcaaaaccaggagctcaagaataatctgggcagcagtgttaagtttgtgggacgttacttgcacccaatgcctgtttcatccttatttttaagcacaagagaggatgaaatccatgtttgtgtcttatgtggctatctgactggtcagtacaggaccctgttcacgtacaaggtagctattgctgaaccaactttagggtgcccttctgtcatggctcacagctcaatactgttgccagatccaaaacataacttcataaaagaaactatggtggaaagatctggggtgcagttgactcctggtggacagtatgttgtcttaataggcagcataaagacccccaattgcagggaaggaaagattgattgtcattgctcaacatgtaaatcagtctgctctgagaagaacgctttgaagattgtccaagtagaacatggttatgtatcagttgtaacaacattggaaactgttgacaatgtgcattgtatattggtttgcgaacctaaccgacttgtttctgtcggagagagtgggaaactgcagctgacagcatgtatataa

SEQ ID NO: 32680 - DNA, 459 bp, Glycine max
  Peptide Sequence Number=SeqID_124365
atgagattattcaagaacaggctccctactagggataatctcagaaagaggcaagagacattgccttcatatagctgtcctttatgtgagtatgaagaagaatctgtcactcatcttatgttcatctgctccaagactaggagtctttggtgggagcctatgagatgggttaatagagtgggtcctctccccatagacccaaagaataactttctgcaattctctcagtggaataggcaaagttgtacagtcaagagatgggaattcctgtggatagctctgtccttgtgcatttggcatcacagaaatggcatggttttcaataatcagcctttcaatccagaaaaggtcatggatgaagccttattccacacttggtcctggcttaagtgtgtggagaagggctttcaattgcattttaatttctggtcaactaacttgaaggatgccttttcttag

SEQ ID NO: 32681 - DNA, 423 bp, Glycine max
  Peptide Sequence Number=SeqID_124366
atggacacaaaaacaagatcacagatgatgatgcatggaatggaagaaatatttgttcaaatagaagggctccaccatacatgccatcaagatcacattcaagatttgaggcgtttgcaacagcatggcaccttggcagaatttaataatgcatttgatgcgatttctgggttcctttattcaagtttcaactgcaattctctacgtttgaaatgcaagaccttgagggaaagggtcttcttatgggggaggggtattgatataaaaacttcgtaccccattgcccagaggctcttcgctatgcgaaggtatggggagagatgttgtacgcagccttaccctttcatatgcaaagaggctgtttccggattcgaacccatgaccaacaagtcaccaaggcacaactttatgtcaattagttag

SEQ ID NO: 32682 - DNA, 441 bp, Glycine max
  Peptide Sequence Number=SeqID_124367
atgccttatggggagcatcgacccgttcgggagtttgatttgatttcatgctttttcggtcagctacgatgggggcctgttgccgccagacaccgaccagagagggtcgtgcgccaattcggatatgtccagagtattccttcagaggctgtcaattcatgggtgtcatttgaagaaatagacgataggtggatgcactactcaaatcatcttgcaccaacaggtgagatatgttttatgccaggtcagtgtgcgctcgagtacatggactggttcttcatcatttctcatccattcatgaccccacatatccctcaggtcccagagccactagtaggagcactgacacatgcccgtcctcatgtggaccagcctagacatgtagtgatgcttgccatgcgatcgctgaaaggttgtagcgtctgctcaaccttaggatag

SEQ ID NO: 32683 - DNA, 465 bp, Glycine max
  Peptide Sequence Number=SeqID_124368
atgtcacatcctcctcaacttctatatgcttttcagctcttgcatgtcaagatcatataccttcaacatcgctatgttgaatctagcgagatactctttaagggtttattgcctgacgtagaacagcatatgcctgagttcctaaagcatgctagaataagctacatcttgaaagttgctcaagatcacagtttttctaaaatggactttaaacaaattactttcaaagagggtgcttctcttaatcggccaccattgttcgatggcgggcacttttcattttggcaaaagagaatgaaaatctttattcagtcaattggtctcagtgcatggaatgctattgttaaaggatcatttatatcgactaaagtagtcaatggtgaattggttcctaaagaatgggatgagatgaaagatgacgaggaaagaaaagtgcaagatgatcaaaaagctaaaaacatttaa

SEQ ID NO: 32684 - DNA, 690 bp, Glycine max
  Peptide Sequence Number=SeqID_124369
atggttgtaattccttgccgctacgttgacgaggacacgctattagcggcacgtggcggttctgatgacaaagaagttgtgcttgatgatgacactttagataatgttgaatccatagtggatgaccctttgtgccctacagtggttatttctagggaggagagaaggaaaatgtatgaaccttggaagcgggtcattatcattaaggtattagggaggaaggtgagcctaaatttcttgagggcgagactagcgaggatgtgcatcccaaagggagtaatgaagaggatgcctagggtttctccatgggtatttggttgctttgggattccttcatgtccgaatataagctctatggatgagctttgggaggaaatgattcaattgagtaccgacagaaatgatccttggcttgctattggggactttaatgtctatcctcatcctcatgagaagagtgagggaggtcctgttaatgtatatcatgcaggttttgatgatgacaaagtattacttaaagatgcatggattgtgatgcaagctctattggagcttgtaggcctaggatcttcttcatcaatggattcctttgcttcttggaagataaatggcagcggaatggagaaggaagagagagaggagatgccacttcaaggagaagatgagtctagaagaagctcaccaccatag

SEQ ID NO: 32685 - DNA, 792 bp, Glycine max
  Peptide Sequence Number=SeqID_124370
atgagctttcaggacatcgaggccgggcgccccttcggttcgaggcgcgggttgatgaatgggaagcaagaccccacgcaagcggtggctgccggcatattccagatcaacactgccgtctccaccttccagagactcgtcaacaccctcggaacccccaaagacaccctcgacctccgcgaaaagctccacaagacaagactacatattgggcaattggtaaaggatacatcagctaaacttaagcaagccagtgacattgatcaccatgctgaagttaatgcaagcaagaagatagcagatgctaaacttgcgaaagattttcaggcagtgttgaaagagtttcagaaggcacaacgtcttgcagctgagagggaaacagcgtacactccttttgttcctcaagcagtccttccttcgagctatacagctagcgaagtagatgttggttctgataagtcaccagaacagcgtgccctgcttgtggaatcaaggaggcaggaggttttattcttagataatgagattgccttcaatgaggctatcattgaggaaagggagcaaggcattcaagaaatacagcagcaaattggtgaagttaatgagatcttcaaagatcttgctgtacttgtccatgagcaaggagccatgattggtaatttattccattcccttttgttcttcctgatgatattggctccaacattgagaactcccatgcagcaacagcacaagcaaaatctcaactttcaaaagcttcaaaaacccaaagatcaaattcctctttggtaa

SEQ ID NO: 32686 - DNA, 458 bp, Glycine max
  Peptide Sequence Number=SeqID_124371
ggctacacgccctcgccttcatagggctacacgccctcacctttagaggactacacatcctcgccttcataggactacacttcctcgccttcagaggactacacatcctcaccttcagagggctacatgccctcaccttcagaggactacacgtcctcgccttcagagggctacatgccctcaccttcagagggctgcacgcccttgcctgcatagggctacacgccatcaccttcagaggattacacgtcctcgccttcaaaggactacacgtcctcgccttcagagggctacacatcctcgcttttagagagctccacatctgcgccttcagagaactcaaggaggaggctatcacaaagctactatgcatatcggggcaagatttcgcccgggccgctgcaaagagacgagtgcagatcatgcgcactgagataaccactcttacacagatatga

SEQ ID NO: 32687 - DNA, 186 bp, Glycine max
  Peptide Sequence Number=SeqID_124372
atgcatcctagatacagaaggggcatgcacttagtgagtggttgctggcttagcgctattcagtccgcaaggaaattgggcttagcgcagcgaaagatgagctcgcttagcgcattagtgacttccggcttagcaccagtcacactcgctcagcctggaggtgaagacggtgcgcttatcgagtga

SEQ ID NO: 32688 - DNA, 846 bp, Glycine max
  Peptide Sequence Number=SeqID_124373
atggcggaaccatcaaagaagcgaaaaggtacttcaagtcggagtcaacggcattccgagactcaggaaacaccgattccttcctctattccctctgcctcattgttttcatccaaagaacagcggatatggtacacaaatctcttttcttctcgttctattgttgatccaaaactcattgatatggatttcttttcaaatgagagttttgaatgcattcaggcatttgaaaactccaatcttattcctttcatgtctttaaaattgcatgtttactctgagttagtcaaagtcttctattcaaaccttgaaatccaagaaggcactttaatttctgaagtgtatgggattaaaatggttattgatcaatccctattctatgagttagcccaattatccagtgaaggtgtaccatttgaaggtacactgattgatgattggaaatatgaattttctgtgcatgatgcccgccggttggtttgcaccaaccaagcgaatatgaccggaaagcttcttgccggttcattggcttttgaaagccgcatccttcattaccttattgttcgcatcttgcttccaagatcttcaaaccttgcacaggtgaaaaagggtgctcgacctgttgatgaagaaggacatggtggagaagattcctctcttcttcaaaagattttggataggttcgatggtcttcaaacctttgttggtgaaaggtttgatactttggagttacaagtggacatgcgcttcaatgagatggagtcaagaatcaccaaggtcgaagaagatgtttcttatattcgtacaagttttgatctaccaccaccaccgccaccatcatcttag

SEQ ID NO: 32689 - DNA, 561 bp, Glycine max
  Peptide Sequence Number=SeqID_124374
atgacaatgatcaaggtcatgaaagctcgccaatccttgacagccatggaaattcaaccgtcgaaggaatgtgacagtaatggaaatgtgcatgaaaaggaagtgaatttgttcaagaagaggaggtggtctctatacagtgacaatgaggagaataatagtttttacggggcacacatgacaggggagcgatatcaatcaatgttgggaaagcatattcagaaatacaagaggaggtttaagggtaccttgagtagtctcgcccaaaatcaggctgctactccacttgtgaaaagcaacacgggactaaaagctcccaagtcagggaatgagcacatgggaggaggattacatgtggcaaagagtacatgggaatggatgaatgattccagttctcagaaacttggaaactaccatgatgtagatttcttgccacaatatggcactgataggattatgtatgaacatgcatcattggatattggggatggaatcatttacaagattcctccaatctatgataagttggctggagctttgaatctcccaagcttctcgtag

SEQ ID NO: 32690 - DNA, 609 bp, Glycine max
  Peptide Sequence Number=SeqID_124375
atgatagaaacgcagacaacaccaattcctcccttcatttcatcttccacattattttctttgaaagaacaacgtatccagtacacttcctttctctcctctcgttctatactagaccctaagtttcttgacttgaagttctttgatgatgaaatgtttgactgttttcaagcatttcagaactctgggttaatccaattcatgtctatgaaacttcttttctatcctgaattagttagagctttttattcaaatttagaaattcaggagggtactttagtttctgaggtatatgggattaaaatggttattgatgaatcccttttctttgagttaacccaattttctagtgacggtgtaccatttgagggcaccattgatgaggactggaagtttgatttctccagtcatgatgcccgcaggttggtttgcaccaatcaagcgaatatgaccggtagattacttgtcggatcattggcatttgaatgccgcatcatgcactatctgattgtgcgtatccttcttcctcggtcatctaaccttgctcaggtttttgaggaagacttggttgttatgtgggttttacttaccgatcgtcaaattgactga

SEQ ID NO: 32691 - DNA, 135 bp, Glycine max
  Peptide Sequence Number=SeqID_124376
atggttatcaaatcgggtacatttgacatcaattcgaggccgaattcttcccaacaaggaggttatgatagaggactatccaaggagaaagagtttggcttaggtgggctcaacatggatggacaaatcacttga

SEQ ID NO: 32692 - DNA, 111 bp, Glycine max
  Peptide Sequence Number=SeqID_124377
atgactgtttttcaaccttccttttctctgcgagcatttttcgctatggccgaagaatttgtgaaggattctgttcatcaaaacggcgtcgccgcaaagcttggtatctaa

SEQ ID NO: 32693 - DNA, 2367 bp, Glycine max
  Peptide Sequence Number=SeqID_124378
atgtctaggggtgaagggagaagggaaggggggagaggttgcagggagagagaccgagagggagggagagtggaccatcgtgaggagacgaagaggtatcagcctgcaaactggcgggacaaggcaaccatcaccacgttttacttcacaaggttccccgatcacataacggagaaggatctctgggctcagttcaagagatggggagatgtaagagaaatcttcatccccaaccataggaataaaggtggaagaagatatggctttgtaaggtacttcggggtctctgacgaaagagagttagaaaggaagcttgacaacatcatagtcgggggactcaagatgtatgtcaatgtcccaaagtatgggaggggaaagaagaaactacaagagcacactaacagacacggcaccaagcctgaagggcatcacaccaaaatgtgtcatcggaatccttccatgacttacgccaaggtggtgtccacacgcagcacagacgcgggcttgagaaggaccttccaacctccacaccacacaacgactgcaccccactcgcatattcaacttgacgtatcagagcagaggaggaggaagtatatggacacatgggtaggccggttaaaaaacttgggggcgttcgagagagttgaagaagaaataccctgggagttaggagttaacgtcatgccgaaatacatcggtgacgacatggtcctcctccttgggttactggattccgaagctgaagagatcatatccgacgaacatcaacatggaacatccccgttctactcgctccaaaaatggaatccgcagatgaggccatgcaatagactcgtttgggtccaatgctggggcgttcctctcgaggcctgggacgagacgcacacggtgttcatcgttgaagaagggctgagtgatgtcggaacgcgggcccaccgccgttttggtgtcgtagagtcgacgaaggagatcgagtcccaagacaccaacaatgacgtacccagcgcggcggtggagccggtcgacgactttcgtcacccgttgcaaggcttcgacggtgaccgggatacccacctcacagaccactggtccaagatgttacaccatggtccaagtcccatggatgatccagcgaacaattctaaatccagctggcgttacctacctagcagcgaggtcagcgcgaggacagaagaaaggatagcagagccacaggaccctatgaaccactccgaggttgacccagtggaacatgacgggggagatagggtgcgtgaatcaccgaacaggaatggaaaggggatcagaccaaagccgacattaagcaaggggggaacagattgcatgtataaggaaagtctcattgatcataggactgatgaccccgacagtccctttgaggcagctatgatccaaattgggcctagtaaaagtcacattttcaaaaatggcccaagtacggaggtgggtttttctaaacacaccataacctcatccccacatacccccatgaacagcccaataaaactcgtaaccccttctactcctctggcaccacctaaaatatcaaacgtgacccaacccattgaggcaggacaacatattgaactgggctccactatccacactgcaccctttaaacccatacacccttttgacagcccaaaacaccaaacagcagcgaaagagagggagtggaaagtctatgtcaagtccaaggggtgcaaacagaagcaagcccaagaaactaaaaaacacaattttctggaggatcctaatccccctccccaccatcagtccacattgggagctagcacaccgccatctgaaatgagatgtcaactctcggccactcattcatcaaatcagagcatgagaaataatccaggaccatcttcaacagtagagggacccaatgaggagcttatcaaggaggcttcctcccagtgggaacttgcaaagctcatgggggtacacactgatgcagaccaggcaacaattatcaataaatttacagctatggaggaaacaaagaaggaacagcttgataagaccttgtgccaggcattgtggggagacttgacagtgggttgggaattccagccagccataaacacagcaggtggactgctatgtctgtggaatgagcaatccttcaaagttgatcatagagtatgtggcaggggattcatagtactggatgggagggactatggtgcctcatgggagactttaacagtattagacaccactctgagagaggtggctcacaggggtttggaagcaaacaatataagcgaatttaatgagtggcttgcagatcttgaggtagaagaaatacctagtgtgggaaatactctttag

SEQ ID NO: 32694 - DNA, 1044 bp, Glycine max
  Peptide Sequence Number=SeqID_124379
atggcttcctatgatggtagcttcttcttggctcatcttcttcttgaagtggactccattgatgaagaagatccaaggcctacaagctccacatggagctacatcaaaattgattcatcctatgatgatttccttctaccttttctgtgtccaaactatcccctcggtattcacatcatacccaccactaccatcaagttcatgctcgatcacattgctccaaggtttccaccattggacctcatgaaaaagaaaggcaaggttcctcctcatagcaaacccatgccttatccaggcccaatggacaatgttgccttgcgtctaattccctatcattggagtaggtactttacaagggatgttgctaagaagatttttgcttttaagccagacgttgagtttgatcaaaatgatgtcatgctcttctattttaaagacatgtatgaaaactctcgtcttgtgtacacttcaaaatataacaaggaagacacctccaatcatatccatatggagataatgagttctatcaatgtctcatccatgatattcctcctcttcgctctcgatttgtctttgacttgcacaagtgctcaaaagttggttgaagccaaacaacaacaggagaagcttaaatttgaaaagttgttcaacaaccttcatgctcatcttggacctcaagttgatgttgttgaacctccgctggttgaagtcacttcacaacctccacagatcattaaagatacactcgcaatgttaacacttccaatacacctaaccaatctgctgattaagaacaccttaaagtcctcactcaagtccttcaatgattatgttctttttaatatgaatatgattatgcaacaaaggttgcctccatccatccaaccacctccaccaccaccaaccactattatgcaatctcagcctgcggttcctgcatctaaggctaccataactgcagatcttgtgtctgcaccaccgccttcaccaccaaagtcacaaccaactatccctctatctctatccactgaaggttcactgtga

SEQ ID NO: 32695 - DNA, 537 bp, Glycine max
  Peptide Sequence Number=SeqID_124380
atggggcaaagcattgaaggtgaatcaaatgaagtattcttcaagtatgaaaagcttggtccatttttcttttactgtggcaagttggggcatgttgatgagttgtgtgagatgttgttctccaaaggtgtggatgatggaaactatcattggggacctaatctcaagggattgcaagcatggatgatcactaataatatgttaccagctagagacaaggtcattaatgaggcaggaattttcaaaaatcctaagattatctctcctcaatcaaatcaagaatcattacacattaagactccaaataatgatgaaatgaatgttgaggagtctgttgttaatgatttggtggaagacaaacctatttggaggatcattggcttctatggccaccctgatcgtgagaatagggaggattcttggaacttgttgcgttttctggctgaagacacatccctcccttggtttaccattggtgatttcaatgacttgctaaataatgatgagaagattggccttgttgatttagactattga

SEQ ID NO: 32696 - DNA, 465 bp, Glycine max
  Peptide Sequence Number=SeqID_124381
atgggttctccacctgcctccactactgctcctcctccttctcctccttctcctcctcctacttcggacgcatcggcttcgacgtctgccgtgaagcggacacgcaaagcctcacgcctacgatcgttgtccactagaccacctggtgttgagagaccagtggtgcatgttgatcttgctacagggaaggccgacggtccccacaagaagaaattaagaacatatttggggattgtgacatgtgataaggtggacatcacctacgagaactggaaggaggtccctactgctcagaaggacctgatttgggaggatattcaggcggaatttgatatcctagaggcttctgatagtaggacgaaaaggaagttactacagaccgtgggggagagatggaggcagtttaaatcagacctcacgaggaaatgggcccttgcagctgatcaggacggtgtcgaggacact

SEQ ID NO: 32697 - DNA, 270 bp, Glycine max
  Peptide Sequence Number=SeqID_124382
atgaagacaaaggaaacaataaagggtcctgtgagactgagaaaggaagaacgatttcaaatggtagtaaccgcgagagtcacagtgaggttgcagcgcgccgcgaatgagggcgacagtgatgttgtagcgccacaagaggtccaaatgtcgtcggtgactgagttacaatgccgcgagaggttgcaaatcagagtgccaaagcgtttgagtgagagtaatcagaatgagagtaaaagtgatgagagtgagaggtttagaagttactga

SEQ ID NO: 32698 - DNA, 330 bp, Glycine max
  Peptide Sequence Number=SeqID_124383
atgacagatccctatgcacatttggcaatgttcattgaaatatgcaacactgttaaggttgtcgatgtgctagatgaagctataagactcagcctattctcattctcattggcaagagaggccaagaggtggtttcactcgtttaagggcaactctctgaaaacccgggaagaagttgttgaaaagtttattgagaagaactcccacctgatgcaatcctaccctacaagggcattggatagaagactccatgtagattgggccagagatgcaagagaaggccctaggattctcatgagccttagggtagattttgggcccatggactaa

SEQ ID NO: 32699 - DNA, 165 bp, Glycine max
  Peptide Sequence Number=SeqID_124384
atggcttcctatggtgaagcaaaggactctattgatgaagaatatctaaggcctacaagctctacatggagctacatcatatttggtaaagtgaagggagatacctacaaaagacacttcaacgctcaaatgaggatttggttcaaaactattaagggtatatag

SEQ ID NO: 32700 - DNA, 453 bp, Glycine max
  Peptide Sequence Number=SeqID_124385
atgacttcaatgttatcatttgaagatattgacgataggtggatgcattactctgactatcttacagtagtggggctgatttgtgttgtgccaggacaatgtgcatcagattacatgcaatggttcttcatgatttctcatccgtttatgacaccagcacagcctgttgatccggccagacatccacctgtgacgcaggatgacacatatgtggagccacatatccctgaggtcccagtggcaccatcagcaacaccggcacatgccccttctgatgtggagcagcctagacatgcagtggaggctttccaaacaatcatagaaaggttggagcgtttgctcaacctaaggatagtcattgcatgcacaaaaatacatgaggtcatggaagactacttaaggatcgctaggggtgtcacaccagatgacaatgtttatgtcaggtcgcaatga

SEQ ID NO: 32701 - DNA, 234 bp, Glycine max
  Peptide Sequence Number=SeqID_124386
atgacagtcttgtgcaaatccaaaagaaggcatcaaagagcaataattgttatttttgttaaaaatctggacatttccagaaggattgcccaaagcgtaagtgttggtttaaaaagaaagggattccttacaatccagaccataagcccaaatgagaagttcatcttcatagggaatagagtgaaagctccagtggaagcggtcgggacttatcgtttaaaacttcgacactag

SEQ ID NO: 32702 - DNA, 1239 bp, Glycine max
  Peptide Sequence Number=SeqID_124387
gccgacgaggatatttttcttggttactcattgcatagtaaagcatatagagtattcaatagcagaactctaagtgttgaagaatatgttcatgtagtatgtgatgaaactaagtctattgttcaagataattctttagaagaagaagatgtaggttttcaggaaaaggattcttcccttgaaaatgacatcaagtctgaagaacttgaacaaagcaaagagatctcaacagcaatgcctaaagaatctccaagaggatggagaactcagaaagacctctccttggataacataattggagaaatctcaaaggttgtctctactcattctagactccgggttttgtgtaacaacatggattttgtttctcaggcaaccctaaccccttcacaagtcacaccaacacctctaatcacctatttcttaacccaaccttcttctacctccaaatccactttttctcttctgaaaatagctagcaacctctccagagtacagaagaaagccaagtcctttaagaggaagcaaggagagtactctcaggctactctcaataggcttgatacatggctcatggatgagagtaagaagaactacatcaagatgatatatgcagcaaagaatgtgatgcaatcctatcccgcaagggcattggatagaagactccaagaagattgggccaaagatgcaagagaaggccttagggttctcatgagccttaggactcatcttctccttgaagtggcatctcctctctctattccttctccattccgttgccattcatcttccaagaagcaaaggaattcattgatgaagaagatcctaggcctacaaactccaatggagcttacatcagaatgtgagaatacccaagtatctggacttggagtggttctctcacaagatgcaaatttacagaggtatgctgaagacagaatgctcgtgtaccgcatagcctacattctcacaccgaggtccagcaacaacgcacaggaatggatcatggctggagagccaccagcaacaacaaacatgaaccatatggaagaagaagcagaagctaaagctcagcaagagcctgcgcaccaatcgagtccttttaagtctcttataattcagaagatggatgtcatgcttcacctccatcaagaacactcagctaatgttcataataccttagaaaatatcacaactcatctggagaacatagaaactaggctaacccttagtaactga

SEQ ID NO: 32703 - DNA, 447 bp, Glycine max
  Peptide Sequence Number=SeqID_124388
atggcctccaggaagaggaaagccacaacatctcggccccaggagccttttgacaccaccagattcatctctgaggcttcctgggagaggtattccctgaacgttcactcccggaacatccttccggagaggaacgttattctttacatcgtagagtacaacgagttccactgggagctcgagaggcggtgttggcataaagccttgaccaggaagcctgatggtgacatagatgtggtgctggtcaaggagttttatgccaacttgtatgatccggaagacaagtcccccaagcaggtccaagtgcaggggaaattgattaagtttgatgccgcctcccttaatgccttcctagagacgccaccagtcattcagccaggggagcaatacacttcttattctcttttctgcaggacacgaacaaatcctcaggagcttgcattgtaa

SEQ ID NO: 32704 - DNA, 225 bp, Glycine max
  Peptide Sequence Number=SeqID_124389
atgaatccattgatgaagaagatcctaggcctacaagctccacatggagctacatcatgtggcaattttctccttaggatagtgagtgttttgttgggaactgatgcaatcctccctaggaagggaccagtcactagagccatgagcaagaggctccaagaggattgggctagagctgctgaagaaggccctaaggttctcataaacctcagggtagatttctga

SEQ ID NO: 32705 - DNA, 282 bp, Glycine max
  Peptide Sequence Number=SeqID_124390
atgaagggtgaggcaggatatcgccagtcgagaacgactttgaatggcaatctgtcgcaacatgccccttcgcgggcgagcgagggtgaggctcacgggtgcgctttccaaaggaggaaagatgcgcggagtcgccaccaacgtttatttgtggaaaacgtcggaaaaaccgaaggaaatcggtcaaaaatgaaaattctaagttcgggagttatatttacgcttgaggaaggtattagcacctctcacgtttgtctcaaaggacaacagcctattttttag

SEQ ID NO: 32706 - DNA, 216 bp, Glycine max
  Peptide Sequence Number=SeqID_124391
atggaattggcattttgtgtctttaaatctgatgttgttgtagagggtggatgtttctacatcgatcgtaaaaggaccgtcttagaaacgcgtcacaaacgaagtcatgcctacaacaacactgatgtagaaagcactgctttcttcattgttgttggcttaagcgcaaccttgtttgtcatgtgttctacgacggtcattttacgaccgatgtag

SEQ ID NO: 32707 - DNA, 2031 bp, Glycine max
  Peptide Sequence Number=SeqID_124392
atggcttcacaggagactcactcttggacgttgggaggacttattggtgcctttattgaccttgttttagcttatttcttgttgtgtggatcagcttttgctttctttgtgtccaaatggtttaggtttttaggattttgtttgccttgtccctgcaaggggacttttgggtttaggagtagccgtttctgtgtgcatagattgatgttccaatggccttcaaggaagatatgttccattcaagttatggcggttaagagattcccttttgatctggttcgggttaaggatcattcacgcagtgctaatgatagagtggctgctgagagaacacatgataatagggttgttgagttggaagatgaggcatcttgcagttcatgttcagcaccgcgtttgcttccctttgttgatagggaaaacgtgtatgatgctaaggggaagagagtcatgagtatgaaacgaaggtctggagttcggcgccggaggagggctagttatgattgtacgaaagtctcttcagctgttccttctgaaaatctgcaatctgatgttgtcctcactccttgttcgccttgtgatggcagtataattagagataaaaccagtgcaggcataagtcctacctcggggaaaggagttagtgtagatgatgccgaagttgatcaagctgaccatgatttggatgaaaagacctgtcatagttatgaatttagtggatcaatggttgatagtccaggacaggacaaatatttattgtcattggaacactacataaataatgtgtgtgaccatgtccaaattgttggtaatggagaggatcgtatcaagatgttagaaaatgcacttgaagaagagaaagctgcctatgctgcactttaccttgagctagagaaggagagagctgcagctgctactgctgctgatgaaaccatggctatgatatcacgcctgcaggaggagaaggcgtcaatggaattggaaatgaggcaatacctgaggatgatagaagaaagagttgcttatgatgaagaagagatggatattctgcaagagatccttataagaagggaaagggagaaccactttttggaaaaggaacttgcaacttacaggcagatggattcaaaaggtagtgaccaatcatatggcaaggcaaaggtgcaacatgatcaatggggacaaaagcctccaatttcagttggaacatatgaaaatcgaagcaccatatcatttgttaagaaagatgaaataaaagatatttcttctaattatatggttgctcagacttgcatcaatatgaaagacggacaagagctggagaaaaacacagaatgtaaggatcaagtgcataacaacctgcatagctccttttatgatactgatctggatgtttttgatgtccatgtcattaatgacaacataaaactaaaggaagaggaaaatgaaaagttaagtagctcttcattgagtactgttacaaatgaactcacaaatagatatcttgaatttggaagtcaaacagtacagagcagtgatgtattaagcaatcgtcgaaggacagataagccagaaaatggtaatagtgttgatggccccacgagtcagttatccatgttctcaaacacaagacgcaaaactttgtctttagattctggaagggattcttccagtgcagttgaaaatgagaagttaaagattggcaatgagattgaaattctcggagaaaggttgaggatgctaaaacatgaaaaggaaaaattgtctttctttgcagagaacggagaaagtgaaaagggccagctgaagcttctggaggagatagcaaaccatctccaaaggattaaacagacaagaaaccctgtgcgtggggcttccttacccccttcctcatctaagttcggaatatggacagaacaaggtagtgaattgtcacctgttgtggtagatcttatttggattgtagagctttatagtttaaagctcaaattctcatatttgatgatgaagggtttcatgattgtagagtaa

SEQ ID NO: 32708 - DNA, 273 bp, Glycine max
  Peptide Sequence Number=SeqID_124393
atgggtgtcgagggaaggagcccagagtatgaagaacctcgggatttgaggtcaaatcctttccaaggtggagggaatgatgcaatcctacctcgtaaagtaaccagctcacctgggcgagcaagattacttcaggttgaagcaacagctcacttgggcgagctccagatcaaccaagtccccgcatttcctataaataggcgtgaggggattgaaggaaagggtccaaggtctagccttcatatattgaaagaattgagagaaatgagatag

SEQ ID NO: 32709 - DNA, 173 bp, Glycine max
  Peptide Sequence Number=SeqID_124394
atggggtgcaaatggcaaccaagcccacttgggccttccaggatgttcctccagaaggcggttgcttctggaggaagcaacctggctcgcctgggcgagctgggtggcaagctcctcccctattttcctattaatagggggaggagtggaggagaaagggttcagcccttctg

SEQ ID NO: 32710 - DNA, 609 bp, Glycine max
  Peptide Sequence Number=SeqID_124395
atgaaggagaggcaagctagaggagttggaggacctcagaggaaccatccttttagaggaaatggtaacaagaggatgaagccgtatgctagcaacaaggggaagcaacctatggctgcctccaacatgagccagtcaagggggactggggtacaatgctttcagtgtggaggaccgcatcttaagaggaattgcccacagctccagcagacacaggagaaccgttgttatgtgtgtggcaaggtgggccattatgctcgagaatgtagggtgaccgggagaccgacggtaacagccaattccaacaccgtcaatcgtggacccactaattccacaaggagcggtaatgttagcaacaacaacactatggtggaagaccaaaagtatttctcctctcaggtggtaagtagtttccctacggaggtatgtgcgaggagtggtagggccatcagataccgtgtgtctcttgccgcatcacgacgacctgttggaacacctctacgggtgcaattgaagtgttccatatgtgtgagcggtcggatcttttatcggggattcatggatttctgtaagaaccttacccgctcaaagttcagatggagactatga

SEQ ID NO: 32711 - DNA, 297 bp, Glycine max
  Peptide Sequence Number=SeqID_124396
atggatcatttcaaggtccaacgccttaaaatgatacctcttaagctgccgtcccttgtgacggacgtgtggggtgctaataccttccccgcgcgtaaatacaactcccgagcctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacagttggcgactccactggggaatgttttttga

SEQ ID NO: 32712 - DNA, 297 bp, Glycine max
  Peptide Sequence Number=SeqID_124397
atgctaacgccgacatcggccaggaaagttaacagaccgcgaggtcggctagggtttttcgtgcgagctgaaccgagattgtgtttcggccgacactggcatgctctcatttactcggccgggaaaacattagcccacctcggtcagaaaaaactgattcacggtactgatcgaaaagaattccagccgacgtcggccaggaaagatgaccgatcgaggtttagaaaagaagcatcaccggatgacgccgatcgaacatttcctaatagacgtcatcaaatattattcagggattga

SEQ ID NO: 32713 - DNA, 282 bp, Glycine max
  Peptide Sequence Number=SeqID_124398
atggcacaacctccacctcgtgagaggaatcttagggagatggctacacctgatttcacttatgaaagcttgtgcattcaatatcctgatgagggtgttccatatgttctcaagactggactaatacatttgctgcccaagtttcatggtcttgcagatcaccatacagatctctgtccttctttgcagcaatttggagtcaatgagcaacctgaagcttatgctgcaaacatttataatagacctcctcagcagaaaaaccaacaacaacagaataattag

SEQ ID NO: 32714 - DNA, 379 bp, Glycine max
  Peptide Sequence Number=SeqID_124399
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggcgagaaagtcgatagcgcacaagatcttggttggcgatcaaagggagaggaccactgcaagtcgtgtcgggaaacctgtcgtgccagctgcattaatgaatcggccaacgcgcggggagaggcggtttgcgtattgggcgctcttccgcttcctcgctcactgactcgctgcgctcggtcgttcggctgcgcgagcggtatcagctcactcaaaggcg

SEQ ID NO: 32715 - DNA, 519 bp, Glycine max
  Peptide Sequence Number=SeqID_124400
atgaccggaaggcttcttgccggttcattggcttttgagagccgcatccttcattatctcattgttcgtatcttgcttccaagatcttcaaaccttgcacaggcattgcgattaaatgctccattgccatatccacacctagtcaccctctttcttcaacacttcaacatccctcttgattttgaaccttatgttccaatcaagagatcctttctaataggcgctgcagtgattgcatcctttggttaccgcatagagcataatggctcttgggtgaaaaagggtgctcaacccattgatgaagaaggacacttacatggtggagaagattcctctcttcttcaaaagattttggacaggtttgatggtcttcaaacctttgttggtgaaaggtttgatactttggagttacaagtggacatgcgattcaatgagatggaatcaaggatcaccatggtcgaagaagatgtctcttacattcgtacaagctttgatctaccaccaccaccgccaccataa

SEQ ID NO: 32716 - DNA, 300 bp, Glycine max
  Peptide Sequence Number=SeqID_124401
atgacgtgcgaccattctttggttctcgtgaggtgcttggcacccatcattaggcaatttgtgaaattccaggacatgccgaaaaaccaaaaaatattgatgcacaatccatcaccaaaaacagcagagggggtgtacttagtaaaatgggggtgcaatagcacccatgcccatttgggccctccagaagatcctccagaaggcggttgcttctgcaggaagcaacctgctcgcctgggcgagctgagctcgcctgggcgagctgggcggcaaccacctcccctattttgctataaatag

SEQ ID NO: 32717 - DNA, 414 bp, Glycine max
  Peptide Sequence Number=SeqID_124402
atggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataagcatgggaaaccccgttaa

SEQ ID NO: 32718 - DNA, 117 bp, Glycine max
  Peptide Sequence Number=SeqID_124403
atgtatcaagggcataatgatagcctaacatcaaagtattttaacgaccctagaccattggagcctgagagattaaaagcattgcgatccagtggacacagttttatctcgagttag

SEQ ID NO: 32719 - DNA, 639 bp, Glycine max
  Peptide Sequence Number=SeqID_124404
atggggacaaatcaaaacggcaaaaggttttatcaagtcaaggttaaaagtctagatgtcactagccttaaggaattgggacgattgatgggacctctccaaaggcaagccttttgcaaagtgtacggaaagattctaaatttgaccgcggcggaggtatttacggaggctgtcatatccctcgcccaatactatgaccagtcattgaggtgcttcatgtttggggacttccaaatggtaccgactattgaagagtttgaggagatactaggatgccctcttggagggagaaaaccgtatcttttctccgggtttctcccctccttgagcaagattgcagctgtggtcggggattcggcaagagagttggatcgcatgaagcaaactcacaacggcgtagtgggcctgccacggaaatacttggaaggcaaggcaagggatatggagagccaagagaagtggggcccatttgcggatatactagctttgttgattttaggggttgtcctctttccgaacatggacggtttggtggacttagccgccattgacgctttcctcgcgtatcaccatagcaaggagagtccagtggtggctatcttggcagatttgtttgatacctttgaccgggagatgtga

SEQ ID NO: 32720 - DNA, 360 bp, Glycine max
  Peptide Sequence Number=SeqID_124405
atgggggcatacgcaaaagatgaggaattgttgatacattccttccaagaaagtcttactggggtagctgttacctgtaaaaggatcgatgtgggtccgaaaagaggaaaatttagtcatcctgcttggacaaatgagaaaattggggcaaatgaagagggtgaggatgaagtagaagcccatgctgtgactgccattcctatatggccaagtttcccaccaacccgacaatgtcattactcagccagtaacaacccatctccttacccaccacacagttatccacaaaggccatccctaaatcacaccacaaaacccacctactacacgaccaatgctaaaacaccacttttagcatga

SEQ ID NO: 32721 - DNA, 459 bp, Glycine max
  Peptide Sequence Number=SeqID_124406
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatcacaaaatcgacgctcaagtcagag

SEQ ID NO: 32722 - DNA, 462 bp, Glycine max
  Peptide Sequence Number=SeqID_124407
atgagtgattcggcagatttggattcctatatacccactcgtgcggcacgcaatacatacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctaggtaagcgtcctgtagtaagaggagtagttatgaaccccgtagaccatccgcatgggggtggtgaagggagggccccaattggtagaaaaaaacccgcaactccttggggttttcctgcacttggaagaagaagtagaaaaaggaagaaatatagtgataatttgattcttcgtcgtcgtactaaatag

SEQ ID NO: 32723 - DNA, 796 bp, Glycine max
  Peptide Sequence Number=SeqID_124408
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcagggacgacgagtatactgattttcaggaggaaataggcgccggcggtgggcaccactggttactcctatggcaatggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccagggcaggattttgcccggactgctgcagggaggcgagtgcgaatcatgcgtaccaatatgaccaccctgacccagatatggatgacgttgctcctcagcaacatcctgcccaccgatcataattccgacctccccatgcctaagtgtcagctggtgtacgccatcctgacacggatgagcatccatgtggctcagttaatcgctgatgccatctatatttttgcaggtatggcgcccactaggcaccctttggacccagataagtccaacagggccctgggattccccgcactgatcacaggactctgccagtcgttcggagtccccgtcgcacctaccaaggtgattcggccgcctatcacccgggcttttattgagaagtactgtacccagagacagggtcagg

SEQ ID NO: 32724 - DNA, 732 bp, Glycine max
  Peptide Sequence Number=SeqID_124409
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgctgcaaaacccaggcgcgagcccgggcggagcggtcgtcgtgcagatcttggtggtagtagcaaatattcaaatgagaactttgaaggccgaagaggggaaagggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 32725 - DNA, 222 bp, Glycine max
  Peptide Sequence Number=SeqID_124410
atgacccgtaaagcgttccgtaaccttacgaaagaactaacaagtatcgttttttctcacaatgagaattcgtcaaagttttgtgaggaaaattctttccgtgaagaaaatccaagccgaggcacttccataatgtttccgtgggtgatttcgcgaagattttcaaccgttcttcgccgttcgtcgttcgttcttcgtcgttcttcggccttcaaccggtaa

SEQ ID NO: 32726 - DNA, 174 bp, Glycine max
  Peptide Sequence Number=SeqID_124411
atgaagagaagatttttagagaaattcttccctgcatccagaacaacatccatccggaaagaagtttgtggcataaggcagcaacctagagagacattatatgagtactggagagattcaacaagctgtgtgctagctgtcctcaccatcaaatcaccagtggaggtgctttaa

SEQ ID NO: 32727 - DNA, 210 bp, Glycine max
  Peptide Sequence Number=SeqID_124412
atgtctaaacctaaggtaaacattggatcattgcttaatccgggcagctcaacctttgctcaatctagggggctatacaacttcaaattgggtgaaaccaatgacattggtgaaccccaatttgatcctccaaggatccctacacatgttcatgttaaccccaattgcgatgaactcatcccttaccttgaagcaggctcacatgtgtag

SEQ ID NO: 32728 - DNA, 186 bp, Glycine max
  Peptide Sequence Number=SeqID_124413
atggaaaaagaatttgagatgtctatgatgggagagttgaaattcttccttggacttcaagtcaagagggtgacgcggggctcacaggttcgtcttccaagaaagaaaaatgcacggagtcgccaccaacgtttatttgaggaaaacgtcagaaaaactggaaaaggtgtggtctacgaaatttaa

SEQ ID NO: 32729 - DNA, 306 bp, Glycine max
  Peptide Sequence Number=SeqID_124414
atggtatggcagcactgcataatctcttactgtcatgccatccgtaagatgcttttctgtgactgcatttatcagggttattgtctcatgagcggatacatatttgaatgcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 32730 - DNA, 817 bp, Glycine max
  Peptide Sequence Number=SeqID_124415
atggagagaagtatgatagatgctgccagtggtggagcccttggagacatgactcctgctgaagccagaaatttaattgagaagatggcttctaactcccagcagtttagcgccagaaatgatgccatagtcattagaggagtgcgtgaggtagctacaaactcagctacatcatatgagactaagaagcttgaaggcaaactggatgcattggttaacttggtaacccagctggccttgaatcaggaatctgtacctgttgcaagggtttgtggtttgtgctcctctgctgaccaccatacagacctttgcccttgcatgcagcaacctggagcaatcgagcagcctgaagcctatgctgcaaatatttacaatagacctcctcaacctcagcagcaaatcaaccacagtagaacaacctgctccttccttcaaaatgttgctggcccaagcagaccatacattcctccaccaatccaacaacagcaacaaccccagaaacaaccaacagttgaggcccctccacaaccttccctcgaagaacttgtgaggcaaatgactatgcagaacatgcagtttcagcaagagaccagagcttccattcagagcttgacaaatcagatgggacaattagctacacaattgaatcaacaacagtcccagaattctgacaagctaccttctcaagctgtccaaaatcccaaaaatgtcagtgccatttcattgaggtcgggaaagcagtgtcaaggacctcaacccgtagcaccttcctcatctgcaaatgaacctgccaaacttcactctactccagaaaaag

SEQ ID NO: 32731 - DNA, 117 bp, Glycine max
  Peptide Sequence Number=SeqID_124416
atggacccctacaggatattgggctgccttgcagcgacgttttctgcttgtccagtgtcgggaagagacgacgatctgtcggtcgtgaccctatcctctatttgcatccgtccctaa

SEQ ID NO: 32732 - DNA, 342 bp, Glycine max
  Peptide Sequence Number=SeqID_124417
atgactcaagagctggtagcccgcggagacaccttacggttatccgcacctcgtcattcagtgaccccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcgacgggcccgatgacaagcagagaccaaatttggtcattctgcacccttgtatcatccaaaggcgacgggcccgatga

SEQ ID NO: 32733 - DNA, 628 bp, Glycine max
  Peptide Sequence Number=SeqID_124418
tgcaaccaatgtccatgttgtctacttggaggcccttcgtgacctcagtatgacagagaggtacgcctggggagtggctgctttgtgctggatttatgagcaatttccgtcaatcgcggactccactgctgatcaagagtacgacgaggattctccgcgtgcgtggagcgcctggactgactccggatttcggatgtctgttggatcccttatggggagcaccgggaggttcgggacttccatgtcagatcatgctattccgaccattcttgctcctcctgtcgattcatgggtctcgtatgatgatatacacgataggtggatgcactacgaggatcatatcgttccagcaggtgaggtgtgcgttgtgccaggccagtgttccagtgactacatggactggttcttccgcatctcccatcctttcatgacaccaggccatgcattagatcctctgcctcatggttatgccccgcagccccgagtcgtccctcaggccccgcagacggatatccctcacgtgccggagccaggagcatcgtcgacatctgcggaggagcctagacatgcagtggttggagcgtcatctgagtctaggggtggtcacgcctggctcattgacacataa

SEQ ID NO: 32734 - DNA, 168 bp, Glycine max
  Peptide Sequence Number=SeqID_124419
atggatgaaatggctccaaaaaagctttccgcgaagagatctaggagggacgccacggctgaagggactagtgttgcccccaagtttgatagtcaccgtttctggagtgccgtgcaccagcagcgcttcgaggccatcaaaggatggtcgttccaggggatcctctag

SEQ ID NO: 32735 - DNA, 615 bp, Glycine max
  Peptide Sequence Number=SeqID_124420
atgcactatatcatagttagaattttgcttccccgttcttctaatctagctcaagcctctgaggaggacttgattttgatgtgggatttcgttaccggtcgtcagatcgactgggctcacttggttaggtaccgaatgcataaggcattacgggccaatgcacctcttctgtatcctcaattggtcaccctttttctccgtcattttcaaattcctcttgatgatgaaccttttgttcaagtcaagcgatattttgccattggtgctggtgcagtaacttcatttggttaccgtaaggatcatgatggacagtggctaaagaaggacgtgcaccctccgcaagacgagcgtactccctctcctcctcctcaacgagatgattcctcagcccttatgaataaagttctttcggaatttcggggcctccgcacctatgttggtgaacactttgattccttggatggtcgctttggaggaatggatacccgcattacccagcttgaagaggacgaatttaattgtcatcatcaaaaagggggagattgtagaagcaaagactttgactttgatgttttgatgatgccatatgatcatgcgcttctcaagtttaattaa

SEQ ID NO: 32736 - DNA, 90 bp, Glycine max
  Peptide Sequence Number=SeqID_124421
atggcacgtattgctgacaagataaaaaccattgatggatctaaagaaactttgaaacttgttgtaaggataactgagctctgccgttaa

SEQ ID NO: 32737 - DNA, 87 bp, Glycine max
  Peptide Sequence Number=SeqID_124422
atgccgatgttggatcaatttcagccatttatacacgatttcactgacaacattgtggatgtcaaagttgacggttactgtggataa

SEQ ID NO: 32738 - DNA, 794 bp, Glycine max
  Peptide Sequence Number=SeqID_124423
gactacatgtcctcactttcagagggctacacgccctcgccatcagaggactgcatgtcctcaccttcgtagggctacacgccttcacctttagaggactacacgtcctcgccaacagagggctgcacgccctcaccttgagaggactacacgtcctcgccttgagaggactacacgtcctcaccatcagagggctgcacgccctcacctccagaggactacacgtcttcgccttgagagggctacccgccctcgccttggggctacacgccctcgccatcagaggactgcatgtcctcaccttcgtagggctacacgtcctcacctttagaggaccacacgtcctcaccttcagagggctacacgccctcgccatcagaggactgcatgtcctcaccttcgtagggctacacgccctcaccttgagagggctacacgccctcgccatcagaggactgcatgtcctcaccttcagagggctgcacgccctcaccttgagaggactacacgttctcgccatcagagggctgcacgccctcacctccagaggactacacatcctcgtcttgagagggctgcacgccctcacctttagagggctacgtgtcctcatttttagtgtgctccacatctacaccttaagagaatttaagggtcaactgtgcgagcacaaccagagaaggaggctatcacacagctactatgcatacccggggcaagatttcacccgtgccgctgcaaagagacgagtgcggatcatgcgcaccaacatgaccactcttacacagatatag

SEQ ID NO: 32739 - DNA, 206 bp, Glycine max
  Peptide Sequence Number=SeqID_124424
gagaaaagagggaggtggttgccacccagctcgcccaggcgagctcacctcacccaagcgagattgtgcaacaatgtttcttttcgacttccggaatgtcgtggaactttacggattacctaacggtgggtgttaagtacctcaaggcggtcaagcgaaggttggatgccaccaaacaatggtccctggacgaaattagggtatga

SEQ ID NO: 32740 - DNA, 487 bp, Glycine max
  Peptide Sequence Number=SeqID_124425
atggcctcctcaaatccattgtttcctgaaggaaattccatttacagaccacccattttcaatggagagggttaccattatttgaaaacccgcatgcagatattcattgaagccatagatctaaatatatgggaagcaatagaattaggaccacatatacccactatagtagatgaacacgagatggaacttcaacgcctcaatcagaatgaagaaaatgaaaaaaagaagagaagcatagcccttaaagcctcatcttcaatacaagaagaaaacgaagaagaagattcagatgatgaagaagatttttctttctttgttaagaaatttcagaaattcatcaagaaaagaagaattgacaggcgtcaaaattacaataatggaagaaaatcacaagatgattctcaagtccttaggtgctacaaatgtaatcaaattggtcacatcaaggccaactgtccgtcaaatgaagaatggtcggagaaaa

SEQ ID NO: 32741 - DNA, 327 bp, Glycine max
  Peptide Sequence Number=SeqID_124426
atgttccttcatgggaagatgcccaggaaatgggttttcagaccttaccttacttcaatataccaaacaccactaatacatattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttacgcacggggaagggtgttttcctttgctcctacgtattcctcaatttgtgatgaggaaatcagacctacgtaa

SEQ ID NO: 32742 - DNA, 934 bp, Glycine max
  Peptide Sequence Number=SeqID_124427
atggttaggactagaggcttaggtcgtgccttggcatcggcacgtaggcaacgggaagctgccgatgttgccgagaatgagcctgtggtagctgcagatgagcctgttgtagttgcagacgagcctgtggtagctgcagacgtacatgcacctggtgcagacattgctgatgatgctaagggatttccaggtgggctgcgtgacccattagtgcttacgaagtatgctgaccatgttgtcatcaacgtatggaacagagaggaccatcctaaattgaagttatcctcccatgggaggaaggtgcagaaatttggtaggcctgctcctgagattgagggcctagttgttgccacaggactaagtcctttgatcgcgtgttcaatagacattggcgatcgaggacttatattcgcgttcgtggagaggtgccacagggaaactagcagtttccatcttcctgtgggggaggttagcatcaccctagatgatgtggcgtctctgcttcatcttcccattgttggcgccttctataccttcaagcctctgcatgtcgatgaggctatgttgatgttggtggagttactagaggagcagcagctgacagcttgctggttacatcactctcttatagttgcggagtgtatggatgatccggactatgatgaggtgtcaccacgtgcatgtcggtggatttctatgaaggcgactatgaagtccatatctacagtgacgtataggcaacgtctggatggactcaggattcctgatgtttgctggatgccttatggggaccaccgacccgttcgagagtttgattcgatttcatgcttttccgaggttgtcgattcatgggtgtcatttgaagaaatagatgacagctggatgcactactcagaccatcttgcactagcaggtgacatatgtcttgtgccag

SEQ ID NO: 32743 - DNA, 524 bp, Glycine max
  Peptide Sequence Number=SeqID_124428
cccaagtggtctcaagagcaaaagctctgtcatgcaccctcacacactgttaccatccgcgtgtgtggatctcacgtgccgccgtaacgccgttgcgccaccatcgtcatctttgtcggttccttctgggttcactccagcacctgttgagttgtggttccttggtcaagaataccatgatcatttggagaaagatgtgaatgaaattcctgccgaaagtagagctcattggcaggaacttgactgccaactttgtgctgtcctatggcaatctgtagaccctgatctgcttgagatactgagctggcattcagattatgatcatgtatgtgatcaaattttgttcggtgatcatattccctcaatgaacaacttagtcactagacttctccatgtttctactttggtgaatggtgaaaatgcagctgctactgttgagatttcagccatggttgcctctcatggttggggtagagggggccattgtaatagaggaggaggacgtggtggtagaggtggtaatg

SEQ ID NO: 32744 - DNA, 198 bp, Glycine max
  Peptide Sequence Number=SeqID_124429
atggaagaagcagaaaaggagatcttggagatcttcaggaaagtagatgtgaacatacctctgctagatgccatcaagcagattccaagatatgccaagtttctaaaagagctgtgcacccacaaaaggaagctcaaaggcaatgaaaggattagcattgataggtttcatagaggacgtgctggttcgggttggtga

SEQ ID NO: 32745 - DNA, 258 bp, Glycine max
  Peptide Sequence Number=SeqID_124430
atcttgttgaagctcagccaggacctgaaagagatcagtaaaccaacgcttctccctctccagactcaagccatgatccagttccagacaacatgcctgaggactttactggctattgctgcatcaaagaagtggtccctataccagttagatgttcaaaatgccttcctacacggagaaaacattgcattagtaggatccaccccatgtgatccgtcattcagtgcaataagagggcccatagcaatgaatgtttaa

SEQ ID NO: 32746 - DNA, 133 bp, Glycine max
  Peptide Sequence Number=SeqID_124431
atgccgacatctccggaaagggcgcagatgaccacattggcctctgctcatcaatccacttgggaaagcggtgtggtcgacaaaagcgaggcttttgctcctgcgtatcctccaatgaggaactcagacctac

SEQ ID NO: 32747 - DNA, 420 bp, Glycine max
  Peptide Sequence Number=SeqID_124432
atgcgggggtccggggaatttgtccccttcttagatacgacgtctaggggtagcgaaatgccccaacgcacgtttttaagaaggcgacacggaccctccgttggtttgtttacagtagggatcaagacagaacccatatgcaatgcctatgcaaaagacacaatgcgggaatgtgcacagtatgaatatttaccgaacataagcaaaaggtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggtattag

SEQ ID NO: 32748 - DNA, 161 bp, Glycine max
  Peptide Sequence Number=SeqID_124433
atgggtgaagtagaggagatacaagagaagatgaaggccgacaaggaggccattaaagagaaaatggccacaatgatggaggccatgatgagcgtgaagaagataatggaagccaatgaggttgcagttgctgctaccagcgttgctgcaatcaattcatg

SEQ ID NO: 32749 - DNA, 480 bp, Glycine max
  Peptide Sequence Number=SeqID_124434
atgtgggcttttcatactggccgacaaattgattgggcacacttaatccgatatcgcatgcataaggcattgcaattaaatgctcctttatcatatccacatctagtcactcttttccttcaacactttaacatccctcttgattctgaaccttatgttccaatcaagagatccttcttgatcggtgctgttgtgattgcatcttttggttaccgcaaagagcgtgatgactcttgggtaaaaaagggtgctcaacccaatgaagatgaaggacacttaccagtaggagaggattcctctctccttcggagtatcttggacaggtttgatggacttcaaacctattttggtgaaaggtttgatgttttggaacaacaagtggacatgcgatttgacgagatggactcaaggatcaccaaggttgaaggaaatgtcacttacatccgcacaagctttgatctaccaccaccaccatcttag

SEQ ID NO: 32750 - DNA, 576 bp, Glycine max
  Peptide Sequence Number=SeqID_124435
atgaattttgcagcgagaaagcctgtagaattcaccccaattccggtgtcctatgctgacttgctcccatatctacttgataattcaatggtagccataaccccaaccaaggttcatcaacctccatttctccgagaatacgactcgaacacaacgtgtgattgtcatggagaagccctggggcattccattgagcattgtaggggcctgaagcgtaaggtgcaaggtctaattgatgcgggctggctgaaatttgaggagaatcgcgtgattttcaactttcatcggaattgggtgcaagccattggtctatttgctcaagcgacctgtgctcctgagtttggacttccaagaccattcaatcagagattactcgtcttgcacattggtggggctgctgtaagacaacaagaacaacccttcccttgtgttcaagaatcccctacaacaagagacccacgatctcttaatcccttttcagaaataggaagaagagaagaagagatctctcttaaaagagatagattgtacaatgaagatcaatcaaaattccttattgaatatgcaagtggttga

SEQ ID NO: 32751 - DNA, 486 bp, Glycine max
  Peptide Sequence Number=SeqID_124436
atgggacattttaatcataatagctggaggtgggacatgaggtggaggaggaatctctttgatcatgaaagccatttggctgtgcagtttatggaggaaatcagttttgttcctattcaaagacaggaggatgtatgtcatttgtttttcaactgtaagctgacaaatggcctgtggtgggaatctatgcactgggttcgggtagtaggtcccctttccattaccccggttcaccatttttatcagttctgtgatgggtttggggcaaatatgaaccacagtacaagatgtgggtggtgggttgcattaactagctctatatggcagcataggaatcatttgattttccaaggaaaaccttttgatccctgtaaagtcatggatcatgctattttcttagcttggtcatggttaaaggctaaggataaaaagtttagtactacctttcactactggtcctctaatatttccaatttccttgcctag

SEQ ID NO: 32752 - DNA, 841 bp, Glycine max
  Peptide Sequence Number=SeqID_124437
ggatatttggaaggcaaagcaagggatatggcgagccaagagaaatggggcccgtttgcggatattttagctttgctgatttttggggttgtcctctttccgaacgttgatggtttggtagacttagccgccattgacgctttcctcgcatatcaccatagcaaggaaagtccagtggtggctatcttggcagatttgtttgacacctttgaccggagcgcgatcaattggtttcctcgttggaaggaaggcaaggaaggagttcttttctcgtgtggggactaccctaatgttccattgatagggactagggggaaaggcaagactcgccaaggagaagttcaagtcagctgctacacacatccgaaagagtgcaccgagttacagaggaaaacgcggccactgcaaaagcccttgaacaagaaaccaaaagggcccgaaaggaggaatatggtcgagagaaattccgaggagcattgtggggtagtaacaatgagctcaagctctgaagagaggagagagatcggtcacgggagtttggttcaacacttggaagccacggagcaaagcatgctagctatcatagggcaatacaaggaagaattgaaccagtctgtggcccatgaacaaaagctagtggaggattttgcacgagtgtatgccaaaaaagaagcaagagggagggtgattgatgcgttgcatcaagaagcgactttgtggatggataggttcgccttgaccttgaatggaagtcaagacctcccgcgtctgttagccaaagcaaaagccatggccgaagtgtgtactgcccctgaggagattcatgggctaatcaattact

SEQ ID NO: 32753 - DNA, 234 bp, Glycine max
  Peptide Sequence Number=SeqID_124438
atggcggtgttggctgaaataaaactttggttgagctcgcacaaaaaaacctcgccgacctacattgaaaattttatgggcgacacccaacaacaacacatcctttaccttaaagaactattatcggccaacgtctctagaaaaaaacttgcgcaatgtcggatgaaaaatagcagtcggggctatttaaccaccgatgtcggctattgttttttctattcaatccctgaataa

SEQ ID NO: 32754 - DNA, 128 bp, Glycine max
  Peptide Sequence Number=SeqID_124439
atgggaacaaatcaaactggaaaaaggttttatcaagtcaagattaaaggcctagatatcaccagcattaaggagttggggcggttgatgggacctcttgatgcaatcctactccgtaagggcattgg

SEQ ID NO: 32755 - DNA, 474 bp, Glycine max
  Peptide Sequence Number=SeqID_124440
atgttgagtcaacatcccaatattttaaacaacattgactctgtgaagaagagagaatctgctctgtccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggagaagcagctgaggaagaagaagaagcagctgaggaagaagaagaagcagctgaggaagaagaagatgcagcagaggatacagaaattttgctgtcgccactacagataccgctgtgcttgattactctgataatgaaagttgctgatcccacttgcataactgctcgtacctgctcaggaagtgtctaa

SEQ ID NO: 32756 - DNA, 204 bp, Glycine max
  Peptide Sequence Number=SeqID_124441
atgttcatgacccctaggctatgcattttggctattttgggtaaaaaaacacgtttccgtgaagaaaaagcgagtcgaagtgctttcgtaacgctttcgagacatttccgtgagcaaatttgtgaagattttcctccgttcttcaccgttcttcatccgttcttcgttcgttcttcattcttcaaccgccgttatcttgcctaa

SEQ ID NO: 32757 - DNA, 368 bp, Glycine max
  Peptide Sequence Number=SeqID_124442
atgaggtggtggggagctgatcgcctagcggcctgtggagcatccactcctgagcctgtctctgggtacatccggtatttctccaagcctacgggtgagggcggccgactatctacctcaaatggtaggtgcaacgggaccgaacactggccagagtcccatgtgataccaatgcgggagaacccgggttgccccagttggacgttgcatctggtccaagtgccaggggcgtcaaccggtcggaattatgatcgggcaggatgtttgaggagcaacgtcattcccccatatctgggttcaggtggtgccgttggtgcgcatgattcgcactcgcctccctgcagcagtccgggcaaaatcctgccccg

SEQ ID NO: 32758 - DNA, 210 bp, Glycine max
  Peptide Sequence Number=SeqID_124443
atgaagaaggtggtcaaagatcaacaaacaatgaaagatatgagggatgaggaagaaaaactagaaaaccaaaagaaaaagaaggatagtaaggccttgtcttcaaaggccaagaggaaggaaaaagaggaaaaggattcctccaagaagattgttaagaagaaaaatcattttgcaacaaaatgcgatataaagagcactcatccttaa

SEQ ID NO: 32759 - DNA, 505 bp, Glycine max
  Peptide Sequence Number=SeqID_124444
gattagcggcaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcaggtggagcaactctggaattttcgtgcttggagagccttgataatttaggaaaaataggacttttcggtggagctggagtgggtaaaacggtcggaatactcgtgagggaaatcgatctttattatggaaatagcggacaagaatctggagtattaagaccaaacatgcctattgcacacaaagagctcgtagatataggtcaatttgagaatgacgtcttccggtgtagaagaccaatggttaacgatggctctgatgggcggttttgctag

SEQ ID NO: 32760 - DNA, 618 bp, Glycine max
  Peptide Sequence Number=SeqID_124445
atgcaaactagaaatgctttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtgggaacaggggaaggggtcagatttatcttgacgggagcaagagtaataataatgtgtataatgctacagcagcggtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaacaatga

SEQ ID NO: 32761 - DNA, 585 bp, Glycine max
  Peptide Sequence Number=SeqID_124446
gtctggagtgttctctcatactccaacctggctccgacttcccacacctcagatttgactgtggatagagctaggttaatctttggcttagttactcagctggacatgaatgttagagctctcatctctggacagatcacatcaatggcccaatctaactcctctagactcgggttccctgctcttatcacaactttatgtaggtccagaggagttgcttccgacagcttggtctttgaacgtttgagcccagtcattaatttggcctacataaggaaaaactgttggaacccggatgacccaacagttattattaggggggccagaagaccaagggcaaggccaattgaggcagcttctacattagtagctcctcatccagcttctacatcatcagctcctcctccagctcgtatgatagcagctccttctaccctacctcttgcagattttcaatggactcagcctcctcttcacagggaagacgaagatcccgccgctcaggaagctgcagctacctctgaaaagtctcttgaagccactctagagcctccgacaccattggcagataccacttctccgtag

SEQ ID NO: 32762 - DNA, 156 bp, Glycine max
  Peptide Sequence Number=SeqID_124447
atggagcatgaaacattccttgcaacttggttggcagagattgatttctctctcaatggcttggagagattctcaaatttgcaaccacagcctagctaccatgaaaaacctatgaaaaacctatggtatgtgggtggcacaagcttaatcccttga

SEQ ID NO: 32763 - DNA, 774 bp, Glycine max
  Peptide Sequence Number=SeqID_124448
atgcgtattataaccttgaacctcaacggcatacggtcagcctgtaacaaaggctttttgccatggctggctaatagcggcggcgatattgtctgcttgcaggagctcaaagcccaagtgggagacatgcagcccgagatgttgcagccacctggttaccatgggtactttcactatgctgagaagaaaggttacagcggcgtgggcatctacagcaaacagcctgcggataaggtcattatcggtttgggccatgcacacattgacgccgagggccgctatctggaatgccagtatggcaacctcagtgtggtgtctttatacctgcccagtggttccagtggcgaagagcggcagcaattcaagtttcaggtcatggatttatttttaccgcatcttgaacagttgattgcttctggacgtgaagtcgtgatttgcggtgactggaatattgcacaccaggaaattgatctcaagaactttaaaggtaaccgcaagaactcagggttcttgccagaagagcgttcctggatgacggatgtgctaggacgtgtgggttgggtggatacttatcgtggcttatatccagacaccacagatgaatgttatacctggtggagtaatcgcggccaggtatatgccaagtacgtcggctggcggattgattatcagctggcaacgccggcattgggcgcaaaagtggttgcggcgagtgtgtacaaggcggagcgttttagtgaccatgcaccgttgattgtggattatgcggattga

SEQ ID NO: 32764 - DNA, 534 bp, Glycine max
  Peptide Sequence Number=SeqID_124449
atgcctctcagccctatgatattggttactttggccgatagcgagctgatgtcgatggctccttccttccttttgcttggaggcgcgtaccttcacggcactgcgtggctgtttttgtatgaaaatggaataagtctaactaccgaggggtgttggggcgtttggggagctgcgtccctggtgaaatgtatcaccaaaggtttaggctttctaagaccttcctcatctgcggattgcatgcatatgtgctgctcttcacccccctcatcgccgacttccagccagccttggtctatcatttgttgcaacaggaatctttctcgtgcccaccgcggagaattatgccccccttttgtagggcctcgtagatacaccttctgggggtcgtcacgtccttcagaggttgcgttagggttataccactttgggaaaggaggctggtggatccttctgggagatatcacaaccatctggttggcgacgagggatggcaagaggtctacatacgtcattgggatcggggtgaattcttga

SEQ ID NO: 32765 - DNA, 306 bp, Glycine max
  Peptide Sequence Number=SeqID_124450
atgggacaattggctacacagttaaatcaacaacaattccaatattctgacagattaccttctcaatctgtccagaatcccaaaaatgtgagtgccattgcattgaggtcgggaaagcagtgtcaaggacctcaaacagcaacatcttcctcatccgcaaatgaacctgccaaacttcactctactccagaaaaagatgatgacaaaaatttaaagaaagtagcatatccctcttccgttccctccaagagaaatttccaacaaaaaaatggaagagacagagaaggagatattggaaacatttag

SEQ ID NO: 32766 - DNA, 885 bp, Glycine max
  Peptide Sequence Number=SeqID_124451
atgaggtcttgggtgaggggtcagtggatcccgtttgatgcggatgctatcggccagctcctgggatatcctttagtgttgcaagagggccaggagtgcgagtatggccagaggaggaaccggtccgatgggttcgatgaggaggccatcgcccagttgctatgtataccggggcaggattttgcccggactgctgccgggagacgggtgcggatcatgcgcaccaacatgaccaccctgactcagatatggatgactttgctgctcagcaacatcctgcccagcgaccataattccgacctccccctgccgaagtgtcagctggtgtacgccatcctgacgcggatgagcattcacgtggctcagttaatcgctgatgccatctatatatttgcaggtatggcgcctaccaggcaccctctggacccggataagtccaacagggccctgagatttcccgccttgatcacaggactctgccagtcgttcggcgtccccgtcgcacctagcaaggtgattcggccgcccatcacccgagcttttattgagaagtactgccagcagagacaggtccagggtgatgcacccacaggccgcggacgcgccgccacctcatcaggctgcaagcggccaacccaccgggcacatgtacagacccatgattgtctttatcagatgagtctcagcctgcagagccagggctttacttcttttccgtgccctactctggaccagttcagggcagaggtcgcatggcctggagattttcctgaggcccaggcaggagaggcaccagcagaggctcctgacgaggcaaatgaggcccgcgaggacgaagagatgaccgatttaattgatttcataggagggagcggggtcacatga

SEQ ID NO: 32767 - DNA, 259 bp, Glycine max
  Peptide Sequence Number=SeqID_124452
gtcgactctagaggatcccctcgccgcggaagcagctcgagcagtccaccgacagccgacgggttcgggactgggacccccgtgcccagccctcagagccaatccttttcccgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaa

SEQ ID NO: 32768 - DNA, 195 bp, Glycine max
  Peptide Sequence Number=SeqID_124453
atgtacaaggccggatattctctatgctgtaggagtatgataattggagtggagacttggatcaagatgaagagcgctactaggagctcaagatgtgtgggatatcgtatgggagaactggctttcgaggagcaagatgaagcctcgctaagccaaggtagtcacactatggagacgttgaagcgagtcaagtaa

SEQ ID NO: 32769 - DNA, 510 bp, Glycine max
  Peptide Sequence Number=SeqID_124454
atgaagttttcccctccaccctctgatgatgaagtgttgttggaagaaactgttttacaacccctggaagaggcttggggacatagccttattggctatatgattggccgcttcccaggaaagaaagctctgttggattgttgccaaaaatggggagtcaagttctcattctcagctcatgaaagtggttggctggtgtttaaatttgaggctgaggacgatctgaaccaagtcttctctgcaggcccttacttcatatttcaaagacccctactgctgaaggttatgccagcattctttgactttggcaatgaggagctcagcaagatccctatttgggttaaactcagaaatcttcctctgaagctttggaatcctcaagccttagggaaaatcctgtccaagattggttcgcccattcgatctgaccatcttactgcttctaagaggtctatttcttttgctagagctttagttgagattgatgcttctttggagttcatcgatgaa

SEQ ID NO: 32770 - DNA, 324 bp, Glycine max
  Peptide Sequence Number=SeqID_124455
atgcacacacaaagtttcacaattccacaatttcctaaaataggcctaactcacaaaaacagtccccagtggagtcgccaactgtcgcaaccaaccctttcgcgggcgagcgaggcgaggctcacgggtgcgtcttccaaaggaggaaaatgcgcggagtcgccaccaacgtttatttgtggaaaacgtcggaaaaaccgaaggaaaccggtcatgaagaatattccagattcgagagctgtatttacgtttgaggaaggtcgacaaaagcggggctcttgctcctacataccctccatcgaagaggaaatcagacctacgtag

SEQ ID NO: 32771 - DNA, 216 bp, Glycine max
  Peptide Sequence Number=SeqID_124456
atgagtctggggtttaaccaatatggatgctttttctcaccggaatcctccatagggtcaattctatgggttacgattctaccatatatgtttttttcattccgtcgaaaggacatcaattttacgggtatagacgcttatgacctccccctctatgaccctgcggtaatgattcctctggcattacggcctttaccacaacgatgctgtccatag

SEQ ID NO: 32772 - DNA, 153 bp, Glycine max
  Peptide Sequence Number=SeqID_124457
atggagagaggcataggtcccatactagacctcactcccaaagaagagaaaaggatggaaggtctcaagagtgaagaaagaaaagttccattggcaacccctagcttccaagggtatgccctctttgatggacttcccttgttagggaaataa

SEQ ID NO: 32773 - DNA, 199 bp, Glycine max
  Peptide Sequence Number=SeqID_124458
atgggagagttgaattgcgccatcgcccgatcgccacctggtaccacatatgacggagtggtacctggagatatgtcgcgagggtcaggagaccttggggatgtcaggtggggtgctattgcccaaaaccaaggtgatagggcactggtaattgattaccagttgggtgtaatcgattacacagtgttacctgctactg

SEQ ID NO: 32774 - DNA, 399 bp, Glycine max
  Peptide Sequence Number=SeqID_124459
atgcataaggcattgcgattaaatgctccatttccatatcctcacttagtcactctcttccttcaacactttaacatccctcttgattctaaaccttatgttccaatcaagagatccttcttaattggtgccactgtgattgcatcttttggttaccgtaaagagcatgatggctcttgggtgaaaaaaggtgcacaacccattgaagaagaaggacacttaccagttagagaagattcctctcttcttcaaaagattttggacaagtttgatgctttggagttacaagtggacatgcgattcaatgagatggattcaaggatcaccaaggtcgaaggagatgtctcttacatccgcacaagctttgatctaccaccaccaccgccaccatcatcttag

SEQ ID NO: 32775 - DNA, 309 bp, Glycine max
  Peptide Sequence Number=SeqID_124460
atggataatgaagagggcgtgcaggaacagatgaaggccgatctatcagccttaaaagatcaaatggcttccatctcggaggtcatgttaaaacttcagaaaaccatagaggataaagccaccacaaccgcctctagtatagttagggaagcggagccggtgctgcagcccaccttgaatccgggcctagacagaaacacggccgtgtttggtcgaaggtatagtctacaagcttatccttatggcctgcctccggacttcaccccccgtgccacccccggaagagttaagccaagccccttcttttga

SEQ ID NO: 32776 - DNA, 720 bp, Glycine max
  Peptide Sequence Number=SeqID_124461
atgcagatattcattgaagaaatagatctaaatatttgggaagcaatagaattaggaccacacatacccactatagtagatgtaagcacaagtactgcaacccaaaaacctagagataagtggacagaagaagataggagaaaaatccagtacgatctcaaagccaaaaacatcatcactttagccctaggaatagatgagtacttcagagtgtcaaattgtactaatgccaaggatatgtgggatactctccagttaactcatgaaggaaccacagatgtaaaaagggaatggcagcccaaggtaactgctatttctgaaagtaaagacctttcttccatgtctcttgccactttatttgaaaacgaaaaagaagattcagatgatgaagaagatttctctttctttgttaagaaatttcagaaattcatcaagaaaagaagaattgacaggcttcagaatttcaataatggaagaaaatcacaagatgattctcaagtccttaggtgttacaaatgcaaccaaattggtcacattaaggccaactgtccgtcaaatgaagaatggtcggagaaaagtgaaaagaaaagatttgatgaaagaagaactaagaaagcatacattgcatgggatgacaatgattcatccaatggttcagaaaaggagattaatcttctaaccaaagattatgaaagtgacgagaacatctctctaggatga

SEQ ID NO: 32777 - DNA, 216 bp, Glycine max
  Peptide Sequence Number=SeqID_124462
atggaaaaagaaaaacatgtctcctatagtagtcatgaattttgcaagagcctaagtgaagaacttagtgactattatagaggaaggcataggtcacatcctagacctcactcccaaagaagagaaaaggatagaaggcctcaagaggttaacattagcctcccatatttccatggaaaagataatgttgaggcctacttagattgggaaatgaag

SEQ ID NO: 32778 - DNA, 1111 bp, Glycine max
  Peptide Sequence Number=SeqID_124463
atggccccgaggaaacttgcctcgaaaagatccaggaaggataaggcggtcgaaggaactagttccgctcctgagtatgacagtcaccgctttaggagcgctgtacaccagcagcgcttcgaggccatcaagggatggtcatttctccgagagcgacgcgtccagctcagggatgatgagtatactgatttccaggaggagataggtcgccggcggtgggcatcgctggttacccccatggccaagttcgatccagaaatagtcctcgaattctatgccaacgcttggccaacagaggagggcgtgcgtgatatgaggtcctgggtgaggggtcagtggatcccgttcgatgcagatgctatcggccagctcctgggatatcctttagtgttggaagagggcctggagtgcgagtatggccagaggaggaaccggtccgatgggttcgatgaggaggccatcgcccagttgctgtgtataccggggcaagattttgcccggactgctgccgggaaacgggtgcagatcatgcgcaccaacatgaccaccctgactcagatatggatgactttgctgctcagcaacatcctgcccaccaatcataattccgacctccccctgccgaagtgtcagctggtgtacgccatcctgacgcggatgagcattcacgtggcccagttaatcgttgatgccatctatctctttgcaggtatggcgcctactaggcaccctctggacccggataagtccaacagggccctgggatttcccgccttgatcacgggactctgccagtcgttcggcgtccccgtcacacctagcaaggtgattcggccgcccatcacccgagcttttatcgagaagtactgcacgcagagacaggtccagggtgatgtaccacaggccacgaacccgccgccacctcatcaggctggcccagccggattgtttgatacagagcagtatttgcggcatttggttcgccagcaggcggccaaccaccgggcacatgtacagactcatgattgtctgtatcagatgagtctcagcctgcagagtcagggctttacttttttttccgtgccctactccggaccagttcagggcagag

SEQ ID NO: 32779 - DNA, 210 bp, Glycine max
  Peptide Sequence Number=SeqID_124464
atggcacgcaaaccgaggcaggattttggcatttcaaaaggtcagatttttctcttcatgtggctgagcatgagtcacatcaagagaaagcccacatttcagaagctctctctccctctccctcacgttgcttttcttcctccctcattctccattgaagctccacacaaagcttcaacctttggtgctcatttctgccccaaatcgtga

SEQ ID NO: 32780 - DNA, 288 bp, Glycine max
  Peptide Sequence Number=SeqID_124465
atgggaaagattgatctacttgaagagaggctgagagcggtagaaggcctcggcaactatccgttctcggatttagcggatctgtgtctggtacctgacatcatcattcccccaagtttaaagtcatcttcagatgtattgccaaaggatgggggcatattctatgaacgaaaagctgttaatgcatttctttcaagacagcttagccaaagtagcggtggcatggtacaccaatctggaagcttctcagatccagtcctggaaagacttggcaactgccttcattag

SEQ ID NO: 32781 - DNA, 560 bp, Glycine max
  Peptide Sequence Number=SeqID_124466
atggctacctcaccaaaagatacttcatctcctggttcaccctctgtaccatcatctccatcatccaccaaagcaccatcaaaccaggaacaacctgaattccatatccaacccatacaaatgattcctggtcaagcccctgttcctgagaaactggttcccaaaagacagcagggagtgaagatttctgaaaaccctagccttgcaacaagtcctagggaagtagacccggagatggataagaagatccgcagtattgtgagtaacattctgaaaaatgcttctgtgcctgatgctgatgaagatgttccaacatcttccaccccgaatgtttctgtccctgatgctgataaagatgttccaacatcttccaccccaaatgctgaagtcctctctttttccagcaaagagagatcaacagaggaagaggatcaagccacagagaagacccctgcaccacgggcaccagaacctgctccaggtgacctcattgaccttgaagaagtagaatctgatgaggaacccattgccaacaagctggcacctggcattgcagaaag

SEQ ID NO: 32782 - DNA, 447 bp, Glycine max
  Peptide Sequence Number=SeqID_124467
atggccgacaacaactccttcattcccaacccccatgagccatccaaaccccttgcttgcatcactttcaccaatgtcaccaaacttctccccaacaattatcctaattggaaacaacaagttgaagctctccttgatggctatgatctcctccaatatccagatggatcttttcctgcgccgtcagaaatgatcctcaccgctccaacatcttcgacgccgactccttcgaaaatgacccccaccactggcatcacttccggtaacaactcagaatcctgcttaccaaacctggcgtcgacaggaccgccttatatatggtgctctcctcaccactctctaatgaagtggcctccctggtgtctcaaaccaagacctcgcatgatctctggatccttctcaaaaacacctatgccaaagcatctcgcagccatttcaagcagttaa

SEQ ID NO: 32783 - DNA, 1056 bp, Glycine max
  Peptide Sequence Number=SeqID_124468
atggaggatgtctccaagcagttctcttggaaggtgggtaggggagaccaagctcttttttgggaacattcttgggttgacggatgggtacctctcaaagaccaatttccagaactttaccaaatttcttcccaaagattacacattgtggaagacatggggtacttctctgatcatgggcgggaatggaatttctcttggagacataatttgtttgacagtgagatggtggtagcttcaacttttttagacaatattgcagctatcacaattcatggcaatctgaaagacacctggctgtggggggctgaacctaatgggatctttaccaaatcagcctacgctgatgaagccttatttggagctataggccaacctgaggactggtgcgtctctgctgttgcctaccttaattgtgctctgctccagcttcctttttgctacttaggtattctaattggtgtcaatccgagaagaagggtggtctgggaaccgattataaggaagtttgaggctaaactgagcaaatggaatcagagaaacatctctatggctggactggggaggggggtgaaatgggcagcagtgaggagggtgataaagaaggaaaatgttgattttatttgtcttcaagaaacaaagaaagagagcattgataaaggcatgtgtcaggctatttgggggagtgctgatgtttcctgggaattgcaacctgctactaactcagcaggtggcattcgttgcatgtggaacaacaatgcatttaaattacagaacaaggttattggtgattttaacagcataagagcaccagcaaagagaattggcactagtgacaggggatcaggggtcagcaacattaaagaattcaatgactggattgatgatttggaggttctggagataccttgcctagcttaccttactgtcgcaacgtgccctattgcgggcgagcaagggcgaggctcatgggtgcgctttcgaaaggaggaaagatgcgcggagtcgccaccaacgtttatttgtgggaaacgtcgtaaaaaccgaaggaaaccg

SEQ ID NO: 32784 - DNA, 459 bp, Glycine max
  Peptide Sequence Number=SeqID_124469
aattttgcttcctcggtcttcaaattagcacaagcctcagaggaggatttgattcttatgtgggattttcttaccggttgtcagatcaactgggcccatttggttcggtaccgaatgcataaggcattacgggccaatgcacctctcccttatccacatttgattactctgtttctgcgtcattttcaaattccgcttgatgatgaaccatttgttcaactgaagaaggatgcactccctcctcaagatgaacatactccttcacctcctcctcagcgcgatgattcagcactcatgaatgaagtcctctccgaattacggggtcttcattcttatgttggtgaccgtttcaactcattagatacacgctttgccggcatggacattcgcctcacacagcttgaagaggatgtaggttacattcatcagagtttcgatcttccacctccaccttcttag

SEQ ID NO: 32785 - DNA, 369 bp, Glycine max
  Peptide Sequence Number=SeqID_124470
atggacattatagaagtgcccactttttaccaccaacaatgggcaccagaataccccgagtttgtcaactttagatatgatggaacaatataccaaatcaggctaaggcagcatcggaaaaaagtctactttgcagaagggctgaaagaattcagaaaagatttatcaatttacgaatctgtgatcattaaattcttggcatgcaacagcaaatccatgtttgatctttatttcgttccctcactggaatgccagacttgcgtaaggccagaagttatgtcaagacaacatatttggacacttgaaatcacacaatcaattcttggtgcaccaggaccactggtaacaatgaaaacctcttcaatgtag

SEQ ID NO: 32786 - DNA, 216 bp, Glycine max
  Peptide Sequence Number=SeqID_124471
atgtctgtcgcaacgtgcccttcacgggcgagcgagggcgaggctcacgggtgcgcttcccaaaggaggaaagatgcgcggagtcgccaccaacgtttattcgtggaaaacgtcggaaaaaccgaaggaaaccggtcgacaaaagcggggctcttgctcgtacgtaccctccatcaaagaggaaatcagacttacgtagttcttccttatgcgtga

SEQ ID NO: 32787 - DNA, 123 bp, Glycine max
  Peptide Sequence Number=SeqID_124472
atgcgtcctccacccaagagtttggagctttgcttcgtgattgacttaaaagaagaaggagtagagacgagagtcgtcatcacggaaagggcaggacggacgaaatcaatgtcttacaagtaa

SEQ ID NO: 32788 - DNA, 318 bp, Glycine max
  Peptide Sequence Number=SeqID_124473
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccggcatgaggaaagtgtgagccgtgagcttgctccccaattcaatcccggagctgttcgtcgtcggctatgggagtggggagagacagaggatgctctgttaattagtggtatcgtatcgtcatattaa

SEQ ID NO: 32789 - DNA, 399 bp, Glycine max
  Peptide Sequence Number=SeqID_124474
atggcttccatgatggatgccatgttaggaatgagacatcttatggagaataacgtggccaccgctgctgctgttagttcggctgcagaagcagacccaactctcccagctaccgcgcaccatcctctcccaaacgtgtcatgcgtgatgacgcgggtcatgtcccttcccccatccttgatggggaacctcctcgacagtcggacgaggttcacgaggatcgtagagagtatgcccaaggagacatcgatttctaccccccggtccccatcgaggggccggcacccaacatactgccttagcccaacctcccagcacaaccaatattcttgtccacagaaggaccacccccgacagcggaagaatgaaggaaactcgatctcatcgaagagagattga

SEQ ID NO: 32790 - DNA, 339 bp, Glycine max
  Peptide Sequence Number=SeqID_124475
gtagtgtctaatccttggaggtttacagtagggaactggttatgtgactcagatctggttagtcctactggaattgaacgggttctaaccgaaaaggaccttctggctgactcatattcagacctagaggcttctatccttgatgaaaaagaatttctcctattgaaggttatctctacctttccggagttatcttgcttaatatgctctatggttggagcgggtcgggaaatagacggttttaacaggactctagatgcacaagtattcatgaccttgtactggatcctatatattaaggctgctgggattgatccttctttcatgtcaaggccatga

SEQ ID NO: 32791 - DNA, 237 bp, Glycine max
  Peptide Sequence Number=SeqID_124476
atgggattttttccggtcacgttgagctgcttaaagccaattgtcacgcgatccataagatttcgtgatgtttcagaaggaaataaaccaaacactcaaaatgggggtgaactaatcaatttagggggtgttcttcagccctgggcccatctaggcccatcaagaagcttctacatgaagcaaccagctcgcctgggcaagcctgttacttcaggcttaagccaccagctcgcctag

SEQ ID NO: 32792 - DNA, 231 bp, Glycine max
  Peptide Sequence Number=SeqID_124477
atgttgctaactattgtagcacggaagggatggaaaatctgccaacttgatgtcaagccccaagagcttggtacaacaggattgatgatcattggcaacaatgttgaacttattcagcagttcaacgatgatatgatgcaagtctttgagatgacagacctaggagaaatgtcctatttccttggtatggaggttaagcatattgaaggtgatatgcaaaggagatcctga

SEQ ID NO: 32793 - DNA, 62 bp, Glycine max
  Peptide Sequence Number=SeqID_124478
atggctagtgtgatcaatttatcctgctaccatcatcatcatattcatcttcttagtcctag

SEQ ID NO: 32794 - DNA, 368 bp, Glycine max
  Peptide Sequence Number=SeqID_124479
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatggagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 32795 - DNA, 519 bp, Glycine max
  Peptide Sequence Number=SeqID_124480
atggaggccataaaagagcaaatggccacaatgatgaaggccatgatgagcatgaagaagataatggaagccaatgcggttatagttgccgctattagcgctgtcgctaaggtgaacccgacgtccccatccggcctcaagcaaatgaatcatccaacctcaaatatggtaggcaaagatttaggaagtatgggcggcccccatgatgtgcaaattcaaaatgagcatgccttcccgtcatatggcttgcctctcaactatacgccacccaatgtggcgtacactcccaataagaatacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaagccctcatgactatggcaggaatgggaaagttggatcatctagaggaaaggctcagggccattga

SEQ ID NO: 32796 - DNA, 408 bp, Glycine max
  Peptide Sequence Number=SeqID_124481
atgtttgggagtagaggaatgttacagcaaatgatagatcaaggtcgactggaagttagcagtgaaggaagagaggagcagcgtatatgcatgcagtccacggatgggagcggtgttgcgaggcccaaacccttggtgatatacttcaccaagggcacagcttcgcaaaagcccggacaccccttagcagctaaacctgttcctttcccataccaaaatagccacgcagtcccatggagatatacacctccgagggagaaggaagaagaagccaccaacgccagctcgttgtcggctaaggtaacaaatatcatgggactgagtggtgtgacccgtagcggtcgtcgtgcttcggcccggacctaccagtgtcctcccgcgactcaggggaaagaaaagtcgaggtag

SEQ ID NO: 32797 - DNA, 236 bp, Glycine max
  Peptide Sequence Number=SeqID_124482
atggagaagctgatttgaggacaaatacttttgaagagggagagagtgatgtggacatggcaaggactaagggcaaggaacctttagaaggacttggaggacctatgacaagggctagaataaagaaggctaaggaagctcttcaacaagtgttaaccatgccatttgaatttaggcccaagttacaagtggagaagcttcagattgttaattgtaccatgttccaaaaagagtag

SEQ ID NO: 32798 - DNA, 408 bp, Glycine max
  Peptide Sequence Number=SeqID_124483
atgtttactgatatactaacccatattcgtctccactacagcgaacactggcagatggtggtcatcctgcccaaggaacacctagttgtctggttttgttcattgcataacaggccagacaactaccttaaggggattattaatagtgctttaaaaggtcttgatgatgctccacagcctaaatcaaagactcctgctaggtggattgtcgccaagtgtaatagacaaaaaggaagtactgagtgcggctactatgtcatgcactggatgtccaccatcattttaggaagttttaggaataactgggaagcgtattttaacaatcctagactattggagccagagagattaaaggcgttgtggatccagtgggcacagtattatctccgagttagagatcagacttag

SEQ ID NO: 32799 - DNA, 294 bp, Glycine max
  Peptide Sequence Number=SeqID_124484
atgggtaagcttaactcatccaaacatggcaatgagaaagaagtccacccaaacctgaaatttcgaggtcccacacgtagagatgtgcttcacgactccgaaaatgccctcctttcgcgatttggagcagaaatgatgaccaaaggttggagctttgttggagcttcaatggtggaggaagaagaagagaatggcaacctatgccacatgtctccatttgagtggagcaaaaagggcccactttctcttttgattgtgacccatactcagccacaaaaagtgagaaaattctga

SEQ ID NO: 32800 - DNA, 540 bp, Glycine max
  Peptide Sequence Number=SeqID_124485
atggcttctagaaagagaaatagcattggtacaaggcccacatctcagtatgacacaaggagattttcttcattagatgcttggaccagatacactgacaatgttctgggaagaaacattttacctgaaaggaaagtagagttgtatcacactgagctagatgactttaaggccgagctggagaggcgtaatttccataaacacctcaccaatttagccgatgggagcatagacctggctttggtgaaagagttctatgctaatttatacagttctgaggaccgtccaccaaagcagtctagagttagaggtcatttggtgaagattgatgctgacagtctcaatgcattcctggagacagctgtggtgttagctgagggagagactcttcctgcatactctagatactgcaggttgcctacagatttcagcgagatagaggctactttatgcatacctggccgagggtgcatcttgaactctaagggccatcctgggaggattctcaggaaggatttgattacactagctcaagtgtga

SEQ ID NO: 32801 - DNA, 258 bp, Glycine max
  Peptide Sequence Number=SeqID_124486
atgtctcttgcaactctttttggaaagcttcaggaacacgaaatagaactcatgagactaaatcaacatgaagaaaatgacaagaaaagaaaggaaaaatctgagaggaaaaccttcaatgataagaaagcaaagaaagcttacatcacttgggaagataacgatatggattcatttggagactcaaaaaatgaagtcgtgaatctaagtctcatggccagaaattatgaaagcgaagaagagaaaaagaagttttga

SEQ ID NO: 32802 - DNA, 345 bp, Glycine max
  Peptide Sequence Number=SeqID_124487
atggccaaggtgttgattgacaatggcttgtcgcttaatatcatacccaagagtacattggacaaaccgcctttcaacgcatcacacttgaggccaagctccatagtggtgcgggcttttgacggaagccgccgggacctgccttttaggctgaccttggattcactcagtcggggtactcccttcaacgctccaccaaaggttgaaatttatggtggaagggtagttaatcatagtcttaggggaggaagacattcttgtaagttgtccttcttctatgcgatatgtggaagccgcagaggagtccttagagacatcctttcaagctttggaagtggtaagtag

SEQ ID NO: 32803 - DNA, 633 bp, Glycine max
  misc_feature (17)..(17): n is a, c, g, or t
  Peptide Sequence Number=SeqID_124488
atggaaagaaatgatgncggaggtgtaatcacaagtcctcaaagaacaatttttggagtgccttatgcacagtttgtaaaatttgatattgacgtaagaaagtactttaagtttaacggaaatcagactttagtacttcgtcagttcgtaggagtaggaataccctacggaaactcttcatcgatgccggttatcaggtcttatttcaacgggggatccaatgatatccgggcgtgggttgcttttggaggcttaggtcctgctgactctcagattgatgaaagagttcgtacttatatgacggataatttaaagcttactacaaatattgaatatcgtctccctttcaacgatatgtatgaaggggcgctatttaccgatattgggaatacctggagtctcagggattataatgatggatacggcgatgagtttaaattcaataaattcttaggccaggtgggtatcggtagtggattcggattaagggtgaatattgcatacatcactttaaggcttgattttgcatataaaatctatgatcctaataaacctaccggtgatcgatggagattcaaagatttccagccttttaaacctacattgaatgtagcgtttggatatcctttctaa

SEQ ID NO: 32804 - DNA, 266 bp, Glycine max
  Peptide Sequence Number=SeqID_124489
atgttccttcatgggaacatgcccaggaaatgggtttttagacctgaccttacttcaacataccaaacacctctaatacatattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgagcgtttaagtgaaaggttcgggagttgtatttacgcacggggaag

SEQ ID NO: 32805 - DNA, 111 bp, Glycine max
  Peptide Sequence Number=SeqID_124490
atgggcttaaaggagcactcaaacccgatgaccccgaaggcctacactccgaagagtccatcagagcctctccctcctgattccggtccaacccaaaaagaaaacatttga

SEQ ID NO: 32806 - DNA, 834 bp, Glycine max
  Peptide Sequence Number=SeqID_124491
atggctacctcaccaaaagaaatttcagcttctggttcaccggctgtaccatcatctccacaccaggaacaacctgaattcaacgtccaacccatccaagtaattcctggtcaagcttctgtccctgagaaactggttcccagaagaccacagggagtgaagattgctgaaaaccctggccctgcaacgagtcctagggaagtagacacggagatggacaagaaaatccgcggtattgtgagtagcattctgaaagatgcttctgtgcctgatgctgagaaagatgttccaacatcgtccaccccaagtgtttctgtgcctgatgctgagaaagatgttccaacatcctccgctccaaatgctgaagccttcccttcacccagtgaagaggaatcaacagaagaagaggatcaagcctcagaggagacccctgcaccaagggcaccagaacctgctccaggtgatctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgttatcccctccaagaaaaggaaagaaatttcctcatccgattctgatgaggatgtcgaactagatgtctcgacatctaagagggccaagaaatctggaagaaaggtgcctggaaatgttcctgatgcaccactggacaacatctctttccactcaattggaaatgttgaaaagtggaaatat

SEQ ID NO: 32807 - DNA, 237 bp, Glycine max
  Peptide Sequence Number=SeqID_124492
atgagggacggcaagaggtctttgtacatcattgggatcgggttgaattctggaattggcttcgggggaaagttcctcatcgcgttggaactgacaccaaagtgggcattgccagccgggcgagtcgtgtttggagccggagcttggggggcctccctctggattggggcaggcgctctaggctatacgggtgctgaattgaaggagttctcggctcgagctgaaaagctcggatga

SEQ ID NO: 32808 - DNA, 268 bp, Glycine max
  Peptide Sequence Number=SeqID_124493
gattcgaccatctaaggttgggatgattcctccatccgggattgtacctgttgctggagaggtcatagttattctgttgtggctaattttgctgctgagcataagcttcaggctgttcaattgcttcagattgttgcacagaagggcaaaggctagctgggttaccaggttaaccaaggcatctagtttaccttcaagcttcttagtctcggctgatgaagatgaattcgtggctacctcatggactcctctaagaacaatagcataa

SEQ ID NO: 32809 - DNA, 859 bp, Glycine max
  Peptide Sequence Number=SeqID_124494
atggcagagccatcgaagaagagaaagggatcatcctccaccgttgctgctgctgcccatcgccgccacggaccatctgaagcattcacagcacctactcatccatctttttcatctccaagatcatcaacattgttttcttccgatgatcagcgtctacggtacctttctcagttttcttctagaatcatcttagaccctaagtacctagacgtagaattctttaatgatgaaacgtttgattgctatcaagtgtttcaaaattttggcattgttgatttcatgtcattaaaattgtcatattatcctgaacttgtaaaggtcttctactgcaatttaaaaattcaggatggcattattatttctgaggtgcatagtattcctatggtcattgatcagtcacagttcttttctttaactaatttacccagtcaaggtgcaccttttgagggcaccattgttgatgactggaaatttgattattcgagtcatgatgctcgtcgtatggtctgcaatgatcaagctgaaatgaccgcacaagcctctgaggaggatttgattcttatgtgggcttttcttaccggtcgtcagatcgactgggcccatttggtacggtaccgaatgcataaggcattacgggccaatgcacctcttccttatccacatttgattactctgtatcagcgtcattttcaaattccgcttgatgatgaaccctttgttcaagtcaagcgttcctttgcaattggtgctggtgcagtgacctccttagggtatcgtaaagatcggaatggacaatggctgactatggatgcactccctcctcaagatgaacgtactccttcagctccccctcaag

SEQ ID NO: 32810 - DNA, 468 bp, Glycine max
  Peptide Sequence Number=SeqID_124495
atgtcccttgccactctatttggaaagttgcaggaacacgagatggaattattgagattacaccaacatgaagaaaatgacaagaaaaagaaaggaattgctcttaaagtatcatcatcaattcaagaagaaagtgatcaggataatgatccagatgatgatgatgatctaagtctttttgtaagaagattcaacaagtttcttaaaaaaaagatggaaaaatctgaaaagaaaaatcatagtgaaaagaaactgaagaaagcatacatcacatgggatgaaaatgatatggaatcttctgaagattctgaaaatgaagagataaatctctgccttatggctaaaagttacgaaagtgatgaagaggtatctttgagaaagaagtggtacatagatagcggatgctcaaaacatatgactggagatgcatcaaattttacacatatctctccaaagaaaagcgggcat

SEQ ID NO: 32811 - DNA, 231 bp, Glycine max
  Peptide Sequence Number=SeqID_124496
atggcagcggaatggagaaggaagagagagaggagatgccacttcaaggagaatatgagtctagaagaagctcaccaccataggaggccatggataagagcttggaggaacaaggagatgaatgaagggagaggaagagaagagcacgaaattttttgctctaaaagagctctgaaatctgaacccactaatccaagatcaagtccaagattctccactaagtgtgcttag

SEQ ID NO: 32812 - DNA, 252 bp, Glycine max
  Peptide Sequence Number=SeqID_124497
atgccactcgaacccagagctagctggttctccccgaaatgcgttgaggcgcagcagttgactagacatctagggctaaagcactgtttcggtgcgggccgcgagagcgggtcaaggtcggccagtgagacgatgggggataagcttcatcgtcgagagggaaacagcccggatcaccagctaaggcccctaaatgaccgctcagtgataaaggaggtacggggtgcagagacaaccaggaggtttgcctag

SEQ ID NO: 32813 - DNA, 351 bp, Glycine max
  Peptide Sequence Number=SeqID_124498
atggttaggactagaggattaggtcgtgtcttaggtcaagtcactggcagaggtgtgggcagaggagatcgtgatgattctgatgatgctccgcagggtcgacggcctactgcatccacacggaggcagctagtcgctgtgactgcggatcacgtcgatgagccagtcatccctgcgccagatgttcaggatgacccgatggaggcaccagctgctgtagaggacattcctgcggacacaggcgcagaggctgctgaggatgagcatgagggatttccgggtggtccgagcgacctatccgtgttgaccctgtatgcagatcacgttgcttgcagcgtatggacgggagag

SEQ ID NO: 32814 - DNA, 432 bp, Glycine max
  Peptide Sequence Number=SeqID_124499
atggcaagagatggtgacaatggtggtgtatatcatcaattggatgaatctcagcgcttatttttggacgcgtggactacacaaatgcaacgtttgttgaaccgtaacaaagaaaagccctacagacgaatagccaaatcttcctcatttactcttaaacctctatcccctagagaatgtgatgaccaaatcagaatgggagaaaagagagaacaagagaaagaaaatagtgaggcaccacaaaggaatatgaaaaagaagagtgatacacccgaggaaaagagtgatacacatgagagaaaatttaattattttgcagaggcgagtgaagtgacgaaagtgttacctgctcatgaaccactcaatctacagaatttaaaaatgtctttcctaaggagattcctcatggactaccaccttcaagaggcatag

SEQ ID NO: 32815 - DNA, 633 bp, Glycine max
  Peptide Sequence Number=SeqID_124500
atggccagggatagattggcagataatcaactagataatgtgaaattgagattgatagctggacgtgaaaaggatggtcgtacatacaatctcccaaatgtttctgaagttgctgccctgattgttggtgattttgatgcagactcaagaagggatattattgttgaaactcaaaatggagaattacaaagaatccatgaattacactctagctatctaggactgcaataccctttactcttcccttatggtgaagatggatatagacctgatatacttcaccgttgtgcacctagcagcagaaaaaggaaaagaaatcgtctaacgatgagacagtggtttgcttatagactacagtccagatcaaatgaagcacaaactttgttgcattctagaaaactatttcaacaattcattgttaaagcatacacgatggttgagtctgaaagacttagctacattaggaacaataaaaaaaacttagagttgacaaagtgcttgcaccttttgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 32816 - DNA, 95 bp, Glycine max
  Peptide Sequence Number=SeqID_124501
gcccgatttcacctccggaaacgcgccggaccccctgcaaaatcgaaacttaaacgggctggggagagagtatttgcgtaatgggcgacctcccg

SEQ ID NO: 32817 - DNA, 447 bp, Glycine max
  Peptide Sequence Number=SeqID_124502
atgtggctatccaagaaatgtgggtatgtcttcacttggaggctcctcaaggacaggctccccactaagggtaatctcttaagaagaaatgtggctatccaagaggctgtttgtcctctttgtggtcaagtgcaggaggaagaatccatgagatggattcaggctgtaggacctcttccagcttccccaacaagccattttgcccaattttgtgatgggtttggtgcagacataaatgatagcagctggtgtgggtggtgggttgctctaactagtgctatatggcagcataggaacctcctgatctttcaaggaaatccttttgattcctctaaagtcatggaagaggctatgtttctagtttggtcttggctaaaacctagagacaaaggcttcaacactagttttaaccactggtcttccaacatatcggactcctttggttaa

SEQ ID NO: 32818 - DNA, 408 bp, Glycine max
  Peptide Sequence Number=SeqID_124503
atgaacggattccctagaggccatttgtggagtaatttcgatattacccacaatgtttcctattttactccttgtcagaatgttgcggttttcgatcctcctactgatgatatgaggtgtcacatgaagcaacttcacttgacaactatggtagaaaaccaaatcattaacaagattttggtggatggagggactgtattcagcatcttaccaagatctatgctgcaaaggaaacaactaaaggttggtgagctggcagaagaagtgactcaatttatgtccagacgagaaaaatactttgtagaggttgaagctcaagaggaaagccctgtaaaagagcatgagtcaagagaaaaagatgaggaacaagcactgtggaagcaaagcttcatgatgaatcaacaatga

SEQ ID NO: 32819 - DNA, 465 bp, Glycine max
  Peptide Sequence Number=SeqID_124504
atggataacgaagagggagtgcaagaacagatgaaggccgacctagtcgactttaaagatcatatggcttctgtcacgaaagccatgctaaaaattcaaaaatcaatagaagacaatgctacggcggccgcttccaatacagctagggaagcggaaccggtgctacagcccgcaatgaacttgggccgggatagaagcgcgacgggtttcaatcggaggtatagtcctcaagcctacccttatggtttacctccagacttcactcctcgtaccgctctagacgatttgagccaagcccctaccttcgaggggcaactccctcctcatgccgactatcctttgcaggaagatgatgaaggagatgcccatttaggccctttacttcccccaaaagaaccggccccccatgagttgccccaaccaaacataatccaccatgccccgtctcaatccgcacccgttaag

SEQ ID NO: 32820 - DNA, 231 bp, Glycine max
  Peptide Sequence Number=SeqID_124505
atggcagcggaatggagaaggaagagagagaggagacgccacttcaaggagaagataagtctagaagaagctcaccaccataggaggccatggataagagcttggaggaagaaggagatgaatgaagggagggggagagaagagcacgaaattttgtgctcaaaaagagctctgaaatctgaacccactaatccaagatcaattacaagattctccactaagtgtgcttag

SEQ ID NO: 32821 - DNA, 534 bp, Glycine max
  Peptide Sequence Number=SeqID_124506
atggcatctaagaagaggaaaacaccctctatacctacccaagacaaatttgatagatccaggttcacttcccaagaggcttgggagagatacactgacgttgtggtacctagaaagcttttaccagaaaggaatgtggtaatctattatatagagtttgatgagttcaaggaggaactcgagagatgccattgggatgagaaactgattgatttttatgatagcagtatagtcatcgccattgcgaaggagttttatgcaaacctctatgaccccgatgataaatcacctaagcaggtgagggtgataggtcatttagtgaagtttggtgaggataccttgaacacatttttgaagacccctgtagtgctggaagagggggagaacttgtgtacatattccagattttcactcctgaggcctgatcctcaggagttggctactaagctttgtatcccagggaggggattcgagcttaatgctgatgggcagccttggaagattctgaggaagaacatgactactctagcttag

SEQ ID NO: 32822 - DNA, 446 bp, Glycine max
  Peptide Sequence Number=SeqID_124507
cggatgccgggagcagactagcccgtcagggcgcgtcagcgggtgttgacgggtgtcggggctggcttaactatgcggcatcagagcagattgtactgagagtgcaccatctgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctatatatatatattacataggaagcagctcaaagaattgcagtaagatcttttatagactgcagacaggagctgttgtattgtga

SEQ ID NO: 32823 - DNA, 270 bp, Glycine max
  Peptide Sequence Number=SeqID_124508
atggctagacaagccagaacaaccatgattctgctcgaggggaaaactactatgtggaagagactcacacttgatggagagattgttggagtacaaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 32824 - DNA, 168 bp, Glycine max
  Peptide Sequence Number=SeqID_124509
atgctggctactggtaatcgattactaccttctggtaatcgattaccagagagtaaaactctttggaattggaaaggaggattggtgtcatcccttgaagaatttgagtcaagaagcaaggggccaaccaccataagagctattggactaagaagcactccaaattga

SEQ ID NO: 32825 - DNA, 183 bp, Glycine max
  Peptide Sequence Number=SeqID_124510
atgggggtgcaaatagcacccaggtccacttgggccctccagaatattcctccagaaggcggttgcttctggaggaagcaacctgctcgcctgggcgagctgggcggcaaccacctcccctattttgctataaataggggaggaaaaaatctaagccgaggcgcttccgaaacgtttccgtaa

SEQ ID NO: 32826 - DNA, 225 bp, Glycine max
  Peptide Sequence Number=SeqID_124511
atgagtgcaataggaatcaggcccactgagcctccagatgtcctccagaaggcggttgctctggaggaagcaactggctcgcctaggcaagctgagctcgcctgggcgagctggattttcaaccgttctttgacgttcttcgttcgctcttcgtcgttcttcggtcttcaactgcatccgttaatttctgttaaaatgaaatccgaccgttcggtcatgccgtaa

SEQ ID NO: 32827 - DNA, 622 bp, Glycine max
  Peptide Sequence Number=SeqID_124512
tcgtgccttaggtcacgttactggcagaggtgtgggccgaggagatcgtgatgattccgatgatgcttcgcagcgtcgaaggcctaccgcattcgtacggaggcagcgagccactgtgattgcggcgcacgatgagccagtggtccctgcgccagatgttggggctgatgtattttcgaatgacccgatggtaccagctgatgtagaggacattgtggtagacattcctgcgaacacaggcgcggaggctgctgaggatgagcatgagggatttctgggtgacaccggtgatcggggacttttgtctttgtttgtggaccggtggcactgggagacgtctagtttccatctcccggtgggagagctcacgatcacgctggacgacgtctcctcgcttctgcatctgcccgtggttggcgacttgcacgccttccagcccttacacgtggacgatgcggttcagatgctggtgaacttattgatggtctctacagagtctgccagggctgacacaacccagtgtcgtggaccgtatgtacgtctgcaatgggtacatgatatatacaagcgccgatgccaggcaggtcattggacagtgttggatcaagtggcctcagaataa

SEQ ID NO: 32828 - DNA, 495 bp, Glycine max
  Peptide Sequence Number=SeqID_124513
gcttttacaaactcagactatgaggaaaggtcaccacgtgccttccgctggacatctacgaagacattactagcatcgacgtatgggaagcgtctagatcgactgacaactgctgatatctgctggatgccttacggtaaccactatgcacaatttggatatgttcaaaccattcctccacggtcttcgggttcaaggttatccttcgaagatattgacaataaatggatgcatttctctaagtaccttgcaccggtgggccagatttgtgttgtgcctagacaatgtgcatcggactacatctattggttctacatgatttcacatcaattcatgacattgacacagcttggggatccacccagacatccacctatcatgcaagatgagacatatgtggaaccggatatgcctgagttcccgatggcgacaacagctatagaggaagcagctgcacatgcaccttctgatgtggatcagccaagacatgtagtg

SEQ ID NO: 32829 - DNA, 468 bp, Glycine max
  Peptide Sequence Number=SeqID_124514
atgatgatcgactctctcgcgcacatcaacctgatccgcgagaccaaccccgacctgaagttctcgatctcggcgatccccgccgaggacggctacgacggcgaacgcggcattccctacgcctcctggggcatcggtgtcgccgagaactccgagcacaaggaggccgcgttcaagctggtctctttcctgatgagcgagcagacgaactccgagctctcgacgatggccaaggcgttcccggggaactcgaagtctgtccccgacttcgtgaacgacgacgaactgttcaagacggcgttcgacatctaccaggcgggataccccgcgaacgagttcacgggcttgcccgtcgcggaagacctcatgcgccagttcggagagcagttgcaggcagcgctcgacggtcagcagtcgatcacggatgcgctcaagaaggcgcaggcctcctgggaagcggagttctga

SEQ ID NO: 32830 - DNA, 213 bp, Glycine max
  Peptide Sequence Number=SeqID_124515
atgaagaaacaacaatggaggagaagccatggagttgcagcgaaagataaaggagaaaagcacatgggaagcttccttgagaagcaaggtgatgcaatcctccctaggaagagaccactcaccagagccatgagcaagaggctccaagaggattgggctagagatgctgaagaaggccctagggttctcatgaatctcagggtagatttctga

SEQ ID NO: 32831 - DNA, 262 bp, Glycine max
  Peptide Sequence Number=SeqID_124516
atggtcactctgcgtcttttgtcatccagaggtggcaggcccgatgacatgcgggaaccacttggtcccgcactttttcaccttttgtcattcagaggcggcgggcccgatgacatgcgggaaccatttggtcccgtactttttcagcttttgtcatccagaggcggcgggcccgatgacatgcgggaaccatttggtctcgcactttttcaacttttgtcatccagaggcggcgagcccgatgacatgcgagaaccatttg

SEQ ID NO: 32832 - DNA, 345 bp, Glycine max
  Peptide Sequence Number=SeqID_124517
gccgcagacgcgctgccacctcatcaggctggtccagccggattgtttgatacggagcagtatttgcagcatttggttcgccagcaggcggccaaccaccgggcacatgtacagacccatgattgtctttatcagatgagtctcagcctgcagagccagggcttcacttctttttcgtgccctactccggaccagttcagggcagaggtcgcatggcctggagattggcctgaggcccaggcagcaggggcaccagcagaggctcccgacgaggcagatgaggcctgcgaggacgaagagatgaccgatttacttgatttcttaggacggagcggggccacatga

SEQ ID NO: 32833 - DNA, 693 bp, Glycine max
  Peptide Sequence Number=SeqID_124518
atgaagggtttagatgctgtaggatattggtggcaaaggatcagggtggctgtagaggccaataaactgctgaagtataatcctaccattggtgtagaagttgtgattggagggacaagacttgctttagaacagaaacggatgcagccaaacccttgccaggtattgaggctggtgatcatatctgggcttcaagttgagggcttcaaatcatggttgttggacacgtggagtgcttgcactcacaagaagaaagtgatggcatcatcactcatggctttctggaatctatcttctaaaatagacaagttcgaggcatcaacactcatcagcactcacgtagttccttttcttctactaggagtggagtatggccacctaattgttggaaacttcatatctcagggcttcaaatcatggttgttggacacatggagtgcttgcactcacaagaagaaagtgatggcatcagcactcatggctttttggaatctatcttcaataaaaactcgaatgttcacaggactaatacttggtcaaaaaggtatcttgaatcctaaggagatttgttttcttgcaagatatagacaaaaggtgatttattccgtgaagctggtctacataatagagttgatggtctcatatagagttgatggtctcatcattgttcgacattttcacttgttttcctag

SEQ ID NO: 32834 - DNA, 246 bp, Glycine max
  Peptide Sequence Number=SeqID_124519
atggggtatctggagataatcattcaggttcagggttcaattattgacaaaatcattcagctcataaagggtgcaaatgatacaattataattcaagaagccattctcttatcttgggttatggagaattcgtccctaacagttaaccacttaatccaaccctatttcaatttactaagcgaaaaacaacttagggttgtcaatatcgggattaggcaacacataccccagttagcccttcgtccg

SEQ ID NO: 32835 - DNA, 204 bp, Glycine max
  Peptide Sequence Number=SeqID_124520
atgaggactacacgtcctcgccaacagagggctgcacgccctcaccttcagaggactacatttaccctcaccgttgagaggactacacatcctcgccttgagaggactacacgtcctcaccatcagagggctgcatgccctcacctccagaggactacatgtcctcgccttgagagggctacacgccctcaccttgggtactag

SEQ ID NO: 32836 - DNA, 95 bp, Glycine max
  Peptide Sequence Number=SeqID_124521
atggaatacttacttgttggtgatgaacaaaagcgcaaaacggaatcaaaaaatgcgagaaaggatgacctaggctgcaaatcgtcatcccgtgg

SEQ ID NO: 32837 - DNA, 375 bp, Glycine max
  Peptide Sequence Number=SeqID_124522
atggcttctatcacggaggccatgctaaaactccagaaaactctagaggataatgccacggcaaccgcctccaatgcagttagggaagcagaaccagtgcttcagcccacgataaacttaggccgggttagaaacccgacggtgttcgatcggaggtacagtccgcaagcttatccttatggcttgcctccggacttcactccccgtgacgctccagaagatgtgagccaagcccctaccttcgagggacaccttcctccttatgtcgattaccccctgcaagaagacgacgaagaagatacccatctaggccctctgcttcccctcaaggatccatccccctatgaattacctcaaccaaacatagtctgccat

SEQ ID NO: 32838 - DNA, 474 bp, Glycine max
  Peptide Sequence Number=SeqID_124523
atggaggctatcacacagctactatgcataccggggcaagatttcacccgtgccgctgcaaagagacgaggatcgcacccacaaagacacctagtggacctgaagaagtccaacagggccctggggtttccagctctggttacgggcctctgttggccctacagggtgcccgttccccccagcaagttcatgtcgttgtggcatagggattgtgcccgcaagacacctagtggacccaaagaaggccaacagggtcttggagttgccagctctaaatacgggtctctgtcagttctacagagtgcccgtcgccccaacaaggtcattaggccccacattaaccgggctttcatcaagaagtactgcgcccccagacgggcgcagggcgaaacaccacatcagcattgggatggccggtggcgggcaatagacacaccgccaccacctctagagttcacctcagctcatccataa

SEQ ID NO: 32839 - DNA, 207 bp, Glycine max
  Peptide Sequence Number=SeqID_124524
atggtgttgattacacctctaatttgctgggcgggttcttgttcttatggaggttgttgctcacgctattgttgctggtgtctctgtcttcctcagtcttccgctctatctcttcttctttctgcttcgtggttcctatgctgctcctcttggtgtcctccaggtcttgctcttgcttggtggttgttcggccttttggacaactag

SEQ ID NO: 32840 - DNA, 282 bp, Glycine max
  Peptide Sequence Number=SeqID_124525
gtcgactctagaggatccccgccgcctctggatgacaaaagggtgcggataaccataaggtatctccgcgtgtcatcgggcccgccgcctctggatgacacaaggataaccgtaaggtatctccgcgtgtcatcgggcccgccgcctctggatgacacaagggtgcatgtcacacaacctcagggtcagtatgacaaagattatggggcggccgacaaaagcaaggctcttgctcctacgtatcctccaatgaggaactccgacctacgtagttctagataa

SEQ ID NO: 32841 - DNA, 126 bp, Glycine max
  Peptide Sequence Number=SeqID_124526
atggagttgtggagaggaaaaaatagatcccttgaagaaggagctagaacacttctaaatgaaacaaagctacaaaattacttttgggcagatgttgtgaggactatttactatactttatacaag

SEQ ID NO: 32842 - DNA, 444 bp, Glycine max
  Peptide Sequence Number=SeqID_124527
atgggctcgaaatctaccctaaggctcatgagaaccctagggccttcccttggatctctagccaatctacttggagtcttctacccaatgcccttgcggggtaggattgcatcattaggattgcatcaatactggttcggccacaacccgtgcctatgtccagtccctaagcaaccaccgattcttgagatttccaataaccttgtaaaatcctttacaagcaaagatccacaagggatgtaccctcccttgttctctttgaacaaccaagtggatgggaaacaaaagatatctcaggcggttagtcctttgaaatattttgttaaagggaagaggaagaatcaaaagaattctcaggcggttagtcctttgaattcttctggcaagagagagacaaatgaagagaagaatagcacaagtttttggtcaatgaacttttcttga

SEQ ID NO: 32843 - DNA, 625 bp, Glycine max
  Peptide Sequence Number=SeqID_124528
cctccacaaccctgttcatcttcggccgataaggggtggagttatgatggtggattttgaaatcctcgcacatttcctgcatcgttttgttattcagattggtgccattgtcagtaatgatcttcctagggagtccataccgacaaaccaactccctctttatgaatctgaccaccacgatcctcgtgacattggtgtaggaagtcgcttcgacccatttggtgaaataatctatcgccacgagaatgaagcgatgaccgttcgaagccttgggttcgatggcccctttgacatctatcccccacatggaaaaaggccaaggggcggacatgacattcagaggatgtggcggaacattgacattgtctgcgaacgcttgacatttatggcatttccttacttgggtgcagcaatcgctttccatagtgagccagtaataacctgctctgagaatcttcctggccatagcatgcccattggcatgcgtcccaaacgaaccctcatggacttcctcgatcatgtggttcgcctctttggcatctacgcatcgcaagagggtcatgtcatggtttcgtttgtacaggatggtaccactcacaaagaaaccagtagccaatctccttaa

SEQ ID NO: 32844 - DNA, 537 bp, Glycine max
  Peptide Sequence Number=SeqID_124529
atgaggggagcaccaacggaagaaagcctgtctcctttccttgtgagagattttggcgcgcaaaatttcaaggttatacaaagagtccacaaggcgtgggaaagcctgttaaggaaagataaagaacttaggggcattcgtaatggcatcattggttgttatcatgaatggctgaaagttcgtacacgaggtttagattggctctccaagttaaagattatcaacgaagagaacttcgaagctccggaagaggatgaagaagtccgagctctgaaaaccgatctaggaaaagcaagacttgccaaagaaaattcaagttggtcgctacagacatctgaaaagagtgtgtcgggttacaagaagaaaatgcagctaccgcaaaagcccttgaacaagaaaccaagagggctcgcaaggaagagcatggccgtgaaaaattccatggagcgttgtggggcaacaacagtgagctcaagcttcgaagggaagagagagacccatcacgagcacatagcatggtttcaaaagaagagttag

SEQ ID NO: 32845 - DNA, 613 bp, Glycine max
  Peptide Sequence Number=SeqID_124530
gaagtgtttggaggaagggcaaaggccttggaaaatcaaggcgaatgggctttcttttattgacatcttggcgcttttgatctttggagttgtcctctttccaaatatggaagggttagtggacctagcagtgattgacgctttcctcgcctttcatcatggcaaggaaagcccggtcgtcgccattttggccatgtatgacacgttcgaccggggatgtgaaaagagcgacgcaagaattttttgttgtgcactggctctctatgtgtggctggtttcacacccttttctccaagaaggtaggcccgtctatccgctacaaggaaggaagaatcaggattctatcttcatgcgaaggatgtccaaatgttcccttgatggaacaaggggttgtattaattataatcccgtcctcgccataagacagcttggctaccccatgagaggagtgccatcagacgaaagcatcacgcctttcatcgcacggggtttcggtgaccacacgcgaggatactccaaggagttcgcaaggcatgggatgcggcgtgaagaaaggacagagagcttaagggaagcagtaatgggatcatcggcggctatcataagtggctga

SEQ ID NO: 32846 - DNA, 204 bp, Glycine max
  Peptide Sequence Number=SeqID_124531
atgagggttgtggttgggggtgatactgagggccttccgaagtgttttcaaggggtataccaccaactgcttgcctttcagtggcatattcgagccaaggctcgaagtcggctagattgtgatggggaatttcatgtgtctcccccacggtttaagagacatgtgcatgatcagttcggggttgttggctctcaatgggtatag

SEQ ID NO: 32847 - DNA, 387 bp, Glycine max
  Peptide Sequence Number=SeqID_124532
atggaaatctttattcaatcaattgatcttggtgcatggaatgtcattgttaaaggtcctttaataccaactaaagaagtgaatggtgaattgaagaaacagaaaaggaaaggaattgcacccaaagttaacttctcaaaggaagattacaaggaaagtttcagcagtgaggaagaggcagagaatttcaacttaatggtaaagaagtttggaaaatttcttaagaagtccaaagacagaaatttctctaaatcctccaagaaggttgaaagcaacaacaccttcacatgcttcgaatgtggtaagcaaggtcatatcaaatctgaatgtcctatcaaccttagaaaacaagtcggtgaaaagaaaggaaagaatgatagaaaatag

SEQ ID NO: 32848 - DNA, 201 bp, Glycine max
  Peptide Sequence Number=SeqID_124533
atggggcgcccgtttcccccagcaagttcatgtcgtcgtggcatagggagtgcctgtcgcccccagcaaggtcatcaggcccccctaccaatcgagctttcatcaagaagtactgcgcccccaggcaggcgcagggcgaaacaccacatcagcattgggatggccggtagtgcgcaacagacgcaccgccatcacctctag

SEQ ID NO: 32849 - DNA, 856 bp, Glycine max
  Peptide Sequence Number=SeqID_124534
gtcgactctagaggatccccaaggcaaggaaggagttcttttctcgtgtggggactaccctagtgttccactgatagggactaggggttgtattaattataatcccgcactcgccataagacagctagggtatcccatgaggggagcgccaaccgaagaaagtctctcgcctttccttgtgagggatctaggtgcgcaaggtctcaaggttatacaaagaatccataaggcgtggaggagtccgttgaggaaagacaaggagcttagaggcatccgaaatggcgtcatcggagttatcaatgaggagaacttcaaagctccggaggaagatgaagaagtccgagctctaaaattagagctaggaaaggcgagacacgccaaggagaagttcaaatcagctactacacacatccggaaagagtgtaccgagttacaagaggaaaacgcggccactgcaagagcccttgaacaagaaaccaaaagggcctgcaaggaagaatatggccgagagaaattccgaggagcattgtggggtagcaacaatgagctcaagctccgaagagaggagagagatcggtcacgggtccaaaaggagttggctcaacacttggaagccacggagcaaagcatgctagccatcatagggcaatacaaggaagaattgaaccagtccatggcccatgaacaaaagctagtggaggattttgcacaagtgtatgtcgaaaaagaagcaagagggagggtgattgatgcactgcatcaagaagcgactatgtggatggatagattcgccttgaccttgaatgggtgtcaagacctcccgcgtctattagccaaagcaaaagccatggccaaa

SEQ ID NO: 32850 - DNA, 291 bp, Glycine max
  Peptide Sequence Number=SeqID_124535
atggaggagtttgacgcacaggtggactggccaggagaccaaccttcttcctttggagggggtggggcctctacaacccaggagcctgtgactaaggagccacaacacccgcaccatcaccagcagcagcagaggagattgattgtgaaggaatgcattaaccatatcccggttgtaggagagcatcatccacagaagatggttcaaggcaaatttgtcccaaatttggaggaggcactgggtatgaaagctaagtgcctaagaaaaagggcaagtatggggaaggaatga

SEQ ID NO: 32851 - DNA, 297 bp, Glycine max
  Peptide Sequence Number=SeqID_124536
atggctccaaagaaactttctgctaagagagctaggaaggccactgcaggggaaggatccagtgcagtcccacaaaaagaaattgagtttgatgggcaccgcttccaaagcgaagagcatcagcgccgctttgaggtgattaaggattggtccttcctcaaagaaagacaggtccagtcaaagaaggagtcatggacaaacactcctgggtgcggggctaatggatcccatatgacacagatgccatcaattattcttagggcatccattggtcttagaagagggtcaacgatgtga

SEQ ID NO: 32852 - DNA, 309 bp, Glycine max
  Peptide Sequence Number=SeqID_124537
atggttctggttttgattactacatgcattccaagcatcatcatagctcaaaccaccacactctttatcagacaaggcaccacactggacaggagaatgggaccccattttgaaatccctccagcatgtctcatagcacttaactctaacaaggtttcgaaacatcacaacagagacagaccattgaactcaggcagaatggagtttttcttaataagaagagatactgattccctaggagtcttaaggcaaccacaatgcacttccaaaatcgattccgaccctttccgagactctttcctttcctag

SEQ ID NO: 32853 - DNA, 486 bp, Glycine max
  Peptide Sequence Number=SeqID_124538
atgacaagtgcagatccattaagtttgctgtggattggggcaataatcacaagcaaagggcacatcaaattggcaaggtggcattcaagaagaggtaaagtgataggaagaagaacattttttgaaggtgctgaccctcaaagttcagcaacaacccctgcacgtaacataaagatggactacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattacagagaaaggaaagctcaattcaacaagttgaatcatgggagaaaagttattgggataatcaaaccataacatcttaa

SEQ ID NO: 32854 - DNA, 1130 bp, Glycine max
  Peptide Sequence Number=SeqID_124539
cgacatcgtcacagaagcagatttgattaaatatgtagagcaggcgaaggctgatgctttgcattcattcaactttttgaaagagaccggcactttgtcggcgacctggacctatcacatcacacacaagattcctggtcatgacaagttgctgaatattcgttttccatggccgtgggaaaaatctcgtgacccagttgtgagtattgatactttttctgaaaagaaagaacacatcctgcacgaatcccgtattgatgcggataccgtgattcatgcccatacaccttacttggcggcctggtctttggcgcaaatcaatttcccaattttatatgtggcagcccaacgtcatttgctggcacgtgaaattcctaaccacctcgaccgcactcgcagcattttgtcgattatttccgagcgcctggacagtcatcctgaattggcacctcctccagcgttgctggagtcaaatggtggtgccaacatttggggcaaaggcattatcggtacctcacaactggtactgttgattgaagaagcggcacgcttccagtcattggccgagcaagtgggtggtgccaaagagtacacgcctggtgcgcttgaagtgcaatggaaacgcaccggcttggtagaaaaagccaagcagtattcagtgttgatcatgagtcagagcaaaaaaaggcaattggccctgaatgtatttttgttacgttatggacaccatccggcaggctggttgcatccaacctggaaggagaatggccgtcctgatttgcagtggtggatacgtgccgcccagattgctgaagcagccaaatttgatactttttttgttgctgactttattggtaggtcaggggtgatcgacaaacaggctgtcaaaaacccaaataactttcatttcgaaccctttaccttgttatctgcaattgcagcacataccaagaatattgggttggttgcgacggtcaatacaaacttctctgatccgtacaatgtggctcgccagtttacctcgcttgatcacttgagcggcggtcgcgctgccttatgggatagctgggatgatgatgcctttgatcaccctaaacgccagagtgggcagttttatgacccggtttccg

SEQ ID NO: 32855 - DNA, 174 bp, Glycine max
  Peptide Sequence Number=SeqID_124540
atggaagagaagttgaggtccttcaatggtgattttccaccatggagatgcagcggaaggaaaaggagaagaggagagaggaggcaccatccacaagggaataagtcaaggaagaaagagcttcgccaccaagatgagccttggataagaagcttggagatgatgcttcaatga

SEQ ID NO: 32856 - DNA, 294 bp, Glycine max
  Peptide Sequence Number=SeqID_124541
atggggatcgcacccacaagacacccagtggacccggaaaagtccaacagggccctggggtttccagctctgggatcgcacctgcagacacccagtggacccgaagaagtccaacagggtcttggagtgtcaagctctaattacgggtctctatcagttctacggagtacctgtaacctccagcaagggcatcaggcccctactgatcgagcttcatcaagaagtactgcgccctcaggcagacgcagggcgagacaccacagtagcattaggatggccggtagcgggcaatag

SEQ ID NO: 32857 - DNA, 87 bp, Glycine max
  Peptide Sequence Number=SeqID_124542
gaattgctcttaaagcatcagtcctcaattcaagaagaaagtgatcaggataatgatccagatgatgatgatgattctctcttctaa

SEQ ID NO: 32858 - DNA, 390 bp, Glycine max
  Peptide Sequence Number=SeqID_124543
acacttgttagcactgtcacacctcttgggcttgaggttattcctcaagtaaaggagttgttggatgagggtttggttcgtaagagcttaaatccttgtgctttgttggtgcccaaaataggaataatcaacatgaaaatacagaaaaaaagggttcctgcggaccctaagagaataaaggtcattcctgaatggcctactccaccaagtgtcgagggaaggagcctagagtatgaagaacctcggaatttgaggtcaaatcctttccaaggtggaggagacgatgcaatcctacccccaagggtattggatagaacactgcaagaggattgggctagagctactaaagaaggccctagggttctcatgaaccttagggtagatttttga

SEQ ID NO: 32859 - DNA, 432 bp, Glycine max
  Peptide Sequence Number=SeqID_124544
atgttgctaagtagcaacgtcatccatatctgtgtaagagtggtcatgttggcgcgcatgatctgcactcgtctctttgcagcggcacgtgtgaaatcttgccccggtatgcacagtagttgtgtgataccctcctcctctcattgtgctcgcatagttggccctcctccaggatcagggggtggcccaggtgtcgcaacgtgcccttttgtgggcgagcgaggcgaggctcacgggagcgctttccaaatgaggaaagatgcgcggagtcgccaccaacgtttatttgtgaaaaacgtcggaaaaaccgaaaggaaaccgatcaaaatgaaaattctaagttcgggagttgtatttacgcttgaggaaggtcgacaaagcggggctttgctctacgtaccctccatcgaagagaaaatcagacctacgtag

SEQ ID NO: 32860 - DNA, 159 bp, Glycine max
  Peptide Sequence Number=SeqID_124545
atggtttttatcaaatcttctttgaggatactggagaagatgatagagaaaggagacatcttgatcatattaaggttactacttggaatatggtttttttccaatgtaaagcctggacattgtttattgtctaattggtttattaaccctactacatga

SEQ ID NO: 32861 - DNA, 153 bp, Glycine max
  Peptide Sequence Number=SeqID_124546
atgagtgtgcgaggcacgattgacgttgatgatagtgcgataggcttcgacgagatgttgacgaccgacctgagctccgacaggatgatagcaaggtggcccttgttgtcatggcgtgcacctttcttggaggcaaaagaaatacaagaaagt

SEQ ID NO: 32862 - DNA, 336 bp, Glycine max
  Peptide Sequence Number=SeqID_124547
gcgtctagggtcgcgcctggtgcaggggcgccaccagtcgcgcccagggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 32863 - DNA, 494 bp, Glycine max
  Peptide Sequence Number=SeqID_124548
atgaattcattgcctagcgctggtcatgtgtcctccgccttcgagtctggggccccgcgaattgattgcctagcgttgttcgccaattctccattctccacttttattcatagacccatgaattcattgcctagcgctgttcatgcatcctccaccaacgagtctggaggcctgcgaattgattgcctagcgctgttccccagttatccattctccatttttattcggagccccatgaatttattgcctagcgctgttcatgtgtcctccaccttcgagtctggagccccgcgaattgattgcctagcgcttttcgccaattctccattctccactttttttcggagccctatgaattcattgcctagcgctgttcatgcgtcctccaccttcgagtctggagccccgcgaattgattgcctagcgcttattagcgccaattctccattctccaattttattcggagccccatgaattcattgcctaggcgctg

SEQ ID NO: 32864 - DNA, 276 bp, Glycine max
  Peptide Sequence Number=SeqID_124549
atggtgaaagttggaacctcttacgtgccgatcaacgtctcattttcgccaaaagttggcccagggcttcccggtatcaacagggacaccaggatttatttatttttgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 32865 - DNA, 386 bp, Glycine max
  Peptide Sequence Number=SeqID_124550
atgaatgagaaaactggggcaaatgaagagggtgagaatgaaggagagacccatgttgcaactgccattcctacatggccaaacttcccaccagcccaacaatgtcattactcagccaataacaaaccctctccttacccaccacctagttatccacaaaggtcatccctaaatcaaccacaaagcctgtctatcgcacttccaatgacgaacacaacctttagcacaaaccaaaacaccaaccaagaaatgaattttgcagcgaaaaagcccgtagaattcaccccaatttcggtgtcctatgctgacttgctcccatatctacttgatactgcaatggtagccataacccctgctaggtttcctcaacctccatttttccgagg

SEQ ID NO: 32866 - DNA, 471 bp, Glycine max
  Peptide Sequence Number=SeqID_124551
atggaagattctgcaaaaggacctcaccatcctcgcccagaagtggagcgtcctcaattacttaaacctcacccttacctctcacacctccgacctcaacatcgaccacgcttgactgatatatgggctagtgatgatgatggacatagatttgggcaacatcatttctttccagattacgcaaatcacctagtccagccaaccctcttcctagccgaagcagctcatccccatgatgtagagcctccaccatggctagtacctagtcatccaaagcctctaccagctctccattcaactctccatccagcaaccgttgatgatgccggtggctttcctggagcaattcgcttggccaggggtctagcttccctctatcgagggaagggggtaacacctcttgtgctggagatgatgttgatgtctcagatgccgatgctgatgatgattatgttgtggacatcatggtag

SEQ ID NO: 32867 - DNA, 1017 bp, Glycine max
  Peptide Sequence Number=SeqID_124552
atgccggacggtagccgcggcgatgagttctatgaataccagtaccagcgtaccgttgtggaaacgcaggtggtggaaagcgatcctggcaaaatcctctccggcggccggctcatcatcaacagcgataagctgaataactacgatagccagattatcgccggaggagcgctcggtggcgtgattggcgaactaaacaacgtcgccacgaccggcaaacgggtgaccaccgacgtcggcacccagacccgttggtatgagaaaaagaccagccgcccgtttggcggcaccaaaaccagccaggggaaaaaaagcagcgaatatgaaccgacgccgacggttcagaccatcgatttgcaaaccatggagtggcagggcaatacccaaattgatggccatagcggtgtgattaatccgcgcgatcgcgccgatgaaacaggcgaaatacccgccggacgactggtggaagtgacgccggttaacgctgacggaacggttattcgcgtcgtcacgccggatacccggcttcctgtcagcagtctgtatcagatcgatccgcaggctaaagcaggctatctggtggaaaccgatccgcgttttaccaacggtaaagcgtggctcgccagcgactacatgcaaaatcagctgggcgttgatcaggcgatgaagcggcttggcgacggctattacgaacagcggctggtgcgtgagcagatcgttaagctgagcggcgggcgctacctgcagggctacagtaacgatgaagagcagtaccgggcgctgatggacgcgggcgtcgccttcgccaaacagtacaacctgatggtcggggtggcgctgacgccagcgcagatggcgctgctgaccagcgatatggtctggctggtcgccagagaggtcacgctaacggatggctccgtgcagcaggtgctggtgccgcaggtttacgcgcgggttaaagcgggcgatctcgatggcagcggcgcgttgcttggcggtgaaaacgtggcattcagc

SEQ ID NO: 32868 - DNA, 297 bp, Glycine max
  Peptide Sequence Number=SeqID_124553
gtcgactctagaggatcccctgctgtgtccaaggatgctctgatagctgaactcaaggacacatgcaaggtgctggaagcaaccatcaaagccaccacagaaaagaagatggagctagaacggctgatcaaaaggctctcagaaagtggcattgatgatgaagcagctgaggaagaagaagaagcagctgaggaagaggaagaagcagctgaggaagaagatgatgcagcagaggaagagaacgaagcagcagaggatactgaatcagatgatgatgattctgaagccaccccatga

SEQ ID NO: 32869 - DNA, 936 bp, Glycine max
  Peptide Sequence Number=SeqID_124554
atgtccaaatcttttgaatttgggatgaccggctctctcgatgagtcgatctcttgctttctcataaggatggaccctcggagggctgcacgccctcaccttcagaggactacgtgtcctcactttcagaggactgcatatccccaacttcagagggctacacgccctcgccatcagaggactgcatgtcttcaccttctagggctacacgccctcacctttagaggactacacgtcctcgccaataaagggctgcacgccctcaccttgagaggactacacgtcctcgccaacagagggctgcacgccctcaccttgagaggactacacgtcctcgccaacaaagggctgcacgccctcaccttgagaggactacacgtcctcgccaacagagggctgcacgccctcaccttggagaaggctacacgtcctcgtcaacagaggactgcacgtcctcaccttgagaggactacacgtcctcgccttgagaggactacacatcctcaccatcagagggctgcacgccctcacctcatcttcagaggactacatgtcctcaccttcagagggctacgctccctcgccttcgtagggctacacgccctcaccttccgaggactacatgtcctcaccttcagagggctacgcgccctcaccttcgtagggctacacgccctcaccatcagaggactgcatgtcctaaccttcagagggctacacgccctcgccatcagaggaccacacgtcctcaccttcgtagggctacacgccctcacctttagaggaccacacgtcctcaccttcagagggctacatgccctcgccatcagaggactgcatgtcctcacctccgtagggctacacgccctcacctttagaggactacacgtcctcgccaatagagggctgcacgccctcaacttgagaagactaaac

SEQ ID NO: 32870 - DNA, 825 bp, Glycine max
  Peptide Sequence Number=SeqID_124555
atgaggacaaggggttgcatcagttacaatcccgttcttgctataagacaacttggctaccctatgagaggggcaccactagaggaagagctcgcgcctgtcattgcacgaggtttcaataaaaccaacgtggaggcacttcagaaggtccgcaaggcgtgggagatggtgcaaaagaaggacaaagaactcagaggcagtaacaacgggcccatcggcggctaccgtaagtggttgaaagcccacgtgcaaggtttggattggctccaaagtttgagaaccactaaaagggaggaagttgaggtgccggaggaagacgaagaggtgcaggtccttagggcagaactcgagcaagcccaaacagtcaaagaaaggttcaaatcagcagctcttaagattcgaaagaagaatgtcaagctgagagatgtaaacatagcccctcccatggtcgaaagggagatgattaccatgatggtagacaccttgccagtgttttactatgagaagttggtaggctacatgccttccagcttcgtggacttggtattcaccagggaaagaatcgaagtagggttgaaaaaagggaagttcgattacgtttcctccaccagtgccaatgctaagagaattggagcaactggggcaaaaaggaaggaaagagatacctatgccatcacgtcgacgcccgtgtgggtcaagcccccgcagacctctcatggtacacatcagtacgtgcaacatcacccgagcttctcagcacgcgccgggatctcttccaattcagcacccgtgcagcctaaggcgccacgcccggggatcctctag

SEQ ID NO: 32871 - DNA, 489 bp, Glycine max
  Peptide Sequence Number=SeqID_124556
atgagtcatcattcatctagtgttaatggtgagggtactagtcataaggaccctctatctagaatattagatgagttaatttgcctcaagttatggaaagaaaaactagaaagaaaagaaaaaggaaaagagaaggtagaaataagtcaagatgagagggaacaaataagggaagaagaaagaacgaaaatactaaaagagttaagaaaagaaaaacatgcctcctatagtagtcatgactcacgcaagagcctaagtgaagagcctaaacataggtcacatcctagacctcactcccataggagagaaaaggaaagaaagcctcaagaggctaacattaatcttccatacttccatgggaaggacagtgtagaagcttatttagattgggcaacgaaggttgagcaactctttgtttgccattatacaagtgaggaaaggatggttcctttggctacccttagcttccaagggtatgcactctattag

SEQ ID NO: 32872 - DNA, 99 bp, Glycine max
  Peptide Sequence Number=SeqID_124557
tgtttttgggtatgcttggtgggagtagaaaatgggaagctgggaattggaggattgaagatagtgaatctgtgattgtgtatgaagttgttcaatgtt

SEQ ID NO: 32873 - DNA, 387 bp, Glycine max
  Peptide Sequence Number=SeqID_124558
atggtagatacgttgcctgcgttctactacgagaagctgataggatatatgtcggctaactttgcagacctcgtcttcgccggagaaagaatcgagttcgggctaagaaaaggcaagtttgaatatgcctccaacgttgcccccaacaacaatagaagagccccagtggtgggcacacggaaaaaaggatggagatacccacgcggtcaccaccgccccaacatggatgaaagcgccccaaaatgcccaaaactcataccaacacaaccacccgaacttttcgatccaagccggaagttccctcccaactcaagtggaagggcctcccgcaacagaaaaaacgcctgcctaacccacagctctaaccactccccggccagccaataa

SEQ ID NO: 32874 - DNA, 294 bp, Glycine max
  Peptide Sequence Number=SeqID_124559
atgcatgctctgttagggtcattcaatagtggaaactggtctgactctaaagtccttgatagtgtagggctgagttgtcgtgctttcatgaggaatcggggtgtgataattaagttttgtatatctcccacaggcaatttagttcctctggacttagaaattgaagcttcattgcaaaggaacagggtcgagaggagaaggaaacttctgcaagacataacagttgcatccattcttgagaaggagactcatttctctgacttattatcacctgattcaccatcatcaaggtaa

SEQ ID NO: 32875 - DNA, 516 bp, Glycine max
  Peptide Sequence Number=SeqID_124560
atgacaagcagagaccaagtttggtcattctgcacccttgtatcatccagaggcggcgggcccgatgatacgcggagataccttacggttattcgcacccgtttgtcatccagaggcggcgggcccgatgacaagcagagaccaaaggcggcgggcccgatgatacgcggagataccttacggttatccacacccttttgtcatccagaggcggcgggcccgatgacaagcagagaccaagtttggtcattctgcacccttgtatcatccagaggcggcgggcccgatgatacgcggaaatacccgagtggttatccgtataaacattcttttgctatttgtaagacagaacgcttgatagatgcagaggctgacacagtcttctgcaccttttgttcctccgggaacaacaagtcatttacatgcggaaatttcatggtcacccgcgactctcgtcaaccgagaggagcgaaattagtgtcatacactgattttcgtccggggacctttgcttga

SEQ ID NO: 32876 - DNA, 378 bp, Glycine max
  Peptide Sequence Number=SeqID_124561
atggctactccaccaagctctcctcctcctcctcctcctcctcctcctccttctcctactaatgcagcatcacagtcgtcgtctaccttgaagcggacaagaaaaaccacccgactaagatcattggtgactagactagctggggcagagagaccggtggcccacgtcgatcctgcgaccgggaaggtcgacggtccccacaaaaagaaattaagaacatatttggggattgttgcttgtgataaggtcgacgtgacatacgagaattggaagcaagtccatgctgctcagaaggatttgatatggaaggatattcaagctgaatttgatatccctgaagcatctgacgttaggacaaaaaagaaaatacttcagact

SEQ ID NO: 32877 - DNA, 297 bp, Glycine max
  Peptide Sequence Number=SeqID_124562
atggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaaggtataggtgcgtttcttctagtattcaaggctctttattttggaggtatatatgatacgtgggctccggggggcggagat

SEQ ID NO: 32878 - DNA, 357 bp, Glycine max
  Peptide Sequence Number=SeqID_124563
atggaggagacacatggaatgccccaccacaatctagccgacttcgagccttgccttggatatgccactgaagggcaagcagttggtggtatacccctgcaaaacactttggagggccctcagtgtcacccacaaccacaaccctcacattccacagcggttaaaaaccctcatgctatggcagaaatgggaaagaggaaaggctcagggccattgaaggagataggatgcaactacagaacatgtgcaaaaagggagacgataatcgtgatggtagacacattatcggtactctactatgaaaagatggtaggctatgcaccctcaaagctttgcggatttggtcttcgccagtga

SEQ ID NO: 32879 - DNA, 375 bp, Glycine max
  Peptide Sequence Number=SeqID_124564
atgactagaggcaatccatctaacttacgacccttttatcctgagatagacaggacattccatagattagttaggcatcattttatatctttagagcatcctgagcattctgttactggtgagtttgtgcattctgtggttggtgattttgaacatcttgattttaagcattataattttgaacattctgagaacatggcacagcctccaccccatgagaggactctaagggaaatggctgcacctgatttcacctacgaaagcttgtgcatccaataccctgatgaggatgtcccatatgttcttaaaactggactgatccatttgcttccaaagtttcatggccttgcagtgaagacccgcacaaacatctaa

SEQ ID NO: 32880 - DNA, 582 bp, Glycine max
  Peptide Sequence Number=SeqID_124565
atgatcttaaaagaagagttagctgcttgcgcaagatccaagaggagtttggctcaacacttggaagccacggagcaaagcatgctagctatcatagggcagtacaaggaagagttaaaccagtctgtgacccatgaacaaaagctagtagaggatttcgcacaagtgtacgccgaaaaggaagcaagagggagggtgattgacgcattgcatcaagaagcgactatgtggatggataggttcgccttgaccttgaatggaagtcaagacctcccgcgactactagccaaagcaaaagccatcaccgaaaaaactctagaggataatgccacggcaaccgcctccaatgcaattagggaagcggaacctgtgctgcagcccacaataaacttgggccgagatagaaacctgacggtgttcggtcggaggtatagtccgcaagcttacccttatggcttgcctccggacttcactccccatgccgctctggaagatgtgagccaagcccctaccttcgaggggaactccctccttatgccgattaccccctgcaagaaggcgacgaaggagatacccatctag

SEQ ID NO: 32881 - DNA, 501 bp, Glycine max
  Peptide Sequence Number=SeqID_124566
atggatgcaagtgatcacacaataatgcatgataggactgatatccctaccaaaagaagtctgctagagctttcatctcaggatgcacttttggcacagaacaagttgttgtccaagcagcttgagacattgaccgaaaccttaagtaagttgccaaaccagtttaatgctaatcaaccttcccattccgatgttttacaggtagaaggttgcagcatttgtggtggagctcacgagtctaggtgttgtattccctttgatgattctgcacaagaagtgaattacatgggagggagtcaacccatacaagggcaatggagagcctaccctgacaatcaattcaacaaagagcatggtggaccatttaataggcctcaacaacaggggcctagcctatatgagagaaccacaaagctggagaagacccttgatcagtttatgcaggtttcaatgtccaaccacaagagaacaaagtcagccatcaaaaaccttgaaatccag

SEQ ID NO: 32882 - DNA, 435 bp, Glycine max
  Peptide Sequence Number=SeqID_124567
gtgtgactcgtgcatgcctcatgaataatggaaataaggaaatgcaagaggctagtgcacatggaaataaggaaatgcatgagcctaacctcctacggaagaataggaaaaggcagatgaagctcatgaatgcagatgaaaacccgaaactcacatttcattttccacatggggagacaaccataactttacaagatgtggccctgcaactgggcctcaagattgacaagctgtcagtaattggtgccattactggtgatgtacgtgttgcttgtcaaaccttaccaagtgacactccacctgataagtatattaagggaaaaatgattcatctaacctggttgcggcaaaattttcgacaacttcctattgatgctaatgatgttgtgattgcacaacatgctagagctcatatcatgatgctcataggtggat

SEQ ID NO: 32883 - DNA, 808 bp, Glycine max
  Peptide Sequence Number=SeqID_124568
caggtttttggatgagtggagctcaactttgggtcatgcttccgtttatggattccttgagccacaatcgatacacgatgcaaaggaccgacgtgctgaatgtgagcattacttacaagcatggctcaaggaatctcaacgagaggtgtacctaggagcttacttaaatcagggacattggcaactggtagtactgtgtcctacgaccaattttgttgcatggttttgttcgttacgtaagaagcctgatactcatatcaaaactgcaattaacaatgcaatgaagacagcaaacacaactgcggatggtacaaataatcaaccaactcctaagtggattgaagtcaagagccatgttcaaagcggagggtatgagtgtggctactacgtgatgcattggatgtggaacatcgtcagtgggggtttaaagaatgattggagcatggacagctacacaagtcttccaaaaccaattgactttggtcaagagttgagagtggggatgttgtttgagttgtacaaaaagtttttagctattgtaggggaaatagatgttgactacttgaatcatgttgagaggaaaccagatatggcctttgaagcggaagttcagatatttgttgtgattatcttattgtcactatcttattgcaccctttctactggttcctattctcttataaatttgatatttgttgtgattatcttattgtacttcagactgaaacatgtccagatgctactgaaagaggaagaatctagcccttggggtcgtcatatccaggctaaggttggtgttaatgtctga

SEQ ID NO: 32884 - DNA, 576 bp, Glycine max
  Peptide Sequence Number=SeqID_124569
atggtggcaccgcgaaggtcccctccgcagtcagatggtaatacggagccacaacctaagaagacaagacaaagcacacgtcttagaaggttgactttaagaagtttagatcagcctagaccaacagttactgtggatcctgcaactggaagagcatcaggccaagagaagcaaaagttccacagttttttaggggtcgtagctcgaaaaaagatccccaatcgtccacagcaattggaaaaatgtgccggaaactctaaaggacatggtatggggggaaatttgatgagaatcatgaaactggccaaatacaggctaaaggcccaagtagagaaggacgaaggcccaagtggagaaggacaaagcccccgtgtggagaagggtgaaggcccaaagtttctctctgggttccttgttgaaccaattataagacttatcaaggtaatccttgtggcgtctaccctgacttatcttccttcactggaagtggcgtcatccaaaacctccgtagcccgtatcaaacgatccgctcctactcaggtttgcatcatctggtatcatagcttcggctcttga

SEQ ID NO: 32885 - DNA, 1849 bp, Glycine max
  Peptide Sequence Number=SeqID_124570
gttcttggtcttttaggtggaaaccaactaaacagtgctattaactcagagaaagctgtgaagatggatagtgctgctgttgctgagttacttgacttgatagacactgctctggctgatgatttatttggaaattttatgaactctggagtagctagtgaatcactaaaaaatgatgatccctttgctgatgtgtcatttcattctaatgacaacaaagagcatgttgatatcttttcaagcatgactgttgttgatgataaattggatcatcatgtgagtcatgaaaatatgggcagaaaatgggcaaaggaaatccatgcccccgagcttactatcgatgcactgcttctccatcttgtccaggtttgtggagttggtttggatgtattcacctctgaaccagctggttacataaccactgcttgtactttcagtacctctgccactgcaatggcctgcaaaacttctgctacagcttccatgctccaatctccctcattgagttcacaacatggattagttgattcagctatatcctccatcatcaactctagtgctcgttattacaaccctaataatgctctaaacttctctacacaccaagtttcaagaccgcaacaattctacttccccaactcatccatttcaaccttgaattctcaccccacaatcactttagaccttacaacaccttcaacttcttcctcaaactcaagcttcacttgcatgccaaaatactcatcaacaaaccttaacttttcctcaagtttctctcctctacattctagcatgccgcaatcaccttggaacaggtatagtggttactccaactctggaacactttatcaaaatagacaccaaggtggtaattacatgttaaacacgggaaatcaaaatcaaccacattctctagggcatctcaatcaacctatttacatgagcaacaatagtaccatttctcagcattctttccctaatcccattgttgctgcaactgaggcaataatcagaagtaacccaaaatttcaatcagcactagcaactgctctcacaacatatgttggcaatgaagctagtagtggtaggacaagagaaaatcatgttcttgagagtgcagaactaatgaagttaaagctgctacgtagtgaaaatagtataggaaactcaacaatgcatgacaagaagagaaaaccaggttggggagctatgggtttcctgatccttgtagccctctgttttcagcaaagcaacgatgaagtcaaagaggtgaggtcaatgccaaagaaaggagcttcaatggaagaaggggtagggcttcaatgtcaaagagctgaggtcaatgtcaaagaaaggagcaagcagaaaggtgtagggttcacagtaaggagaaagcaagcagaaaggtctagggttcacagcaaggagaaagctagcagaaagcgatctaaccggctaagcatgatgttcattaagactaaaatcttggctgtgatacgtgattctgtcaaccagcatgaaaaggcccgagacttgcttaaggttattgatgaccagttcatcactttagataaaactttagcaagcaccctgatcatgaagttctccttccttcggctcaccagtgtgaaagaagaagaaaggcttgtgatggagatgggtgagaatgcattgctgacaactacttgtgggaagaacaaagttactgagtctcaagctaatcagaaggggaatggtagaataccacttcaagctaatattaagaaggtcgaaaattgtttcttttgtaagaagaagggatacatgaaaaagaattgcccacgattccagatatggcttgagaagaaag

SEQ ID NO: 32886 - DNA, 461 bp, Glycine max
  Peptide Sequence Number=SeqID_124571
atgcaatcacaggtactcacagtgcctcgtgaggctgaggttggtccttctgttgcttgtgtcgatccctcgaggcagggcccaaaaatgggagactcgaaaaaatgtgggttgtatgtcaatgacagtcctcctcgactggtcggtgttgagaaagtccaagatgctgatgctcacattcatgtacccattcaagaggataaacaggtagctgagggaatgacgaaacctgtagatatgtcggatcctaacatcgatcccttgtacctaatgacattgaccattctgcaactttttctcaagccgttgcaggtgtcgtgggatgctagtgtgtttggagtgtataatgataactttccattagtcgtgagggagaggatcgtcgcgaggctgaagggtgagagtgagagtgagagcaagactgaagtgttgcggacaaagagagtgagagtcagagtgag

SEQ ID NO: 32887 - DNA, 663 bp, Glycine max
  Peptide Sequence Number=SeqID_124572
atgagtcaagatgtgcatcagcctgaagttcctcggcgtcataggcctactgcttcagtacgtaggcaatgggttcatgtgactgaggacgttactcagacacttgaggatgtgcctcaattgaatgaggatgttcctcatgtgtctgacgctactccggagatgacaagcgccaccgatgctgcggatgcagagggagtggctagtgatggtagcttgggttcacctgctactaatgagggattccctagtaggccacatgacccattggaacgacccggtctaaagttggtctcccatggtaggaaagtagataaatttgggagaccagcgcctgagatagaaggcatgattgcagccaccggatcgagtccactgatcaggtgctctgtaatcaccactgatcctggacttatatccgctttcgtcgagaggtggcatagggagaccagcaccttccacctgctagtaggagagttgacggtcactctagatgacgtttcgtcactcctacaccttcccatcactagcgcgctgcatgccttcgagccgctagttacttctgacgcggtggggcttttgacggagctgcttgaggtcacccctgaggaagctacagctgagacccgtcaggctagtgggccttatgttcgattgtcctag

SEQ ID NO: 32888 - DNA, 375 bp, Glycine max
  Peptide Sequence Number=SeqID_124573
atgaatgctgatatagacgaccgatggctgcacttttcagacaatctaatgcctgcgagggagatctgtgtagttcttggccaggtggcgccagactacatggattggtttttttggatttcgcacccgttcgtcacgtcgaccgaggatagtgctgagttgagacatccgcctaccccacatgatgaggagctcatcgagccacctatcctggaggtttcagttgcgtccgatctctttacacattcagtggatttgggagcgatcgctgaggatttggagcgggtcatcaacctcgggatggtcactaaaggcactgacttatatgacatcatgactcgttgcctgaggagagctagaggtgacgccgcatag

SEQ ID NO: 32889 - DNA, 588 bp, Glycine max
  Peptide Sequence Number=SeqID_124574
atgaagaataagaaggttgaagcagttggtgtctcgttaagcgaggcttatgcgcttagtgagcaacatccgctaagcgaggcactcagctcgcttagcgggttgagagaatctggaagagaatctgtcattcatgcacgcgcccagcacgccatcagctcgctcagcaagggtagttccagacccctcacattcgagtccttgagtcccgctattaatttggcgtatatcaagaaaaattgctggaacccggatgatccttcgatcacatttccggggacccgcaaggctcgagctcgaggacctgagggccctttttcttctacttccttcactcctgcttcgacttcttcagttccagctcccattccagctccaagtattcataacttggctcagcattggcccatcattagcatggaggatttcatggctcaggagtcgcagccagaggccgaggcccaaccggaggttacatcagaggctactccccagacttcacctgctacgacaccatttgtggaggtttctgaggaggaggaaggcgccgaggagactgactacgcaactaatatggcagcagcgtag

SEQ ID NO: 32890 - DNA, 470 bp, Glycine max
  Peptide Sequence Number=SeqID_124575
tatacatacttctggaaaacaatgggataaatccagtgctactacttcctcctcctcatcctcctcctccttcttcacagaataccttaggaggaagtttgctaaaccaaacggttggagttcctgcttcaatgaggtcctttaatggtgattttccaccatggagatgcagcggaagacaaaggagaagaggtgagaggaggcgtcatccactagggaataagccatggaagaaggagcttcaccaccaagatgagccttggataagaagcttagaaggatgcttcaatggaggaaaagaaagagggagagaaagagagaggggggagaacgaaattgaaggaataaaagagggagagaagtggaactttgaagtatgtctcacaagactctcattcatcaaagttacaacaagtgttacacatgcttctatttatagactaggtagcttccttgagaagatttcttga

SEQ ID NO: 32891 - DNA, 489 bp, Glycine max
  Peptide Sequence Number=SeqID_124576
atgtccttctcctttattcccaaatcccaacatatagctaaccctactcccaattcttatttgctagggagctgttgttgcagtggtgatgagataaagctactggtggaggcgacggtgaagggtgaattgtcgcttattccctgggctccctcttcccctccgaaccaagaccctttcgctctaaacctaatgtcaacaactcatgggaactcaaaaatcgttgcgacaacgttcgatatcagtctcttcatgctcattattgtttgggcacactgcttccataacaactacaacagttggttcagtgacgaggttggctcatggaagttaacaatgttccaacatttgaatttcgcagcagagggtgtgttggagtgttcatcaatgtctgataagatattggagatgggatccatggaaatgatttacagagtggaaatgctaggtagcaagatctttacaattaagaatttatggctgaagtaa

SEQ ID NO: 32892 - DNA, 237 bp, Glycine max
  Peptide Sequence Number=SeqID_124577
atgccatatccaccaataaaggtttcatcatggaattttttttggttgttgttgcaagctctcggaaggggcgctgtttctgagggtgttgaaggtaacaatgagggtggtcttgtcatggttcatttcactgcggaaggtgaagaggcatcacagggtgatggtgcagagaggggtgcatcgatcggtgaaggtgcaggggtcaaggaagggagaggagagaagtgtgaactgttt

SEQ ID NO: 32893 - DNA, 924 bp, Glycine max
  Peptide Sequence Number=SeqID_124578
atggcctttagaaaaaggaaagcaatcgcctcccgacctcaggaaccatatgacacaacaagattcatctcagaggtcgcctgggaatgctacgagcagaacgtttactcccagaacatccttctggagagaaacattaatttatttatcatagagtatgatgagttccgaagggaactcgagaggaggcagtggcataaagccttgaccaggcaacctgatggttacattgatgtggccctggtcaaggaattttatgccaacttgtatgatccagaggacaagtccccgaggcaagtcagagtgcggggcaagttgataaagtttgttggggagtcactgaacacattcttggagaccctagtggttttggatcaaggggagcactacacaacatattccaggttctgccacacgcatccaaacccacaagagcttgcatccaagctctgcattccaagcaaggggagcactacacaacatattccaggttctgccacacgcatccggacccacagaagcttgcatccaagctctgcattccaagatggacatggatgtgggctcgtttatctctggacagatctcacagatggcccagtccaactcttccaggctcggattccccgctcccatcactgcattgctagagaagtcgtgcctgattcacttacctttgagtcccttaggcttgccattaatttggcttacattagaaagaactgctggaacccgaatgatcccacaatcaccttttcggggacccacaagactagggttagaggacctgacatttatgctccttcctcttctaccccctctactccagcttctacatcagcaccaccagcttctattcctgcacctccagcaccctccggcacctccgctcagagcacagacgccatggtgctaatgttgtag

SEQ ID NO: 32894 - DNA, 717 bp, Glycine max
  Peptide Sequence Number=SeqID_124579
atgggtatagatgtcgcggtattaatgtgccttaaagacattaggcataacaaatttgaagattccttgataaggacggtagaaacaagcctaggacaaggtccggtctactttaattgctatccaaacaaaacaatgagtctaatgaatagaaacattcttgattctttgttcttaaagatccactttcatggccttgacatgaaagaaggatcaattccagcgacactaatctataggattcagtacaaagtcatgaatatttgtgcatcaagagtccttctaaaaccacaaagaggagagacaaccttgtttatcactgatatgacaaaggccaatgtttctctttcaagaaccataaaatgggatgaagtaactattcctaaaaaatgggtcatgaataaagccacaccatctgttcccctacccggtccaaccatagaacaaattaaacaagacaactttgggttcaaacagaaacaatccatgacaaagcaaaactgttggggaaaaggatctgaacttgctgtgcttttagccggctcaaaatctaaagaaagcctggctaagaatctcaaagaagttctccaaatgttacagcaagaagaagaaggatcttcctcaaagaaggaagaaacaagttcgtcagaagaagaagaagaccctttctaccagaacgaagatggttgttttggtatttctttgaatgatgattaa

SEQ ID NO: 32895 - DNA, 900 bp, Glycine max
  Peptide Sequence Number=SeqID_124580
atgagcaccatacaagttgtgctgggaatggttttggtgttgttaatgcatgtcttcaatgttttggcgttaaggtcaagatcaccgagaggaaagcttcataggcaagggattcatggtccttcacctcacttctacttcggcaacattccagaaatgaagacccttttgcttcaagttcagtcagctccaaccactcaagttaaagataaagatcaacatgtttctctttctcacaaatggccttttactctctttcctcacattcaaaagtcccttatacttgttttctactgggactatacagtggctaatggtgacagatataaaaatggtgaaggaaatcatcatgtatacctctttggatttagggaagcctacttatttgtccaaagatctgggaccactcttgggccaaggcatattgtcagcaagtgggcaaatttggctcatcagaggaagataattgcccctgaactataccttgataaggtgaagaaagagttaaactcaaagatatcaaagctcataaaacatcaccagaaggaaactcatgagcatgatctcttgcaaatgatacttgagggagcaaagaattgcacgggtagtagtgatggcctcttatcaaattccatgtcacatgacaggtttgtgatagataactgcaaaaatatattatttgctggacatgagaccattgcaatcacagcatcatggtgcttaatgctgttagctgcacaccaagatcggcaagattgcgcccgtgctgtggtgcttgaagtttgtggaagaggtgctctagatgcaagtatgcgtagaagcttgaaaacggtattttatacactgtatgtgctaaagctcaatgtttccatgaaatgcattagaatcattagcccttga

SEQ ID NO: 32896 - DNA, 696 bp, Glycine max
  Peptide Sequence Number=SeqID_124581
atggacttgaaagaaaattgtacttatgtcatgcacaattttaaagtgctaaaaaacaatggtcagtacagagtgtgtgatcatcaatttaaattagtgtttattggggttactgttgtgagggagtgtgttctaggggacatcccttttagaaaatacaggtttgctagatttgcagatgttgtggatggccagtttgaacgtggactattggttgatgttattggtgttgtggaggaggttttcggcaagtttcaggaaaagtttgtgaagttcttagatgattatgaaggtgatggtccaattgcagttctattaagtcattgtaggatcaaggaagcgcaaggcttgcagagttgggcattgaggcccggtcattttttaaatcccatggtgaagggagtacacaactttcaggaaattgtttgtgtcactgttggcacaattactaggattgttctggacaatcattcatggtgttatacatcttgcattcagtgccataaaaaaagtgatgcagagatgacgccctttacatgtgcatgcggcaaatacaataaggaagttgtgcttaggtataggcttgaggtgatgatcaaccagggaaatgcaagcacacaattcctgctttgggaccgtgaatgcagtgaattaattggtcaatcagctgatgcagttaataagcttaaaattgaa

SEQ ID NO: 32897 - DNA, 219 bp, Glycine max
  Peptide Sequence Number=SeqID_124582
atgtccttggcgtgctttaggccgagaccaataggaaaagccctaggtagaagaggggctagtgacgatgataatgatgcccccaccggtgaaagcttaccgcatctacccgtaggcagcaacaagaggcgcatgttaaagaaggaacatcctgagcaaaagctatcttcccacggaaggaagatgactaagttcagctggcctgctccagagatttaa

SEQ ID NO: 32898 - DNA, 861 bp, Glycine max
  Peptide Sequence Number=SeqID_124583
atgggtctttctgtctgctcatattttcttctatgtttacaacttaaggctgtggctacctctccaattggaggagaatttcttacagactgcttgatgaaaagcttggaaagcaagggtattacgataaaaccaaggtattcctttaggagaaaggaaatacgtcctggagagtttcagacagtagatcttgagtttccaaatacaactgaaagctacaaactctattgccagagggtgattgctagtgatatcaaggaatgtgtgtgtcgtgctccagatactccatatgatgagagtgcatattctaacatcccaatgacctcatatgagcttcctgatggccagacaattgaaattggagctgacagatttaagattccagatgttcttttcaatccgtccctggttcagtcaattcctggcacagagagctttgcagaaattgctccttcagttcgtggcctgcctcaaatggtgattgaaagcattaataagtgtgatgtagacattcgaagagagttgtttagtagtatactggttatgaagcatttcatatcaatgcatcatttcctgcttgctggtggcacagcttcaatgcaacagctaaaggaacgccttgagaaagacttgctagagcagtgctacagagttttcttaaatcccatgactccgaattttcactatctaattttggagggatgggagtttgggagattgagtgagtcccctcaagctgccagagtaaaagtattagccagcggaaatgctactgaaagaaggtttagtgtttggattgggggtagtatattggcatcacttggctccttccagcaaatgtggttctccaaatccgagtaa

SEQ ID NO: 32899 - DNA, 93 bp, Glycine max
  Peptide Sequence Number=SeqID_124584
atgacaattaataagtctcaaggtgatttaaggatgaagcaaggctggctctccacacccattggagttgctctcattgatccagtggtttaa

SEQ ID NO: 32900 - DNA, 402 bp, Glycine max
  Peptide Sequence Number=SeqID_124585
atggctgaaacctcgagttcggcacaggaggcagttggaaaagggggaaagttgaaaagccaaaaagcacaaacaagcaaaattcaaaaatcgatgactgagttgaacatcacaataaatgcccttcgaaagctaaacgcagggggtcactgtaggaacaccggatgctatactcaacctgcttcaatcaactatcactcctacaccggatgcacttatgtattacaattggaactggaacataccatgaagagtatggagaaactcaaggatttaatcaagcaagttgcacctataggggttccccctaatggaattcacgaatcacaattggttagacgattgttctttcgaaaaccaggtcatgtattgtcgactatcatctcagttactataatttga

SEQ ID NO: 32901 - DNA, 149 bp, Glycine max
  Peptide Sequence Number=SeqID_124586
tacttagccataagagaacgtgttaaagaaaagaaagtggtcattgaacacgtcaacactaagttgatgattgcttatcctttaactaaaggcatgccaccaaagaattttaaggaccatgtagtacgaataggacttggttccatgat

SEQ ID NO: 32902 - DNA, 219 bp, Glycine max
  Peptide Sequence Number=SeqID_124587
atggataagagtatttttcctttctcgctttacctctcaccatctatccaaaaacatcgatgtccaccctcgctttcgtctccactgcaacctccctacacggttgaaattgtcgtatcacctaacgacaacaattgtctcatcggcaacaacgcattgatgaaggcgaagaagactaacaacaccaatttggaaaaccaggactcccctctatcataa

SEQ ID NO: 32903 - DNA, 2145 bp, Glycine max
  Peptide Sequence Number=SeqID_124588
atgggaatagtttcaactaggaatgatgatgaagaggaggttaaggagtccatagatgaatatgagaaagatgaacgcttagatttggaggataatgatcctgagtatgaacctgaggagtatggtggagttgattatgatgagaaggaaattgaacaagatgagggtcatgaggtaggaaatgaagtagaggaagaagaggctgaagataatgtaggtgaagaagagggtgatacaggtgaggaagaagtcgaagatgttcatgacgaacttgagggtgaagaggagcatgagcatgctggtgaggagcgtgagcatccagactttgctgacgttgaggaagaggaacaccgagaagtcgtgaaggagaggcaaaagcggaaagaatttgaagtttttgttgggggcttggacaaggatgctactgagagtgatctgaggaaggcttttggtgaagttggggtggttacagaggtcaggttgatgatgaaccctcaaactaaaaagaacaagggatttgcattcttgcgttttgaaactgtggaacaagcaaaacgagctgtagcagagctcaaaaatccagtgattaatggcaaacaatgtggtgtgactcctagtcaggacagtgataccctctatttgggaaacatatgcaagacatggacaaaggaagctttaaaagagaagttgaagcattatggagtcaccaatgttgaggatttaactttggtagaagatactaatgatgaaggaaagaaccgtggatttgcgtttttggaatttccttctcgttctgaagctatggatgcctttaagcgactgcagaggagggatgttgtatttggagttgataagcctgcaaaagtttcttttgcagattcctttattgatccgggtgatgaaattatggcgcaggttaaaactgtgtttattgatgcattgcctccttcatgggatgaagattatgtccgggatcttctcaggaaatatggtgagattgaaaagattgagcttgccaggaacatgccagctgctcggaggaaggactacgggtttgtgacatttggctcacatgatgctgccgtaaaatgtgctgatagtattacaggcacagagttgggtgagggagacaagaaggcaaaagttagagcaaggttgtctagaccactccagagaggccgcggaaaacacattagtcgtggggactatcgttctagtcggggatctggaatgatgacgcggccttcatggagccgacctgcacctcgttcttttccttctcgtagtgtaagaggagttggaagtcgtgctccacctgtcagaccagttagtgtgagagatagacgccctatgatgtccatacctgcaagaagtaggccagtgcctcctccatctagatcttatgataggagaccagttgctcctgcatatccaaaaagtagcatgaagagagattatggtcggcgtgaggatataccacctccaagaagtagagttgctgtagattatggctcaagggttgcttctgaaagacgaacatcttacagggattatcctgctcgtggtcctggctacaccgagctccctagaagcacatctcgtgctgcaccaaggagaggctatgtggatgatgggtatggccagagatttgagagggctcctcctcctcctcctcctccccatctaagttaccgtgaaggacgtccccgagattatgatgctctgtctggctcaaaacgttcttatgctgctatagatgatgttcctccacgatatgctgatactggtgctcgccaatcaagagctcgactggactatgactatggcggtagtgcttcacagtatggagatgcttatggtgatagacttggaagatctagtatgggatatggtggtggcagcagaagttctatttccagtcaagattcacatgggttgtatagcagtcggcagggcatgagttatggaggaggttcttttggtagtggtgatgttggtggcatgtattcatcaagttatggtggtgattacatttctcgtggaagtgatgttggtggcagctcatattcatcaatgtattctggaaggggtgtgggtggtggtagcagttatatgggtggtggcggatcaggatcttattattga

SEQ ID NO: 32904 - DNA, 867 bp, Glycine max
  Peptide Sequence Number=SeqID_124589
atgggtgcaagggtttcatcattcatgaacaggggggcatcctgggctggcagagtggcattcatcggtgtggcgacaggcgtgacctcgggtgtctcctctggtgtcacctccggctctggctacggctcctgggctgtaggagcctcacctccccccgcaggagaaggttggactcctgtggaggggctagatggtgctgtgagtgctggaggggctggagcaggagctggtggtggtgctggtgctgaggtagaagctggagtagaggtggaggcatcagaaggtccccgagccctagtcttgggggtccccgaaaaggtgatcgtgggatcatctgggttccaacaattctttcgaatatatgccaaattaatggcaaggcacatagactcaaaggccatctgtgagatctggcctgagatgatggagcctaattccatgtctatcttcatcaccaacctcgccctgtccatattaagatcggacgagcttctagggtgctccctcaacattcagtacaaaacctcgccctggaatagacaatctggcggcgagctcctaagggtctgggtgcatgcggtagaaactggaggccacatctatgtggttatcaggctgcctggtcaaggctttatgccatctcctcctctcgagctacttgcggaactcgttatattgggtcacgtacaagtcaacattcctctttgggaggatgtttccggaatgcacgttctgctcataacattcctaggcgacctcggacataaatctcgtcgtgtcatatggctcttgaggtcgagaggtggatgcttttctctttctggaggccatatgtatcaaaagaatcacagggaagaaaattag

SEQ ID NO: 32905 - DNA, 585 bp, Glycine max
  Peptide Sequence Number=SeqID_124590
atggctctcttctgcataggtctaaccatattggttgattcaattatgtggaaaagttgctgtctgtggaaagggatatcattcaggatattagagttggtttaccatttagaggaggttaacttttctaagagtgatttggctggtttaattgtggatagctatgttgtttcttccattgtttctctggatgttgtgaaactttatggtgccccttcacatacttgggagttcctttgggtgacacatgctttccattggtacttcacctcagcacttcctcgttcactacttgctgcatatccactttcactaaggaagaaggataggagagagggggatcttatcatttgtagattgagcattagttcaagatttccaaccaagccacattgttttcaagattcagatttccataaaaagattgttatggtgaaacgaaaatcattcatgaaggtggttggaacaacaatggtgctggaatcttggaatgtcaacttgttgggtgagcctttagcattaaattttgttgcatctatggctgacagcttagccatggagctaaggcagaaggaatgtacttag

SEQ ID NO: 32906 - DNA, 678 bp, Glycine max
  Peptide Sequence Number=SeqID_124591
atggggcatgtgttcgactatcctctctgcgagaaatttcgtatggtgaccatctgggaagttgttgcattggtgaatatgtatgacaatctgaatgatgtgtcaaagagcacggtcaagcagcttgcaggatatatcacactttcacagtgttggatctacgagtattttccctctgttggttctgttgttgttgttgaggattatgatgagaggaaaccacgtgcctggcattggaagtctgggaaggcattaccagtatcgacttattgtaggcggttggatagattgacgtctgatgttaccattcctcaacaccatgttactccttctctctgtatagaaggcattgatgatagatggatttggttttccgaatacattgcaatagtaggtcagatatgtgtagcacctggccaatgttcgctggactacatggattggttctacttgatatctcatcccttcatgagtccgacacaacttggggatcctcctagacatccgcccatgcaacaccatgacacatttgttgaaccagatgttgctcagcatacagtggtgacaatggctatgaatgaagcacctaaagatgcacatgctgatataaagcagtctcgacatgtagtggaggcttgccaaggaatagttgaaaggttggaaaaactgctgaactga

SEQ ID NO: 32907 - DNA, 2406 bp, Glycine max
  Peptide Sequence Number=SeqID_124592
atggttacatgcaattcccatctctctagtgctcctccttcaccccttccaatctcaattcatagttttcaaaacactaatcagtaccactcccccactttgaaattcactcaatcccaaccaaaaccaaatgtgcctcacatccaacaagaacttcacatcaacctcaatgaaacacaacaactccatggccacttcatcaaaaccagttccaattgcagttatcgagtccctcttgcagcacttgaatcctattctagcaatgcagcaattcatagcttcctaataacatcttacatcaagaacaactgccctgcagatgcggcgaaaatctacgcctatatgcgtgggacagacactgaagtggacaattttgtcataccatctgttcttaaagcatgttgtcttataccttcatttctactaggacaagaggtgcatggttttgtggtgaaaaatggatttcatggggatgtttttgtgtgtaatgctttaatcatgatgtacagtgaggtaggaagcttggcattggcacgcttattgtttgataagattgagaacaaggatgttgtttcttggagcactatgattaggagctatgataggagtgggttgcttgatgaagcattggaccttttgagagatatgcatgttatgagagtgaagcctagtgaaattggaatgataagcatcactcatgtcttggcagaacttgctgatttgaaattggggaaagccatgcatgcttatgtaatgagaaatgggaagtgtggaaaatcaggagttcctctatgtactgctttgattgatatgtatgttaaatgtgaaaatttagcttatgcaagaagggtttttgatggcttgtctaaggctagtatcatttcttggactgctatgattgcagcctatattcattgcaataatttgaatgaaggtgtgagattgtttgtcaaaatgctaggagaaggtatgtttccaaatgaaattacgatgcttagtttggtcaaagaatgtggcacagcaggagctttagaattaggcaagttgttacatgctttcacattaagaaatgggtttaccttgtctttggttctggccactgcttttattgatatgtatggcaaatgtggtgatgttagaagtgcaagatctgtttttgatagcttcaagagcaaagatttaatgatgtggagtgccatgatttcatcttatgcacaaaacaattgcatagatgaggcttttgatatctttgttcacatgactggttgtggaataaggccaaatgagagaaccatggttagcctacttatgatatgtgcaaaagctggatcacttgaaatgggtaagtggatccattcttacatagacaagcaaggaattaaaggagatatgattcttaaaacatcttttgtggacatgtatgccaactgtggagacatagatacagctcatagattgtttgctgaggccacggaccgagacatttcaatgtggaatgccatgatatctggttttgcaatgcatggtcatggtgaggcagcattagaactctttgaagaaatggaagcactaggtgttacccctaatgacatcacattcattggagctcttcatgcttgtagtcactcaggattgttacaagaaggaaagaggctgtttcacaaaatggttcatgaatttgggtttaccccaaaagttgagcactatggttgtatggtggatcttcttggtagagctggattgcttgatgaagcacatgaactaattaaaagcatgccaatgaggccaaacatcgctgtatttggatcctttcttgctgcatgcaagcttcacaaaaatatcaaacttggggaatgggcagcaaaacagtttctatcattggaaccccataaaagtgggtacaatgttctaatgtctaacatatatgcatcagcaaatagatggggtgatgttgcatatataaggagagctatgaaagatgagggaatcgttaaagaaccaggtgttagctccattgaagtgaatggattacttcatgaattcataatgggagatagggaacacccagatgctaaaaaagtttacgaaatgatcgatgagatgagagaaaaactagaagatgctggatacaccccagatgtatcttgtgttctgcataacatagacaaggaaaagaaagtaagtgcactcaactatcatagtgaaaaactggcaatggcatatggactgattagcacagctcctggtgttccaattagaattgtgaagaatcttagagtttgtgatgattgtcacaatgcaaccaagttactgtccaagatttatgggagggagatcatagtgagggaccgcaatcgttttcatcactttaaagaaggatcttgttcttgttgtgattattggtaa

SEQ ID NO: 32908 - DNA, 621 bp, Glycine max
  Peptide Sequence Number=SeqID_124593
atgagcattaatgagtttgcaacttcagtttcacgtgaaaaagatgaagaaatagaaggtgcagtagttggtgtctcgctaagcgagatcaatgcacttagtgagtatcatccgctaaacgaggcatcagcacgcttagcgagtcaaggggaatctggaagagaatctgtcacgcaagcacgcactcaatgcgccatcagcttgtccagcgagtcatttgtctcttctgcgcttagtgcgccttgctcactaagtcaaaaggagtttttggaggagaaaaagagaaaggagaggagtgtgaagaacagagaacaaaagcgcaaagcagatcaaatccaagtagatgtaccctctacttgtaccacaaaggatgtaccctccaatgtgttaagacaaagatctcaggcgggaaagggaagaatcaaaagaattctcagactatgtcgttttgaattctttgacaagggagaagggagacacaaaagaattcaggcgggagaagagaatgaaaagatgaatagcacaagttttcaaggtttagaaaaccagaaaactttagaaagcttttggcacaaagaagaagaagaagttcaaagagattcaaggcttgtaaaggattga

SEQ ID NO: 32909 - DNA, 240 bp, Glycine max
  Peptide Sequence Number=SeqID_124594
atgtctcctccacctctagaaacctataaatcactcctaaacctaggtgtagaagcaaagcttcatggtgaatcaaaggtgattcaaaggtgttttgatgataacaatgacgatgacaaaggtgatgacaaaggtaatgacaaaaagctcaaaggtcaatcaaagaacaactcaagtgaatcaaagatcaatcaaagaacaactcaagtgaatcaagaacaattcaagagttcaagataa

SEQ ID NO: 32910 - DNA, 225 bp, Glycine max
  Peptide Sequence Number=SeqID_124595
atgaaggagtcaaaaggagggaatatcaggggtcatcgccattatgcgctaagcagcagaagacaaaggagaagaggtgagaggaggcgccatccactagggaataagccatggaagaaggagcttcaccaccaagatgagccttggataagaagcttggagagggtgcttcaatggaggaaaagaaagagggagaaaaagagagaggggggagcacgaaattga

SEQ ID NO: 32911 - DNA, 234 bp, Glycine max
  Peptide Sequence Number=SeqID_124596
atgaaggagcttgacaacaagaaggactttgacatcgagtatgatcccctcgtccctatcatcgtcatcgatgatgacaacattgtcgttgttgagagcaagagcttcgtgtccatgcagggctgggactctgaccccgacaacgatgtctacgatttcatagagatgtatgttactcctccagacacaaatgtttatttaattcccaaggttctcactctaatgccacaaaag

SEQ ID NO: 32912 - DNA, 180 bp, Glycine max
  Peptide Sequence Number=SeqID_124597
atggaagaagatgaaggagaatgtcttctccagcctcttagccctatttttctctgtttttcacatagcaacaacttggcaggactttggctcttggacttctcagtacacgcaagctcgctcagcgagcatgtctcgctgagtgaaactttccaatgttccattcccggattactttga

SEQ ID NO: 32913 - DNA, 345 bp, Glycine max
  Peptide Sequence Number=SeqID_124598
atggttagaacacgaggtttaagtcgtgcgttaggagctggtagaggtagaggcattagtgaggatgcgcatgaggctgatgttcctcggcgtcgcaggcctactgcttcagcacgcaggcaacgggttcgtctgcgtgaggacatcactgagagacatgaggatgtgcctcagttgcatgaggatatgacaggcgccgccgatgctgttcagacagagggagtggctactgatgggagcttggggtcacctgctgcagatgagggatttcccggtggaccacacgacccatcgattttgaccgattttgctgagcatgtcgcacacagcatctggagtggacaa

SEQ ID NO: 32914 - DNA, 2733 bp, Glycine max
  Peptide Sequence Number=SeqID_124599
atggcagagtccgaattcgaaccaaaccgagtccatgacctcgaagagaaatcgtggcacctcctcgcgctcctcttccgaatcggccacgccgtttacccgcaacgcctcgccgcgcagtgccgtttgttcgccgcctcgcctgacttcgtctgctacgtcagcactctccccggctcgccgctctccgtcaccgacaacgggctcgtcacgccctccgtcagcgccgtcttcgccctcggaagcttcttctccctccgcttctcgccgccgcagacgcaccgtttcaggaaacgcaagttgcttttcgattccgccgaagatggaagagagcgcaagaggttagcgattcgtcatggacttcgagaattttcgttccagagttttgctgatgctgcagaggctctgatgagaagcaatttccctgtaataaaatttgaatcacagaatataggtagtggaaattttgtattcctcttgcgtattgataaaaatgaagagtgttctggttgtccaatgtcaaattttgaacatcggggagccaataatgatgccagcacaaccatgtctaatggagaggtttctaaatctattatcgaagtgctgaccaaaaaaatatccattatcaaaacaagttacttgaactgtccgaagctagtggacaaaaatagattcatggaatgcaatctctttgttgtggatcccccatgcaaagagggaatagttaacaaccttggaattgggaagaaaatagattattttgacacatttacgcatgactgtgctgaacaaaacagtattcatcatgtggatgaagatggtattggtaaaagtaatacttgcaaagatcaaccaagagaaccaaatgaagatgatgaggtggaaagtggttcaaagaaagggctgattgattctggcacaaatagagtcaaggaagatgttgctcagagggtcaatgctgcactatgtggagaagcattgactaatggtttggaacaaaagaaccatgtccatgcaatgaatttggaaaaggagagtgagagaaacacagggactaagtctactaataaaatatcaaattcctcttcaactcctaagcgacctttgaaatcttctagcatattaaagggaggacagaagaatgatctccaccccaagtcacaaattcttaaagagtcattagtcagtaataaatttggtaatgttccaaaaaatgttgatcaacgtaaaaatgaacagaatcttacagcaaggaagcaaaatcataaagagaacatggctggaaatattgccactactactaaggtggagaaaagagcatatccatcatttgaagcttttacaatagaggaagaagaaggttcaggtggttatggcaccgtttaccgtgctcaaagaactactgatggaaaacgggttgcaataaaatgtcctcatactaatgctcataaaaaccatgtaaataatgaacggagtatgctcgagcgttttggtggtaaaaactatataataaggtatgagggctcttttaaaaatggcaacagcgactgctttgttttagaacatgttcaccatgatagacctgaggttttgaaaaaagaaattgatatagttcagcttcaatggtacgggtattgcatgttcagggccctttattgcttgcacaaagagggagttgttcacagagacattaaacctggaaacttccttttctctcgaaagctaagcaaaggctatcttattgattttaaccttgccatggatttaaagcagaagcacaacatcggaagtaaatctaaaccaagccatgatgcagcatccaatattgtttctttctcttctggttctgcccctctggtccgagacaagaaccttggaggcagcaagtctttaacatccaataaaagggctttggcagattataagaattattctgaacttaataggcatgtaaagcaaaaggattgtaccggtcctctgaaaaattgtcctgataaggctggtgggagttttcttagagcacaaggaacagatggctctggtgtaacttctgcgaaagatcctagcactaggactgcttctgcagagaggctcagggaacctttaccttcccatggaagaaaggagcttatcagctttgtgaataccatgaaatgtgcaaacaacagttcaacaataggcccttcttcacaaaggaaaagggttactgctccctcaagcaaggtagatggcaagatttttaatattactccgatgcctttgcattcatctactgttggtgggggattaatgagaagcaaaggtgatggaaagaaaaaagaaggttcatgtgttggaaccaaaggattccgtgctccggagaatttaaatgaaactatctttgggcaggttttgttaaggtctcagcatcagggacataagattgatatttggtcagctggagtcactctactctacatggagttacttgatgaccgatacttacagtcatgggacttagaaggctggtgcaagattcacacaaagagaccagagtttcttgagcagatcccgaaatcgctgtttgatttgatagacaagtgtctaacagttaacccaagaaataggctcagtgctgaagatgttctaaggcatgaattctttgactcactgcatgagtccctgaggaagcaaaggatgcttcatcgacatcgagctctcaggtcggatgcagcagcttccagagcaatctga

SEQ ID NO: 32915 - DNA, 195 bp, Glycine max
  Peptide Sequence Number=SeqID_124600
atgacgccaatagccaacaccttgaagaaacgatccttgaagcgacgaaacacattcgagcaaactcaaacagcttcttggaaacgctgttcagggaaacccaacctattttcctatttcaggctaaggataaaaaagaagaaggttgaagcagctggtgtctcgttaagcgaggcatatgcacttagcgagtaa

SEQ ID NO: 32916 - DNA, 183 bp, Glycine max
  Peptide Sequence Number=SeqID_124601
atgggtcatggagatgatgataacaacaataccaacaataacaatagtgatgatgatgaaggcaatggaggtagaggtcgtagaacaagaggacaacaatcacctccaaatccagtgcaacaagatgagagacctcgatgcatatctagaagaattcgttgtggaaaaatattccattattaa

SEQ ID NO: 32917 - DNA, 136 bp, Glycine max
  Peptide Sequence Number=SeqID_124602
atgtggcaccacaagacaggaggcgcagagcttccctgcacagtgctacacgtggcaccgcaagataagaggcacaccgcaagacaagaggcgcagtgcacgagggcgccctgggtagcgcccctgacgcgggcgt

SEQ ID NO: 32918 - DNA, 445 bp, Glycine max
  Peptide Sequence Number=SeqID_124603
atggagaatgtcttctccagcctctcaaccctaaatctctctgtttttcacgaagctaggctttccttgttgcccttgaccgcaagcttaggtgcactaagcgcgagaagagatagcgtcctcgctggacgggctagttgggcactaggcgcacagatctacgacttatcctcttctagggtttcccatccgctaagcaagctggatgcctcgctgagccaaattgccttgctaagcatgtcatcagcagcttttaccttctcttctttggatgaatatttccgcatctgggcatattcatcatcatctaatccagaaacaccagtcaaagatgctgaaggtgacacaccgtctctaattgtccgtccaatgggtcaaaatgcagccaaaaggaagagcaaaggaaaaggagtacgaacatctaccaatcctgtcgacctgactg

SEQ ID NO: 32919 - DNA, 315 bp, Glycine max
  Peptide Sequence Number=SeqID_124604
atggaagaacaccaacaagaacaacaccaaccaagcactctcttcacacaatatttcactctgcaaactcgaaaacacaggctaaaaattgaaggccaaacgcagtttataaacgaaagaagaagcacgaagcgccaatggcaccagcgccttcagcaggcaggaagcgccaatgggaatggcgtttccctgcacctaagctacctagccctgcaccttctgctgctgcctgacgggacaagacgggtcaaagcgccaacaccactggcgttttgcaattcatggtcaaatcgccaatccggttcttttatgtaa

SEQ ID NO: 32920 - DNA, 348 bp, Glycine max
  Peptide Sequence Number=SeqID_124605
atgattaatttgaggaagcttgttcagaggtcactgtctttagaagcacttcgcaacttggtgcctcatattgaagccttagccttatctgccatgaactcttggggtggtgatggccaagtcattaacacatttaaggaaatgaaaaagtgggatagtgatagcaattcagcaacagaacaccacataggccacattgcagaagctactaacaggccaagaagagtgagtaagaagcccacttacttgctttgtgcgaaggctccaagtgcttgtagaatcttccagagtttgttacagcattccactagtttgttggtagtgataattaactatacaacaatttga

SEQ ID NO: 32921 - DNA, 924 bp, Glycine max
  Peptide Sequence Number=SeqID_124606
atggcagaaccctcaaagaagcgcaagggttcttcaagtagaagccaacggtactccgaggcacaagatactccaattccttcctccatttcctcctcctcattgttctcatcggaagaacaacatacacggtacactaacttcttctcctctcgctctatcattgaccctaagttcatagatatgaatttcttttctgatgagagtttcaaatgcattcaagcatttcataactcaaatctcattccctttatgtctttaaaactgcttgtgtattctgaattggtaaaagccttttattataaccttgaaattcaagaaagtaccttgatttcagaggtctatgggataaagatggtcattgatcaatccctcttctatgatttgacccaattgtctagtgatggtgtaccatttgaaggtgcattggatgatgattggaagtttgatttttctgtgcatgatgcccatcggttggtctgcaccaaccaagcagatatgatcggaaggctgcttgccagttcattggctcttgaaagccgcatcctccattatctaattgtatgtatcttactccccagatcttcaaaccttgcacaggtttctgaagaagatctaatagtcatgtgggcctttcataccggccgacaaattgattgggcacatctagtccggattgtcatcatcaaaaagggggagattggggaagcaatgacttccaagattattttgatgatgccaaagaatcaagagttaagcaagttccaaagaatcaggagtcaaaaagattcaagaatcaagtttcaagattcaagattcaagaacaatcaagtttcaagaatcaagattcaagaacaatcaagatcaagattcaagactcaagattcaagaattaagagaagactcaatcaagataagaactaa

SEQ ID NO: 32922 - DNA, 486 bp, Glycine max
  Peptide Sequence Number=SeqID_124607
atgggtgccaagtacctcgaagtggtcaaacgaaagttgcatgccaccaaccaatggtccccggacgaaattaggatctctctgcatgcaactgactcgctgtctttggatgacaaaggcgcagaatttgtctatgcgcatttaccacccaacatgctgctcttgaatgataaaggtaaaaatgcgggaccaattggttcccgcatgtcatcgggcccgccgcctctggatgacaaaagtatgacagaaattgtctgcccggaagatgacgtaaatctccgcgtgtcaacggacttgttggccgcgattgacaaaggtatgacagaaattgtctgcacggaagatgacgtaaatctccgcgtgtcaccgggcttgttggccgcgattgacaaaggaaattgtggggcggccgacaaaagcgaggctcttgctcctatgtatcctcaatgtggaactcagacctacgtagttctggataacttgtga

SEQ ID NO: 32923 - DNA, 390 bp, Glycine max
  Peptide Sequence Number=SeqID_124608
atgacagaaaccgtttgtatggatacccgcttgggtatctccgtacgtcacctgacttcacgggtcaagatgacagaaacagtttgtacggataaccacttgggtatctccatatgtcacctgacttcacgggtcaggatgatagaaagcgcggaagacgatgtaagtctccgcatgtctacaggatcaacagaaatcgtttgtgaggataacaacttggttatctccgcatgtcacctgacttcacgggtcaggatgaccaaaactgtttgtacggataaccacttgggtatctccgtacgtcacctgactttacgggtcaggatgacagaaggcacggaaggcgacgtaagtctccgcatgtcaacgggttcgttggcccctgattga

SEQ ID NO: 32924 - DNA, 324 bp, Glycine max
  Peptide Sequence Number=SeqID_124609
atgtatgttcaggaagaagaaaggcttgtaatggagatggctgagagtgcattgctgacaactgcttgtgggaataacaaagcagctaagtctcaagctaatcagaaggggaatgctaaaataccacctcaagctgatattaagaaggtggcaaagtgtttcttttgcaagaagaagggacacatgaagaagaattaccccagattccaaaaatggcttgaaaagaaagatctactatccatattgcaaattctttatcagggtatgcaaaacctaaggaaactagggggaagtgagcaaagcattttatcaagcaataattaa

SEQ ID NO: 32925 - DNA, 443 bp, Glycine max
  Peptide Sequence Number=SeqID_124610
atggagcccagaggagaaatagttgcagcatcactgggaggtgtgggtagtggggtgaaaaggctatggcgtaagcctggtgaggaaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 32926 - DNA, 216 bp, Glycine max
  Peptide Sequence Number=SeqID_124611
atgaagggtgcccaagcctatgatgccatgatgcagagggttctgttcgaaccgtgtggacggagggtgaggtggcgggccagagatagagtccatccacacatgagcctttatgggttgtgtgacccgtctgcaagtccttcacataaaaagagtttggcaggaaaacaacaacagagttggtttgttggtgagtcaggaccagtgtacggatga

SEQ ID NO: 32927 - DNA, 411 bp, Glycine max
  Peptide Sequence Number=SeqID_124612
atgcatagatctcccacaggcaatttagttcctctggacttagaaattgaagctacattgcgaaggaatagggccgagaggagaaggaaacttctgcaagacagaacagttgcatccattcttgaggaggagactcatttctctgacttgttatcacctgattcaccatcatcaatggaatccgccactcaattacctgaagtcattaccatggcagaagagcatgaccaaaggattacacttgaggattactcaagtagttcaataccacaatttttcaccagcattgcacgtcctgaagtgcaagctaacaacatcaactacccacattccttaattcatttaatacagggaacttatttcaaggattacctaatggagacccctatgcacacttggcacgttcattga

SEQ ID NO: 32928 - DNA, 321 bp, Glycine max
  Peptide Sequence Number=SeqID_124613
atgaccaaacctccaccccgtgagaggactctaagggaaatggctgcacctgatttcacctacgaaagcttgtgcatccaatacccggatgaggatgtcccatatgttcttaaaactggactgatccatttgcttccaaagtttcatggccttgcaggacttagtaacatggagagaagtatgatagatgctgccagtggtggagcccttagagacatgactcctgttgaagccaaaaatttaattgagaagatggcttcaaactcccagcaatttagtgctagaagtgatgctatgtcattagaggaatgcatgaagtag

SEQ ID NO: 32929 - DNA, 384 bp, Glycine max
  Peptide Sequence Number=SeqID_124614
atgatgcccgccgcatggtctgcattgaccagcggatatgaccggcagactgcttgtcggctcaagcctcgagaagaggacttcattctgatgtgggctttcttaaccggccgtccaatcgactgggcccatttgattcgttaccacatgcataatacattgcggtctggtgcacatctaccttaccctcagctagtgactttgttgcttcgacattttgaaattccattgaattttgagcctttggtgcaagttcaacgttcctttgctattgctgccagtgcggtaacctcctttggctaccgtaaggacatggatgggaaatggttgaagaaggacgcgcaacctctgcaagacgaacgtactccctctcctttgccttaa

SEQ ID NO: 32930 - DNA, 375 bp, Glycine max
  Peptide Sequence Number=SeqID_124615
atgcgaaataacaacagttatttacttttacacagaattcaacagagaggaatgcctacacgaacccttttccttctcacttcctctaagcctaatagcaaaaaggcggagtcgccactgtgcgcagggcccttcgcgggcacgaaggcgaggtcacgggtgcctttccagaagcacttcgaggaaagagcgcggcccaagtcgccaccaacgtttatttgtgggaaacgtcggaaaaaccgaaggaaaccggtcaaaatgaaaattctaagttcgggagttgtatttacgcttgaggaaggtcgacaaagcggggcttttgctcctacgtaccctcctttggagaggaaatcagacctacgtagttcttcttaa

SEQ ID NO: 32931 - DNA, 313 bp, Glycine max
  Peptide Sequence Number=SeqID_124616
gtgcttggcacccatcattaggaaatttgtgaaattccgggacatgccgaaaaagaaaagaaatattgatgcacaatccgtaaggttccgtgacacaccggaaatcaaatggaagcatcgttgcacaattagtgaggttcctgggggtgcaaatagcacccagcccacttgggccctccagaatattcctccagaggttgttgcttctggaggaagcaaccctgctcgcctgggcgagctgggcggcaagcatctcccgtattttgatataaataggggaggaagtgaagaagaaaagggttcagccccttag

SEQ ID NO: 32932 - DNA, 219 bp, Glycine max
  Peptide Sequence Number=SeqID_124617
atggagagaatgagaaaagagaataagaagagtttgggaagaatagacatgagtaaagaagctttaagtgtgaggattgaaaatataaagcgaataagagatgacaaaccatctaatttttctcatggagatgatgatgggcatgaattggatgagggaggaaggaggaatgagaggtatagggagagaagaaatcatagaagagaaggagatagataa

SEQ ID NO: 32933 - DNA, 312 bp, Glycine max
  Peptide Sequence Number=SeqID_124618
atggctcaggagcggacatggatgtcttgtgtcttgttggaacaagtgcgaaaccaaccaaacacagagggcgggtacttctgtggtaggcctgctatgccgttccgagtctgttttatgcggtccaaacctctggctgaatccttgaccacagttgcaattctgctcaaagaggggagacacccggaggaaagatatggtttccttcccccgagaggacatcctagaatttcctcaaattcttcaatggttggtactaattggaagtccccgaatgtgaagcatctcaaggctggtcgtagtattgggtaa

SEQ ID NO: 32934 - DNA, 441 bp, Glycine max
  Peptide Sequence Number=SeqID_124619
atggatggcgccctaaacgcgtccgaattgcctatccctggagaagcgtcctcggggcaaggaccgggcccaagccccggagtaggagggcgcgagcgtcaaagagtgctgaaattgggaggggaagcccgtctgatagcgctctgtgcgctgtgtctccgaaagggaatcgggttaaacggtgagagccgggacgtggcggctgacggcaacgttggagtccggagacgtcgtgcgatggtggccccggaaagagttttctgttgtatgccctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaa

SEQ ID NO: 32935 - DNA, 324 bp, Glycine max
  Peptide Sequence Number=SeqID_124620
atgcacacacaaagtttcacaattccacaattctttaaaataggcctaactcacaaaactagtccccagtggagtcgccaactgtcgcaacgtgcccttcgcgggcgagcgagggcgaggctcacgggtgcgctttccaaaggaggaaagatgcacggagtcgccaccaacgtttatttgtggaaaagtcaggaaaaccaaaggaaactggtcaaaatgaaaattctgagtccgggagttgtatttacgcttgaggaaggtcgacaaaagcggggcttttgctcctacgtatcctccatcgaagaggaaatcagacctacgtag

SEQ ID NO: 32936 - DNA, 201 bp, Glycine max
  Peptide Sequence Number=SeqID_124621
atgatggaaggagatctcatcaaaggtcttagccaattccttgatataggctttatagggtatcagcttgggatctctagtttcccaatcccctctcagctgatggattccaacgctgagtcggctccgttcactctttggccggttggtgcacttgtccgtgatatcctatccttggcaaaccatattttcggcagatga

SEQ ID NO: 32937 - DNA, 705 bp, Glycine max
  Peptide Sequence Number=SeqID_124622
atggtggaagaatttgaagagatcataggatgtccttctagggggaaggagaccatacctcttctcagggaattagaccacagaaagcaagtcgaaaatggggtggttggaataccaagaaaatatttggaggcaaaaacaagaatcttggtaggtaaaggcgaatgggccccgttcatagacattctcgcactgttgatcttcggaggaatcctttttccaaatgtggatgggttggtggacctagcagcaatcgacgcttttctcgcctaccatgaccacaaggaaagcccggttgttgctatgctagccgacctatatgacactttcgaccgaaggtgtgagaagagcagtacaaggattgtttgttgtactctagctctttatgtatggttggtttcacacctttttcgccaagaggtgaggcatgcttgcccgctagaaagtcaccgttcatgcacagagaaaggaggcgcaaattgggaccaactcttagcaaacaaagaaggagcatctgtcaactggttccatcgatggaaagaaggaagaatcagagttcttatttcgtgtggaggatttccgaatgttcccttgatggggacgaggagttgcatcagttacaatcccgttctttctataaggcaacttggctaccctatgagaggggcaccactagaggaagagatcacgcctgtcatttcatga

SEQ ID NO: 32938 - DNA, 192 bp, Glycine max
  Peptide Sequence Number=SeqID_124623
gcatatttcttggatattcattgcaaagtaaagcatataagaacaaggaaagggaaacaaggctcaaaagggttaacaaaggaattaattcaagcatcaacaagaatcaagccaaggctattgtgcaagcagttaatggggcaagacacaccaaatgattatgatgatggatggctcatattctcacaagag

SEQ ID NO: 32939 - DNA, 433 bp, Glycine max
  Peptide Sequence Number=SeqID_124624
ggcctgggatccccgcactgatcacaggactctgccagtcgttggagtccccgttgcacctaccaaggtgattcggccgcccatcacccgagcttttattgagaagtactgtacccagagacaggctcagggtgatgctccacaggtcgcaggcgcgcccccaccccctcatcaggctagccaggctggggcatttgacatggagcagtatttacggcatttgatgagccttagcatgcagagccagggcttcgcttctttttcatgccctactccagaccagttcagggcagaggttgcatggcccggagattggcccgaggcccaagcaggagaggcacccccagaagctcccggcgacggagaagaggcccacgaggatgaggagatggccgatttgcttgacttcttgggagggagtggagatacgtga

SEQ ID NO: 32940 - DNA, 333 bp, Glycine max
  Peptide Sequence Number=SeqID_124625
atgattaaaaaggagctaaatgctttggagaatgttctaaatgacagacctctatcccaagtggaagtcactcttaagaaatctcttcaagttcaattgtgggaggcagcttatgcatatgaatctatgttgagacaaaaggctagaattaagtggctaaaagaaggggacaacaactctacttattttcacagattgatcaatcatagaagaagaaaaaaatgctattccagggttaaaaatgcagctgtcctttatttcaagacagatttttggaggattgttctaacaggccaacactggatggtgtttacttctcctctctggatctaa

SEQ ID NO: 32941 - DNA, 525 bp, Glycine max
  Peptide Sequence Number=SeqID_124626
atgtcactcgctgtggatgacatgtactggagtcgtaatgctagaaaaagggctcaccaaggatggaccttgggttttaagagccttggaggtacaactatggatgctcttgtcttgataagagaaatgcgaaaaggaagggatgttggttgtgaccctaaagggaccttcccagttggggccaagctttcctgcttgagaatcttttcttgcttcaccttggactcacaatacgaggttgccgagttgaaaggctcgtggttgaacctttgtattgtatcttttggctgctcgaagcttggcagcttcttccttaatcctcatcgtttcgcaaacttctttggtggtttcaatctccttgttgacggttccctaacttctatgaggatcatggcgtctatgccatatgcccttagacttgtcgagtctagtttgcaaggccctgaggatgactctgttagctatctcttcctgtccgttagtctaaggatgttcgacaaaggtgaccaggtgcttgatgcttag

SEQ ID NO: 32942 - DNA, 261 bp, Glycine max
  Peptide Sequence Number=SeqID_124627
atgaatgctctgaagcatagtgtcacaacctactcttcggcgggaggcgacacgaggctcacgggtgcatcatccaatgaggaaaatgcgcgagttgccaccaacgtttattcgagtggaaaacgtcggaaaaaccgaaggaaaccggtcatgaagaatattccaaattcgggagttgtatttacgtttgacgaaggtcgacaaaagcggggctcttgctcctacgtaccctccatcgaagaggaaatcagacctacgtag

SEQ ID NO: 32943 - DNA, 1008 bp, Glycine max
  Peptide Sequence Number=SeqID_124628
atggtgctggacgacgctaacaacccgttcaagctgttgccgaccgggaaaaccgtcctcatccagatgttcggtacccccatgccgggctttatgccgccgacgaaatccgtgcgcgacgcgctgatcgatctgcaggcgcaccagctggggatgatctccggtattcgcgccattattgccgcgatgctccagtcctttaacccggaacagctggaagagcaggcgaaacagaacggcatgacctctcgcctggcgctgccgggaagccgcaaagccgccctgtgggactattttgttcgcagctacggcgagacggcaggtgagatcgaggatgacttccacaccctgtttggcgaagctttccttcatgcctatgacatggaggatcagacgggagaaaccattggggaacgctcagcctgctttgtcgtctgcgacggcatcgctggcctgccgggcggggaggtggccgctgaactggcccgcaacagcattatctcccgcttcgatggcaacaaacatcttaatgcgcagcatatccgcgactacgtgcagaccgcgaatcgcaccattctcagcgaacagcaggccgtgcaggactaccgccggatgggcacaacgctggtcagcctgttcattgaccgggattatgggctggcctactgggcgcacgccggggacagccgcctgtacctgtttcgtcgcggctggctgtggcacgtcaccaccgaccacagcctggtgcagcaaatgaaagatgccgggcaccagaccgataacctgaacagcaacctgctgtatctggcgctggggattgaaaacggtgggccagaagcgagctatagcgacgtagtgcaggttgaagacggcgatgcgttcttactgtgcaccgacggcttctggcacggcgtcagcgaagagcaaatgaagcagtcgctgcatatggatacaacattgctgcacaccctctctgatgcagcacatttcttccctgcgactgattag

SEQ ID NO: 32944 - DNA, 424 bp, Glycine max
  Peptide Sequence Number=SeqID_124629
aggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatctgcacccctttgctaggcagacacagtggtccgatggcaagcagagaccaagtttggtcattctgcacccaagatacgcggagataccttacggttattgcaccctctttgctatctgtaagacagaacgcttgatagcatga

SEQ ID NO: 32945 - DNA, 348 bp, Glycine max
  Peptide Sequence Number=SeqID_124630
atggaggttttaagatggagagcggctgcgatgtcggagggtttaggggtaggctcaaaaccatggaaaggtatcttgtcaggcacagccaccgcactacgtcctaaaaggccagatgggttaaaggtaactaaaggtcctcaacttcataggtcgcttggaaatattaatgctgaacacgactactcatgccaacatagtaatattcccaagatccctccattgagcggggttatcacatgtgccacatccgaaactcactctcggaaagacactatgattataccaccatcctatcttatgtttccctcaagtccgggtgtaggacttatctcaccactcacgtaa

SEQ ID NO: 32946 - DNA, 486 bp, Glycine max
  Peptide Sequence Number=SeqID_124631
atacctacggttattcgcaccctttgtcatccagaggcggcgggcccgatgacaagcagagaccaaagaccaagtttggtcattctgcacccttgtatcatccagaggcggcgggcccgatgatacgcggagataccttacggttattcgcacccttttgtaatccagaggcggcgggcccgatgacaagcagagaccaagtttggtcattctgcacccttgtgtcatccagaggcggcgggcccgatgatacgcggagataccttacggttattcgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaa

SEQ ID NO: 32947 - DNA, 123 bp, Glycine max
  Peptide Sequence Number=SeqID_124632
atgtcggctattcagttttcaattcaatccgtgaacgaagtttgcatgatgtcggttaagtggtggctggacagaaatatagaaatgacaataactgaagctacacggctccaaatgaggtga

SEQ ID NO: 32948 - DNA, 168 bp, Glycine max
  Peptide Sequence Number=SeqID_124633
atgctccaaccatgtgggatcggcacagacttaaaggagcactcaaaccgggtgacccccaaggcctatgctccgaagagtccgtcagggcctctccctcctgactcagacgctgctcatgaattatacaatacccacgacctcacactcgtgtttaaacacgtttaa

SEQ ID NO: 32949 - DNA, 234 bp, Glycine max
  Peptide Sequence Number=SeqID_124634
atggccaccgctgaagccttggaacaagaaaccaagaaggcccgaaaggaagaacacgaccaaagcaaagtcgaaaagaaatttgtcccaacagttaaggcgagactgaaagggaatatgtgggccatcatcgatgagtgcaaagagaagctaaatctagcggcgactcacgagcaaaggctagaggatgagtatgccaagatatcagcagaaagggaagctagggaagggtga

SEQ ID NO: 32950 - DNA, 747 bp, Glycine max
  Peptide Sequence Number=SeqID_124635
ggctacacgtctcggcttcagagggctacacgtcctcacttcagaggactacacgcctcacttcagaggactacacgtcctcgccttcagagggctacacgtcctcaccatcggaggactacatgtcctcccctttagagggctatacgccctcgcctttttagggatacacgccctcaccttcagaggactacatgtcctcgccttcagagggctacacaccctcccttttagagggctatatgccctcaccttaaggactacacgtccttgccttcagagggctgcacgccctcatcttcataggattgcacacccttgccttcataggacttcatatctgcgccttgagagaactcaagttcatgggccaccccctgatattggagggcgaccaactgtgcgagcaaaaatagagagggaggctatcgtgcaactactatgcataccggggcaagatttcacccagccgctgcaaggagacgagtgtggatcatgcacaccaccacaactccgatctccccttgccgaagtgtcagttggtctgtgccgtcatgacatagggccctggggtttccagctctggttatgggcctctgtcaatcctactgggtgcccgtcccccccagcaaggtcacgccatcgtgacatagggattgcgcccgcaagacaccttgtggacccggagaagtctaacacggtcctggggtttccagctctgattacgggcctttgtcagttctacgg

SEQ ID NO: 32951 - DNA, 225 bp, Glycine max
  Peptide Sequence Number=SeqID_124636
ttggcagataggccgtcaagcagctttagtgctaacactgagaaaaatccgaaggaggaatgtaaagctgtcatgacaagaagcagaatggaaacccatgttgatgaaggaaaagctgagaagaaggtggaggaacatatacaacaactggcagctgagccgacacttgaacccattttttactttgctgaacttgaggagattttggaagatgaagatgactag

SEQ ID NO: 32952 - DNA, 664 bp, Glycine max
  Peptide Sequence Number=SeqID_124637
gtggctgcgacgtggaaatcaacatattggcaatgatgatcttagagttttccttcacaaattggatatcatgaaacgacatgagtttgtgtgggagccttacacagcaactatgatggcagcgttgcctccaatttgtgtggttggaagtgtagcatggttcgcggtgggtgaagttgtggagactttacagtatatggtgtcaccacaagggaggaacacatggacagttgatgatctcgtgccttacgtggaaaagttagcaattttatttgaagagcaaaagagaatcactgagccagtgtcacatggtccagcatcagagtgtcaatttccaacacaagagtttcacattcatcagtcaagttttgaaactcggggcataggcagacgaagagaggctgttgaagcggaagaatattcccaacaaatgatggagcatggtcatggaatgtattacacgccaacaacattttctcagtatccttcacagatgtatcagtatccttttgaaggtcatcacactgatacttctgcgagcgaacattcgttcggtggtgttgcggaaacacatcctcatttttcatggccgactatgactccttcacagcaacacgatgccccaatggcaacacctaacgccccattagctccgcaatggaat

SEQ ID NO: 32953 - DNA, 328 bp, Glycine max
  Peptide Sequence Number=SeqID_124638
atgagtcataacaacagcttccagaattgccccatgtatggtgttgcttgtcaatgttatgattcaacaagcgattctcctcaaatttcagccagcccgtatcaattagacttcacactttatgcttcggggtcatacaatgctcaatggaatcccccagggctcctccacgataagcacacgttgcgttcgagtcgtatcctcagaaaaatggaggttgaggaaccttggttgggatatgggatcaagtttagcataggacactggaactggggtgaattctacaggctttctcgctgcaaaattcacttcttggttgatgtttttg

SEQ ID NO: 32954 - DNA, 219 bp, Glycine max
  Peptide Sequence Number=SeqID_124639
atggtgaaagttggaacctcttacgtgccgatcaacgtctcattttcgccaaagttggcccagggcttcccggtgctccagtggcttctgtttttatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 32955 - DNA, 129 bp, Glycine max
  Peptide Sequence Number=SeqID_124640
atggcttacacccacattccggtgaaagttgaaaatcctgagccctacaatgctcaatggaacgccccggggcttctccgtgacaagcacacattgcgttcgagtcgtatctcggagaaatggaggtga

SEQ ID NO: 32956 - DNA, 429 bp, Glycine max
  Peptide Sequence Number=SeqID_124641
atggcggcgcagctaatccatgatcgagtagagatggagtgcctagaggagcttggagaccctcgaaggcaacatgaggtgccgatttcgggcactattcgatttacggttacttcattggtgcatccagatgaaccgacgcgtacgcttcagcgcactgtggagtggatactacccacgcctacaccatatcgtctagtggagccagtccaagtgatcgaggtgacgtcatccgaggaagaccctgaggaggatcccgaggagctacctcctgagcctgctatggatgctcttgactttctagaggacgctgaggacccacttcctgaggtggattctcccgaggaagtcatgtcgacatctgaggcagactctacggaggatagtggcccgagagagatggcgaccagtggaggctcttcatcatag

SEQ ID NO: 32957 - DNA, 252 bp, Glycine max
  Peptide Sequence Number=SeqID_124642
atggcttctatggatgattgggtgattggtaatgagaagggccgatattggctgagcaatgacattgttgggctggtggtttggccatacacttcccgtgcctacgtccagtactcaagcaacccacttgagatttccactatctttgtaaaatcctttacaacttctgaaccacacagggacaactcatcccttgtgttcaggaatccttacaactcaagagaccctcggtcccttaatcaatttcattga

SEQ ID NO: 32958 - DNA, 798 bp, Glycine max
  Peptide Sequence Number=SeqID_124643
gtcgtcgacgtacccttcgacgcccacactcacgcgccgcagaccgcgcccatcgtccgcacgccggtaccgcctgttgttgcccgcgtcccggttcagcccacccgggcgcccttgctgccgatcgtccgcacaccggtccagcctgccgtacctgttcaggtcgcaccgctccccgaagctcccgccgcggctgagccgtatcacgcagccggtgagctcgcgtcgatttcagatttcgccttctgggaagtcatggctttcgaagatggcgccgtgcctgccgcgccgcagttccagccggttccgatgccgagggtcgaggtatcgcccgagtcgatcatcgccagtttccgtgtcatggaatggcacccgcaccggcgtaccgagacggccccggtcgtcgcttcaatcgccgttgcaccagcgcccgtcgccgtggcaccgcagcctgtcgcgccagccctcgtggtcgctccgcccgtggcaaagccggttgaggccgccgctcccgcgccgcagccggtgccggtagaagcccgcatacagccgattgcaccgatcccggtccgcacgcccgccgtcgcgcccgtgacgatgccggcgccgcgtcttgccgctgcaaagcccgtagctgccaaggtcgacgcatccggctacgaattcccgccgaacgaactgctgcagcagccgcccgagcgcttgggcgagatcatgacgcaggaagcgctggaacagaatgccggcctgctggaaagcgtcctcgaagatttcggcatcaagggcgagatcatccat

SEQ ID NO: 32959 - DNA, 312 bp, Glycine max
  Peptide Sequence Number=SeqID_124644
atgctaataggtctcgaaagcaaaggtggatatcccaagatcaagaaagattcatcatcctgtgttgtgaaagttgttcagcctactttgaagatgttgaatgatgagaacttagaggcaatatgggatgctgcagttcatttgttatgtaccacaataacttcattcccattttctattcgtaatcattatgatagtctagaacttcaaactgaaatggttgaatctgctattgctttaaaacttttgtctggaggatgcagtcttgatatgtcaaaggttaatcagttttttacatcagtgttgacgtaa

SEQ ID NO: 32960 - DNA, 678 bp, Glycine max
  Peptide Sequence Number=SeqID_124645
atggctgtgagcgatggctatgcgattgcggtgaaggaagcagcttcggccggcattcacagcgtagagaaactcgtgaacatgattttgaatcaacacagagagggtggttctgaattggaagcagttgctgacgtggcggtgaaccgcttcagcgaggttatttcgctgctcgagaaaccaacaacaaccagaaccaccggtcacgctcgtttccgaagggcccctacaacggcgccacctgtccctgttgttcagttgcagcaaatggtgcatgattcaaaacacaaactacagcaacaacagaacgagacagaacaaaaacaacaaacctctgcttttaaggtttattgtccccctcctcctcctcctctgcctcagaatcaaaatcaccaagaacaaccttttattcttcctctgcataataatgaagcaaatggttctactaccaactcctatgtttcaacgttatccatggacactgagagtttgcaacggtcatgtctctcttcttcggggtttcaaatttctcacatgtcacatcaggggggttcttttgtgcgtaaaccaccgctttctacaaattctgtcaagaggaagtgcaattccacgggttttcctgataccaagtgtggatcatcctctgctcagtgccattgctacaagaaaagattttaa

SEQ ID NO: 32961 - DNA, 153 bp, Glycine max
  Peptide Sequence Number=SeqID_124646
atggcagactcaatggatgactccttaaccattgaagaaactgaggtgtgcctaaaagcaagaaactcactatggtacttggatagtggctgctctaggcatatgacaagtgacaagtccaaacttattgactttgtgtcaaaagaaggatga

SEQ ID NO: 32962 - DNA, 70 bp, Glycine max
  Peptide Sequence Number=SeqID_124647
catgttcggcattttggtgaagaaaacaccgagactatttttagtctcacagttagcaagaactacatag

SEQ ID NO: 32963 - DNA, 233 bp, Glycine max
  Peptide Sequence Number=SeqID_124648
atgaagaacgtcgaagaacggtcgaaaaccttcgcgaaatcactcacggaaacgttacggaagcgcctcggcttggattttcttcacggaactaattttcctcagcaaattcgaaagagagagaaaaaattgggggagaagcttgccacccagctcgcccaggcgagcaaggttgcttcctccagaagcaacagccttctggaggaatcttctggagggcccaagtgggcctg

SEQ ID NO: 32964 - DNA, 417 bp, Glycine max
  Peptide Sequence Number=SeqID_124649
atgaggacgcgtagccctctaaaggcgagggcgtgcagcactctgcaggcaaggatgtgcagtcctctaatggcgaggacatatggtcctctaaaggtgataggtactagtacccaagggtccacctttatgagagaacaagagaacgacccatcgagaggttgccggtcatccacaaggatgctggacacgagatgcctgcgacctgcctggggatgcagttacttcttgatgatcgattgtagggagcactgcatgcaaccttgctgtggggtgaaagtggcacgggtgaaatcttgccctggtatgcatagcaaatgcgtgatagcctccctctctggatgtgctcgcacagttggtcgccctccaatattaggggtggcccaggaactgataaaggaaactattggcccttaa

SEQ ID NO: 32965 - DNA, 381 bp, Glycine max
  Peptide Sequence Number=SeqID_124650
atgtaccctccactagaactaatccacaagagatgtaccctctcttgttctcagtcaacaacccaagtagatgtaccctctacttgtaccacaaaggatgtacctccaatggagaagggagacacaaaagaattcaggcggttagtccttcgttcttttggaaaagggagaagagaggcacaaaaagaattcaggcggttagtccttggcgaattctttttggcaaagggagaagagatgaaaagaatgaatagcacaagttttccaggtttagaaaaccagaaaactttggaaagcttttggcacaaagaagaagaagaagttcaaagagattcaaggcttgtaaaggattgtataagattgattggaaaagtgcattga

SEQ ID NO: 32966 - DNA, 183 bp, Glycine max
  Peptide Sequence Number=SeqID_124651
atgccaaaagatagggggacttgtcttgatttcaggtattgtcatcatcaaaaagggggagattgtagacaaaggatcaagctgaatgttttgatgatgccaaaggatcacatgtttctcaaagctttattcaagacaaagaaatcaaagatattcaagatggaggatcaagacagtctctag

SEQ ID NO: 32967 - DNA, 249 bp, Glycine max
  Peptide Sequence Number=SeqID_124652
atgtcttggccaagaggacacattgcttctcaaatggtcccagcctatagaataaccctggagactgatatgagttggcaagacatttatgagaagggtggtccaagagagccttacaaacttcaatggctcaatgagaaaggagagatgatagtcaatcaacaagtgaaagtgcccttctccattggaacatataaggatgaagtgatttgtgatgtagttcctatggaggaaaacaccttctcttag

SEQ ID NO: 32968 - DNA, 240 bp, Glycine max
  Peptide Sequence Number=SeqID_124653
atggccttgtttgaggaaaacctagacgaacaccgggacaagtggaccatgtggtttaatgggcctttggcgtcaaatgttctaggcaggcaattatcaacgggcgtatggtggctttgttccccgatcatgatactcacagcaggcgaggtgttcatcacagctgagagggaagggaaactagagggaccccaaaaagttgatagcatcctgaccaagcctatatcagaggagtgctga

SEQ ID NO: 32969 - DNA, 687 bp, Glycine max
  Peptide Sequence Number=SeqID_124654
atgggacccctccaaaggcaagccttctgtaaagtgtacggaaatattttagatttgaccacagaggaggtatttacggaagccgttgtatccctcgcccaatactatgaccagccgttgagatacttcacgattggggacttccatatagtaccgactgttgaagaatttgaggagattctaggatgccctcttgggggaagaaaaccgtatcttttctccgggtttcttccctcgttgagtaagattgtagctgtggtcggagattcggcgagagagttggatcgtatgaagcaaaatcgaaacagcgtagtgggcctaccgcggaaatacttggaaggcaaggcaagggatatggcgaatcaagaggagtgggtcccgtttgcagatatactagctttgctaatctttggggttgtcctctttccaaacgtggacggtttggtggacctagccgcaattgatgctttccttgcatatcaccatagcaaggagagcccggtggtagctatcatggcgaacttatttgatacatttgaccgaaggtgtgagaagaacagcgcacggattgtctgctgcttacccgctctttgtgtgtggttggtttcgcacctattccaacaagacataaggcacccgtgttccgctccaaagttattcgctcgtgcgtcgaaaaaaggagagtaa

SEQ ID NO: 32970 - DNA, 312 bp, Glycine max
  Peptide Sequence Number=SeqID_124655
atgggaactacaaagacagcagcccccaagcttccattgttgagtttttgcttcccttttcacgctttatttcactccccacaagcctatgtcgcattatggagtaatggggcatgccacattgcccccattctcttgctattcatgccaaaacatgcgcccaccaagtgctcggtgaaatgcctcaatgacatatgggcatggtttggagacatgaaggatttaaatgagtgcctgaatgcgattctaagcctaggaacccaagcttttaatttcaatacaaggaagcatgacttacgcctaggaatctaa

SEQ ID NO: 32971 - DNA, 249 bp, Glycine max
  Peptide Sequence Number=SeqID_124656
atgcatagtcggccgatgtttggttggcagttgctggtttgggagattctgagggatggcttagagtttgattatgacgctagtctttgtgtgacccaggaagaggttgatgttttcttagtggtcgaagagccagtctggtcctttgcctgtaacgatatcttcctgccccttgagaagatttccgatgaccttggagtgcattacacttttcgtaagaagtattcacggataagagtagtcaggtaa

SEQ ID NO: 32972 - DNA, 237 bp, Glycine max
  Peptide Sequence Number=SeqID_124657
atggcaataagaaggtctataagtacaagggaccgggtagaaatgttatactccagaatgaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 32973 - DNA, 255 bp, Glycine max
  Peptide Sequence Number=SeqID_124658
atgcaaaaggcaaggcatcaagctaatatcgtagaggagcatgatcaagaacaatgtatgttctatgccactcaagactcaataaaagaaaagggaggagctaagactgccaaagaagcgtggaacacattacaagaggagcttttcaaggaagattgtaagagtactgccgtcaaacttcaatctctaagaagagattttgaactattgaagagaaggacgtctgagacagttaaaggaccgactcatccatga

SEQ ID NO: 32974 - DNA, 404 bp, Glycine max
  Peptide Sequence Number=SeqID_124659
atggaaaccatatctaaaagatttgaggaacttgatgtttgtggtgaagtaactctaaagagtaaactttgggaaattgcataccctgatcaaaaatctatgtgtgttcctccgtcaaaggtcaacactaaagatgcaccgaagaaatcgatgaacaaaaaccaaagatcaacaaacaactcttcagtgaagcgtagtgcatcatcttctgaccagccgaatccaagaaggatcatgtcgatgttggatcaatttcagccatttatacacgatttcattgacaacattgtggatgtcaaagctgacagtaactttttatatcagtcgattgccactttattaggtatgggtgaagattcttggtcattggtgtgcaaccatttgcttaaagaacttgccaaatg

SEQ ID NO: 32975 - DNA, 129 bp, Glycine max
  Peptide Sequence Number=SeqID_124660
atttgcaatactgttatgattgccggtgtaccagataaagctatcagactcagcctgttctcattttcactggcaggagaggccaagaggtggctccactcattcaaaggcaacagtcctaaaatctag

SEQ ID NO: 32976 - DNA, 711 bp, Glycine max
  Peptide Sequence Number=SeqID_124661
atggctccgaagaaactctccacgaagaggtctagaagagacgctgcagcagaagggtccagtgccgcccccgtgtttgatagtcatcgtttctggagtgccgagcaccagcaacgcttcgaggccatcaaaggatggtcgttccacagggagaggcgtgttcagctcagagaggatgagtatacggactttcaggaggagatagctcgcagacgttgggcaccactggtgactcccatggccaagtttgaccctgagatagtcctagagttctatgctaatgcttggcccatagaggagggagtgcgagacatgcgttcgtgggtgattggtcagaggaacagggccgacgggttcgatgaggaagccattgcccagctgttgtgcataccggggcaggattttgcccggaccgccacagggaggcgggtgcggatcatgcacaccatcatgaccactttgacccagacatggatgacactgctgctcagcaatgtcttacctagcgatcacaactccgatctccctctgcctaagtgccagttggtgtatgccatcctgacacggatgagcgtccacgtggcccaggcaccctctggaccaagatcagtccaacagggctctagggtttctggcactgatcacgggcctctgccaggtgatgcacatcaggccgcagatgcaccgccaccacctcagctggtcgatccc

SEQ ID NO: 32977 - DNA, 1011 bp, Glycine max
  Peptide Sequence Number=SeqID_124662
atggcagaaccatcaaagaagcgcaagggttcttcaagtagaagccaacgacactccgaggctcaggatactccaattccgtcctccatttcctcatcctcattgttctcatcggaagaacaacgtatatggtacacaaacctcttctcctctcattctatcattgaccctaagttcatagacatggatttctttaaatctcattccctttatctcatagaaagtaccttgatttctgaggtctatgggataaagatggtcattgagaaatccctcttccatgatttgacccaattgtctagtgacggtgtaccatttgatgatgcactggatgatgattggaagtttgatttttctatgtctgatgctcgccgattggtttgcaccaaccaagcggatatgatcgaaaggctgcttgccggttcattggctcttgaaatccgcatccttcactatcttattgttcgtatcttactcccaagatcatcaaaccttgcacaggtttctgaagaagatcttatagtcatctgggcctttcataccagccgacaaattgattgggcacaccttgtctggtatcacatgcataaggcattgcgattaaatgctcctttaccctatccacacttagttactttgttccttcaaaattttaacatccctcttgattctgaaccatatattccaatcaagagatctttcttgatcgatgctactgtggttgcctcctttggttaccgcaaagagcgtgatggctcttgggtaaaaaagggtgctcaaccaaatgatgatgaaggacacttaccggttgaaggggactcttctctccttcagagtattttggacaggtatgatggacttcaaacctatgttggtgaaaggtttgatgctttggaacgacaagtggacacgcgattcgatgaaatggactcaaggatcacaaaggaggaagaagatgtcacaatcattcgcgactgccttgatttaccttcaccaccaccatcagtttag

SEQ ID NO: 32978 - DNA, 243 bp, Glycine max
  Peptide Sequence Number=SeqID_124663
atgacaaaggaagggtgcgggcgaccatgtgttgtctccgcgcgtcattggacttgtcgtctatggatgacgaaaggtgcggataacaataaggtgtgtccacgtgctaccagaccctcgggtcacgataacagaattgagactttttcgcggtcttggtcggaagacgctgacatctccgggaagggtgcagatgaccacattggtctctgcgtgtcaacgggcttgcttgcctctagctga

SEQ ID NO: 32979 - DNA, 724 bp, Glycine max
  Peptide Sequence Number=SeqID_124664
atggcagagccatcgaagaagagaaagggatcatcctccaccgccgctgttgctgcccatcgccgccacggaccatctgaagcatccacaacacctattcatccatctttatcatctccaagatcatccacattgttttcttccgatgataagcatctacgtcaaggtgcaccttttgagggcaccattgttgatgactggaaatttgattattctagtcatgatgctcgccgaatggtctgcaatgaccaggctgaaatgaccggtagattgctggccggatcattaacttttgataatcgcatcatgcactatatcattgttagaattttgcttccccggtcttcaaatttagcacaagcctctaaggaggatttgattctgatgtgggcttttctcaccggtcatcaaatcgactgggcccatttggttcggtaccaaatgcataaggcattacgggccaatgcacctctaccttatccacagttgataactttgtttctgcgtcattttcaaatttcgcttgatgatgagccatttattcaagtcaagcgttcctttgcaattggtgttggtgctgtgacttcctttggttaccgtaaggatcggaatggtcaatggctaaagaaagacgcactccctcctcaagatgagcgtactccttcacctcctcctcagcatgaagattcagcactcctgaatgaagtcctttccaaattacgag

SEQ ID NO: 32980 - DNA, 771 bp, Glycine max
  Peptide Sequence Number=SeqID_124665
atggaaccgattgcatccctttcccagtattatgaccagcccctaaggtgcttcacatttgaggacttccagctagtgctgactgtgaaagagttggaagaaatcctgggatgccaactgggaggaaggaagccatatcttttctttgggttctatccctccacgacaagagttgccaaggtagtgaaatctcagcacaggagttggaacgtcaagcaaaacagaaatggagtagtcggagtaccaaggaagtgttggaggaaagggcaaaggccttggaaaatcaaggcgaatgggctttcttttattgacatcttggcgtttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtaggcccgtctatccgctacaaagtcaccgctcgtgcgtcgaaaagggaaagggtaattgattcattgcaccaagagacaacaatgtggatggaccgatttgctcttactttgaacaggagtcaagaacttcccccattgctagccaaggccaaagcagtggcgaacacctactccgcccccgaggagatccacggacttctcagctattgtcagcatatgatagacttaatggaccatataattggaaaccactag

SEQ ID NO: 32981 - DNA, 402 bp, Glycine max
  Peptide Sequence Number=SeqID_124666
atggttacacaaaacaatgagagtggcaaatttttgctttgggaccgtgaatgtgctgaattgattggccaaacagctgatggtgtgaatagggtcaagattgaagatggtgatcttgatttgaatgcttcccctcaagcacttgacaaattgttgggtcatgtgcttgcttttaaggcatgttctaaaatagatccttccaatgttgattgcaatgatgctacgcatgttgaatgtcaatttctgtctgccacaactgaccatgatccggttgcgggattgcctttaacacccaaaaagcggatgtcatctgatgaagccgatgatgagttagggagctctcaaatttcgccagcccagctatcgtctaacaaattaacaagacattctcataggagctaa

SEQ ID NO: 32982 - DNA, 438 bp, Glycine max
  Peptide Sequence Number=SeqID_124667
atgtccggcaattcgcggacttcggttgcgttaaacttcaaggctgctgcgcgcgggccgatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 32983 - DNA, 924 bp, Glycine max
  Peptide Sequence Number=SeqID_124668
atggccaagtttgatccagaaatagtccttgagttttatgccaatgcttggccaacagaggagggcgtgcgtgacatgagatcctgggttaggggtcagtggatcccgttcgatgccgacgctatcggccagctcctgggatatccgttggtgttagaagagggccaggagtgcgagtatggccagaggaggaaccggtctgatgggttcgatgaggaggccatcgcccagttgctatgtataccggggcaggattttgcccggactgctgccggaagacgggtgcggatcatgcgcaccaacatgaccaccctgactcagatatggatgactctgctgctcagcaacatcctgcccaccgatcataattccgacctccccatgccgaagtgccagctggtgcaccctttggacccagatagtccaacagggcctgggatccccgcactgatcacaggactctgccagtcgttcggagtccccgttgcacctaccaaggtgattcggccgcccatcacccgggcttttattgagaagtactgtacccagagacagggtcagggtgatgctccacaggccgcaggcgcgcccccaccacctcatcaggctggccaggctggggcatttgacatggagcagtatttacggcatttggttcgccagcaggcggccaaccaccgagcacatgtacggacccatgactgtctgtaccagatgagccttagcatgcagagccagggcttcgcttctttttcatgccctactccagaccagttcagggcagaggtagcatggcccggagattggcccgaggcccaagcaggagaggcacccccagaagctcccggtgatggagaagaagcccacgaggatgaagagatggccgatttgcttgacttcttgggagggagtggagatacgtga

SEQ ID NO: 32984 - DNA, 342 bp, Glycine max
  Peptide Sequence Number=SeqID_124669
atgtctcccgaacaatttcagtacatatggcgcaagacgattccacatatcgaggtcggaatgggatcgggtgttttcacgtctcaccgtagtgcccggatttccatccagccacaggttcccctacggctaccttgttacgacttcaccccagtcgaagaccccaccgtggtatgcgccaataagaccaccaaaagcctttgtggcactagtggtacacagaagtcatgggtgatcattggtccgatgcttcggcgaaatccaatttccaagggtgtgacgggcggtgtgtacagggcccgggtacatattcactgcggcatgctgatccgcgattactag

SEQ ID NO: 32985 - DNA, 162 bp, Glycine max
  Peptide Sequence Number=SeqID_124670
atgccaaagcttggaggtattggtgttggtggtagtgatattattgacaaaagtttgaagctaaaatcagggacaaaaagaacattatggatgataaaatctggagtgaattttatgctccccgaaatgtgggattggacagtggatccattgggtaaatga

SEQ ID NO: 32986 - DNA, 252 bp, Glycine max
  Peptide Sequence Number=SeqID_124671
atgatggcacatcaaaaacccccatacttagccttttgcactcctgggcaaaatgaaacaaagaacaaaatccaaggatatcaaagagagacaaacgaaaacattcacatgtttctcaatgaacatcaaggaatgaaaggaatgggtcttttgaaggttgtaatggggccaaggacaaggtatggaaaaatatggaataagtggctgaatcccaaaggaatagaggagcaatggggaataagtgcatattaa

SEQ ID NO: 32987 - DNA, 228 bp, Glycine max
  Peptide Sequence Number=SeqID_124672
atgtggtaccatttttcagtgaaaaacctcgtcgggtgcctaggagtacatgacaggacacgcctcacaatggggagaccagtcagggtcacgctgtttgcgagaatgttccaaccatgtgggattggcacaggcttacaggagcactcaaactggatgacccccaaggcctacactccgaaaagtccgtcagggcctctccctcttgattcagtgcgcctcaagtga

SEQ ID NO: 32988 - DNA, 715 bp, Glycine max
  Peptide Sequence Number=SeqID_124673
cggagggggacggcaaagctggcagggttcattgccccggccccaaacggaaatttgaggcacgggcaattattcagtcacgaatgttcccgcgtcgcgcccaatctgggtcgatcaatcagctgggccatccccccagccccagaatagtcgctgacggcaagttcaggaacgagggcatttcgtatgatggtcatggtctcctttgctacgcagcccagtgtgggcgtaaggcctgcggcgccgacaggctcagtgtggctgcaactctttcttccgtcataccggccttgagccggatccagccagcccaagtctttgggctgaaaagagtcttcccgccgcgcggacgcgcgtcggctggattccggctcaaggccggaatgacggtggaacaccaccatgacctcacttctgcgcaagccggtcgcgacaagcggcaaggtgcacgatatcacgccccaaagcgcggattggggttatgtcggtttcggcctctaccgcctgaagccgggcgagacggcggcggaaaagaccggcgatacggaagtcatcctcgtgctggtcgaaggcaaggcgacgattccgctgatggcaaggacttcggcgaacttggcgaccgcatgaatgtgttcgagcgcaagccgccccattgcgtttatgttcccgccggctctgactggtcgctgacggccacgaccgactgcaccgtcgc

SEQ ID NO: 32989 - DNA, 282 bp, Glycine max
  Peptide Sequence Number=SeqID_124674
cgtgactcaaatgtcagtatgacagatcttgtgagcgcggaagatgacgtaaatctccgcgtgtcaacgggcttgtcgacagcaaaaaagaatgtttatacggataaccactcgggtatttccgcccgtcagcgtgactcaaatgtcagtatgacagatcttgtgagcgcggatgatgacacagcaaaaaacaatatttttacggataaccactcgggtatttccgcccgtcagcgtgactcaaatgtctgtataacagatcttgtgagcgcggaagatgac

SEQ ID NO: 32990 - DNA, 198 bp, Glycine max
  Peptide Sequence Number=SeqID_124675
atgtcggctgaaaaatatcagtcgcggctttacagcggccgatgtcggcctgtgttttctattcaatccctgaataatatttggatgatgtccattaggaaatgtgcgatcggcgccatccggaaatgttcgatcggcgtcatctggcgatgcttctttttcaacctcgatcggtcactttcctggcgagtcggctag

SEQ ID NO: 32991 - DNA, 245 bp, Glycine max
  Peptide Sequence Number=SeqID_124676
ttggacctctacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 32992 - DNA, 285 bp, Glycine max
  Peptide Sequence Number=SeqID_124677
atggaaagaaaaatagctcaaagagaactcaaagaatcaaaattagagccagagctggaggtttacaccaaagagaagatgctttcaagaagacttttgtttcaagatagcatgacatcacaattgcaattctcaccaacaaaatcatcagcacagcaaagcatacaaaaatatcaaggaaatgtatcttcgtcaccttgtacctcgatcaagtcgtacctcacctcagtatatgcaagattacgtctagcaagtccagcaaagcgactgatgagtagcaaataa

SEQ ID NO: 32993 - DNA, 606 bp, Glycine max
  Peptide Sequence Number=SeqID_124678
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataagatgtggatgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatccccgtattgctgaatag

SEQ ID NO: 32994 - DNA, 309 bp, Glycine max
  Peptide Sequence Number=SeqID_124679
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttatgaaagtgatgaagagggtataaatctgaaaaactacaaaaggttcataaaaacttttccacttccacacaaaaatgtaattctaattctatcacttgttttgactgtggaagaagaggacatggcatatcaacttgctacttcaagaaaaattacagtaacattaaaatga

SEQ ID NO: 32995 - DNA, 723 bp, Glycine max
  Peptide Sequence Number=SeqID_124680
atgggttctgtcttgatccctactgtaaacaaaccaacggagggtccgtgtcgccttcttaaaaacgtgcgttggggcatttcgctacctctagacgtcgtatctaagaaggggacaaattccccggaccctcgcattcctagattgcatctgtgtcatatgcattccatcatgcattcatctatcccacccatgagatatcggagttttgatttgcaccagcttttgtctcactttagcaagccttccgcaagacttacggaaagatctagagtgaccatagcagaggtgtccatagaagccattgcatcactcacccaatactacgaccagcctttgagatgcttcacattcggagacttccaattagtaccaaccattgaagaatttgaagaaattctaggatgtcctctcgggggaagaaaaccatatctttcctccggatgtctcccctccttgagcagaattgcaactgtggtcaaggattccgcaagaggtttggaccgcataaaacagactcggaacggcatggcgggcctaccacagaagtacctagaagacaaagcgaggggtatggccaatcaaggagaatgggtcccgtttatggatgtgttagctttgctaatttttggggtcgtcctctttccaaacgtggatggtttggtaggcctagcagcaatcgacgctttccttgcctaccaccatagcaaggaaagtccggtg

SEQ ID NO: 32996 - DNA, 277 bp, Glycine max
  Peptide Sequence Number=SeqID_124681
gttgtacattgaagaaaatcctccccccctggttgccctagaaagagtttatgagggatccacaaccgttcacaacattcctttgttgcatgatcaagtcaaggttggtgttgaggaggttagagatgcagatgctcccattcctgtacccactgaagagggagctgtgggaccagcaaaacctgtagataggctgaatcgtgatgtcgatgatcccctatatatgatgacattgaccatcccacagctttttctgaagccattgcaagttatgtga

SEQ ID NO: 32997 - DNA, 495 bp, Glycine max
  Peptide Sequence Number=SeqID_124682
atgggtgaagcagaggaggtgcaagagaagatgaaggccaacatggaggccatgaaagagaaaatggccacaatgatggaggccatgatgagcatgaagaagataatggaagccaaatgcgcacgccttcccatcatatggcttgcctcccaactatacaccacccaatgtggcatacactctcatgaaaatctcaataactccactccgatactcattgagagccaacaacctcaatctgatcatgcacatgtctctcgacccatggaggagacacatgaaattccccatcacaatctagccgacttcgagccttggctcggatatgccactgaagggcaagcagttggtggtataccctttggaaacactttggagggccctcagtttcgcccacaaccacaaccattgcatttttgcggtgggaagaaccctcatgactatggcaggaatgggaaagttggatcatctagaggaaaggctcagggccattga

SEQ ID NO: 32998 - DNA, 441 bp, Glycine max
  Peptide Sequence Number=SeqID_124683
atgacccgttccctttttccgaattcgtcatgttgtcccagcacacaccccatcgactcatctaatactgtcatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcggggtgtggggggttacgcgcagcgggaccgctacacttgccagcgctgatgtccggcgggtgctttttgccgttacgcacccaccccgtcagtag

SEQ ID NO: 32999 - DNA, 120 bp, Glycine max
  Peptide Sequence Number=SeqID_124684
atgaaacatacagcaggaagaaggttggaaactgcagtgcctgatgatgtaatggctactgctggaatcagaaacagcaacaggggaaggtctagatcaggagcaatacacaaatactaa

SEQ ID NO: 33000 - DNA, 567 bp, Glycine max
  Peptide Sequence Number=SeqID_124685
atgggccgcaaatatgcggcgcttcagggcgaaaacgaaagcgttgcggccgccatcgaagatcactacaagccgcagggtccttccgaccgcctgccggctgacaaggtggcgatcacggtcgctctcgctgacaagctcgacactctcgtcggtttctgggccatcgatgaaaagccgaccggttcgaaggaccccttcgcgctgcgccgtgcggcgctgggtgtggtgcgtattctgctcgagaagaacgtccgcctgcctttgctgagtgttgccaaggacccggaccttctctccttcttccacgaccgcctgaaggtctatctccgcgatctcggcgcgcgttacgatctgatcgacgccgtcctgacgccggaatccgacgacctgctgatgatcgcccgccgtgtcgaagcgctcaccgccttcatcaccggtgaggatggccgtaaccttctggcaggcgccaagcgcgccacccagcttctggccgcggaggagaagaaggggactgtggtggcggatggcgtttatcgaattcctgcagcccgggggatccactag

SEQ ID NO: 33001 - DNA, 300 bp, Glycine max
  Peptide Sequence Number=SeqID_124686
atggagaataatatgacatgccaatccttgtgctttattggtgcccaaaataggtattatgaggcaccaaatccctatgataggtggaataatcaacatgaaaatacagaaaaaagtgatcaaggggttcccacgaaccctaagagactaaaggtcattcctaagtggcccactccaccaagtataaggaaaatttggagcttccatgacttaataaacttttacaaaagcaccatgggaagatgcccaggaaatgggttttcagaccttaccttactccaacataccaaacaccactaa

SEQ ID NO: 33002 - DNA, 525 bp, Glycine max
  Peptide Sequence Number=SeqID_124687
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggagtctcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 33003 - DNA, 70 bp, Glycine max
  Peptide Sequence Number=SeqID_124688
ctccaccgcggtggcggccgctctagaactagtggatcccccgggctgcaggaattcgattgtaatttga

SEQ ID NO: 33004 - DNA, 267 bp, Glycine max
  Peptide Sequence Number=SeqID_124689
atgacagtagacacgttaccggtgttctactatgagaagatcgtggtgttcgccggtgaaaggatcgaagtgggtctgagaagaggaaaatttgattgtctcactttgacaagtaaaaagcctagggcaaatggacagaatgaggaggagggaggaacccacgttgtgactgtcattcctacatggccaagtttcccaccatctcaacaatgtcattactcagccaatatcatcccttctcattacccaccacccaatcatccataa

SEQ ID NO: 33005 - DNA, 1209 bp, Glycine max
  Peptide Sequence Number=SeqID_124690
ggaacaaaagctggtaccgggccccccctcgaggtcgacggtatcgataagcttgatttcggaaggagtgtgccgggttacgggaagagaatgcaattaccgcaagagcccttgaacgagagaccaagagggctcgcaaagaagagtatggccggaacaaatttcgcggagctctatggggagttgattgcttgttcaaggtctaaaagaagcttgtctcagcgtttaggcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcagctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacgcggccaccgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcctctcccgtccatgaaagagagcctcctcagcagcccgacgaagtccataaagaccctcaagattatgctcgaagggatgtcgagttctatcccccgatccccgaagggccggcaccaggcacgttgcctcaacccaacatcgcagcttcgccaatagttttgtccatggaagggccgcccccggcaactgaagaaaggaggaagctcgatctccttgaggaaagattgagggctgtggaaggatttggggactatccgtttgcagacatgactgatctttgcttagtacccgat

SEQ ID NO: 33006 - DNA, 186 bp, Glycine max
  Peptide Sequence Number=SeqID_124691
atggttggagcattctcgcaaaacatcgtgaccctgactggtctccctatgatcttacttagtgagagtgacctgacaaacccatggtgtggtgtgtcttgttatgtactcctaagcgctccagggcctcgagaatttggatcttgtgatgatcttgaacttgtgttcgtgggagcagatgaatag

SEQ ID NO: 33007 - DNA, 170 bp, Glycine max
  Peptide Sequence Number=SeqID_124692
gcaaccccggaaagagagatcgggatgatggagacttgaagaaagtcgtcagtactgaaaaggccctggcattaccatcgggaaatctaggaggacagctcgccgagcctatggtggacgtcggttgggttgtcgacgattacgaccattcaaaggcatttttccattag

SEQ ID NO: 33008 - DNA, 318 bp, Glycine max
  Peptide Sequence Number=SeqID_124693
atgccaatctccccctgcaaaagtatcagggccctggggtttccagctctgtgtcggccctacatgggtgctcccccagcaagttcatgctatcgtgacctagggattgtgcccgcaagacacctagtggaccctgaagaagtccaacagggtcttgggtttcaagctctaattacgggtctctgtcagttctacagagtacctgtcacctccagcaagggcatcaggccccctactaatcgagctttcatcaagaagtactgcgcccccagacgggcgcagggcgaaacaccacatcagcattgggatggccggtag

SEQ ID NO: 33009 - DNA, 113 bp, Glycine max
  Peptide Sequence Number=SeqID_124694
gttctacgagctacaaagttgttgctgaatgtgctaatgtaatgaatgaaatggtttcagatgatgaaggtgaaatgatgggtgctgctggtgtcactaatttggaggaatga

SEQ ID NO: 33010 - DNA, 439 bp, Glycine max
  Peptide Sequence Number=SeqID_124695
aaaactggaagaccgtaatactgatcttcatttcgcaaagcctgaacaactggggaaacttttacaatttagcataaaaggacctgatgatgaggctactcctgtaaataatttaagtgcggaaaatctttttattcctttaaatgcacctcttcaaccggggaaaagcataagactaaaactgcagtatcagatacagcttccggataaaaaatttactggatacggtacagctgatcgaaatatagctttaaaatatttctttattgttccggatcattttgatccggacaatattttaggaagatattaccatgatatcgaagagtccatgcagaaaaggcagatctcgattatctgggaattatcaccaaaaaagttcttgaccaaagtattattacagataaacaggataatcactggtttaagaatggattga

SEQ ID NO: 33011 - DNA, 387 bp, Glycine max
  Peptide Sequence Number=SeqID_124696
atgacaaaggctaatgtttctctcccaagaaccataaaatgggatgaggtaactcttcctgaaaaatgggtcatggacaaggccacaccgtcagtccctaggctagctccaaccatagaacaaatcaagcagaataactccggtaaagtagaaataaccttcaataggagaaactctttctcatctagaatagaagcctcaagatccgagtatgaatcgacaagaaggtctttctcggtaagaacccgatcaattctagtagggttatctagatctgagtcacaaaaccaatttcctagtataaaactccaaggattagatacaacttctagtatacctagaaccacatataatcaagaacaagaggatgaccaaaagtcaatctaa

SEQ ID NO: 33012 - DNA, 441 bp, Glycine max
  Peptide Sequence Number=SeqID_124697
atgggtgatcaagaggagacgcaggaacagatgaaagccgacatgtcggctctgaaagaacaaatggcctccatgatggaggccatgttaggacggggaagggacacactgggcacgatggcagccctcacctgggatacaaccgagcggcttacccttatggattgccgcccaactattcaccacccatcttgcaagaagatgcgggccacattgcttctcccgtccatgaaaaagaacctcctcagcagcccgacgaagtccataaagaccctcaagattatgctcggagggatgtcgagttttatcccccgatccccgaagggccggcaccaggcacggtgccccaacccacatcgcagcatcgccatagttttgtctatggaagggccgccccggcaacttgaagaagggagaagtcgatctctgaggaaagattga

SEQ ID NO: 33013 - DNA, 240 bp, Glycine max
  Peptide Sequence Number=SeqID_124698
atggcaccagtgactatgggattatgtactgtcattgttcagattcaatgctggttggatattgtgatgctgattgggctggaagtgcagatgacagaaaaagcacttctgcaagaagcagaactgtgtgtccctatctactgcagaagcagagtatattgcagcaggaagcagctgttcacaactagtttggatgaagcagatgctgaagggagtacaatgtcgaacaagatgtcatga

SEQ ID NO: 33014 - DNA, 516 bp, Glycine max
  Peptide Sequence Number=SeqID_124699
atgtgggcatggaaacgatgcacgactttggctccaaagaggactcctcccgtgatccaaaataagccactcggacacaggtggttgcgacgtggaaatcagcatattgggaatgatgatctaattgtatttcgtcgcaagttggatatcatgaaacgacatgagtttctgtgggagccttacacagcaactgttatgttgttgttgcctccgatatgtttggttggtagcgtagtgtggtgcacggtggtgccacaaatttgtttccatgttgttgagtggcaccaacctgatagagtgttgcgacaatttggaatgcaacaacctattccggagtgtccttcgcaaccactaaatatccatgggctaacgctgaaaggcaaacaatctgaaaattggttccagctgttggccccaatgatcagtcaatggaataatcgagctgagttaaaggtcgacgtgtatcctcgacaggagggcctattgagttttaactcccactacatgtgtgtatag

SEQ ID NO: 33015 - DNA, 309 bp, Glycine max
  Peptide Sequence Number=SeqID_124700
atgaaagataagagggatgaggaagaaaaactagaaaaacaaaagaaaaagaaggatagtaaggccttgtcttcaaaggccaaggggaaggaaaaggaggaaaaggattcctccaagaagattgttaacaaggaaaatcattttgcaacaaaaggtgatattaaaatagcactccttcttaaacaatctttctaccttctcctatcaagggaaacatcccttagcatcgccatacctcttgagcttgaggttattcctcaagtattattaggcaccaatccctatgatagtggtatgatgaatgtgtga

SEQ ID NO: 33016 - DNA, 130 bp, Glycine max
  Peptide Sequence Number=SeqID_124701
atggaatccattgatgaagaagatcctagacctacaagctccaatggagcttacatcaataagtgggagtcttccttaacaaaccttgaaatctctctgatgcttcactcagggattcatcagggaactg

SEQ ID NO: 33017 - DNA, 519 bp, Glycine max
  Peptide Sequence Number=SeqID_124702
atgatcgtcgcagttcgaccggagagggtggtacgccagttcggttacatccagagcatccctccgccgcctgttgctagtgcacgattgtcacaggatcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattacgagggatatgaggcgattgcacagaggttggagcgtgtgctcaaccttaggatagtcactgcaggcacagagttatatgacattatgcaggactgcctgacgatcgcgagagggggacccagtgctgatgggacggtcagggctcgtctgggtcgccgcacggaccattga

SEQ ID NO: 33018 - DNA, 958 bp, Glycine max
  Peptide Sequence Number=SeqID_124703
atgattcctggtcaagcccctattcctgagaaactggtccccaaaagacaacagggagtgaagatttctgaaaaccctagccttgcaacaagtcctagggaagtagacacggagatggataagaagatccgcagtattgtgagtagcattctgaaaaatgcttctgtccctgatgctgataaagatgttccaacatcttccaccccaaatgctgaagtcctctcttcatccagtaaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagcagaaagggaaaaacccccattactaggaaagaaatttcctcatctgattctgatgatgatgtcgaactagatgttcccgacatcaagagagtgcaagaaatcagggaaaaggtgcctggaaatgtccctgatgccccattggacaacatttcattccactccattggcaatgttgaaaggtggaaatttgtatatcaacgcagacttgctttagaaagagaactgggaagagatgccttagattgcaaggagatcatggacctcatcaaggctgctggactgctgaaaactgtcacccaaaaagtgtttgttagaggaaagtgtattagattctcccctgctgtaatcaacaaatacctgggcagaccaactgaaggagtggtggatattgctgtttctgagcatcaaattgccaaggaaatcactgccaagcaagtccagcattggccaaagaaagggaagctttttgcagggaagctaagtgtgaagtatgcaatcctgcataggattggcactgcaaactgggtacccaccaatcatacttccactgttgccacag

SEQ ID NO: 33019 - DNA, 518 bp, Glycine max
  Peptide Sequence Number=SeqID_124704
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaaccccccgttcagtccgaccgctgcgccttatccgaggagttagtcttgaagtcatgcgccgggttaaggctaaactgaaaggacaagtttttggtgactgcgctcctccaagccagttacctcggttcaaagagttggtagctcagagaaccttcgaaaaaccgccctgcaagggg

SEQ ID NO: 33020 - DNA, 230 bp, Glycine max
  Peptide Sequence Number=SeqID_124705
ttgagccggtccaagtgatagaggtgtcatcctctgaagaggatcttgaagacgacccagaggagttacctcctgaacctgctgtggatgcccctgacttcccagaggatgatgagaacccactccttgatgttgattcaccagaggatgttatgtcagcatctgatgcagactctatagaggagagcggccctggagggatagcgaatagtgacgactcttcatcgtag

SEQ ID NO: 33021 - DNA, 649 bp, Glycine max
  Peptide Sequence Number=SeqID_124706
atggtggcgcgtgttatgctcaggaacggatttgagcccggaatgggtctaggcaaggacggccttggaaatgccgatgtggtcgatatcaagggaaatccatacaaatatggattagggtatgaacccgggatgccggggaggaggaatgtgccgtcaagacttcgggcgaatagggtatggcccggccgtattagccagtgtttcaccagcgctggaatggtgtccgaggaggaggtggccgcaataagaaataaggagttcccttcaaggacccaccaagtgtttggcaaagccatgccattcctccgctcattccacaaggggaatgggtgtaaggccaagtatggaccaaggttgtcgctcaggaagaacttatcgacaatggaaactcaccaagttgaatggaagccgaaaacgaccactttggaaaagctgccttttagtgcgtcacgtttaaaaccgagctcgatggtggtgcgagcctttgatggtactcggcgggaagtgatgggggaaatcgacattcccatccagataggcccccacacttgcaatgtgaccttggattcatacactgggagtggtcccttcaacgcttcaccagaaattgaagttcgcagtagtggacttttagtgatagtgtcgg

SEQ ID NO: 33022 - DNA, 267 bp, Glycine max
  Peptide Sequence Number=SeqID_124707
atggagatggcactagtgaggccaacttacaacagcaagccccaagagactcagcataaggatgcacaggccaaagttgagtatgtgaaaagattgtatgaccaagtgaaggtgcaaattgcaaagaagaatgaaagctatgccaagcaagccaacaagaaaaggaaggaagtggtacttgaacccaatgatgatcctggacttttgagggcaaatgttttccaagaaggagggaatgatgagaatcctgaaactggccaaatatag

SEQ ID NO: 33023 - DNA, 724 bp, Glycine max
  Peptide Sequence Number=SeqID_124708
tgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcttttgccgcttcaattgcatttaagatatttttagaattgcctgatgttgataatccgaataaaacatcgccttctttaccgacggcttcaacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33024 - DNA, 447 bp, Glycine max
  Peptide Sequence Number=SeqID_124709
atggattattcaacggatgactcctcaaccattaaagaaattgaggaagttaaggaagcctttaatgaaatgcatcaagaagcgcaaaagcttactattttgaacaataagcttagaagcaatctaaaatgggatctcactaaattggcttcaacacaaagagaggaacaacttgaagactttggggtaaatcttaaacaacttgaagttgttgcggagaggaacaacttgaagactttgggtcgcgctaagcgaaccctgtgggctcagcgcgcatccaccgctaagcacagcttcagcgcgcttagcgtgacaaaggaatctggaagagcacaagaatcaaggccgcacactaaatgcgagatcagcttgctaagcgagatgtttgtctttagccaggctcagcgcacgactggagccaagcccaaatccacttactcgcgctaa

SEQ ID NO: 33025 - DNA, 691 bp, Glycine max
  Peptide Sequence Number=SeqID_124710
gaattcgatctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgcagatcctttacatgtaagacctatagctcatgcaatttgggatcctcattttggtcaaccggctgtagaagctttttactcgaggagttccttggcttggacagggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagg

SEQ ID NO: 33026 - DNA, 267 bp, Glycine max
  Peptide Sequence Number=SeqID_124711
atggcggagcagaaagatcgcttcccgcagactgcgctgttcaatgttaatgacgcgtttggcggctggccgcaggtgatgaaaacccacttcgccagcggcgaaacgcgttctgcccggctttggcctcagcctcggcaccagcctgctgtttacctgcctgattctgctgctgccgatcagcgcgctaatcatgcagctgtcgcagatgacgctggcgcagtactggcaggtgatcagcaatccgcaactggtggcggcgtataa

SEQ ID NO: 33027 - DNA, 225 bp, Glycine max
  Peptide Sequence Number=SeqID_124712
atggcaaaagaagatgcactttctcttgacaacattaaatgtggtgtatgtgctgagtacaccgatgctggtgtatatggaagacgaaactctggatcaaacaaggaagcgtttgaaatgggagaacgacgattacatttgtcgtggacacattctgaacggaattatgggactctcttgaatccaagtatatggcagaagatgcctcaagtaacaaattcttag

SEQ ID NO: 33028 - DNA, 456 bp, Glycine max
  Peptide Sequence Number=SeqID_124713
gaattcgattgtgcgccgagatccctcacaaggaaaggagacatgctttcttccgtcggtgctcccctcatggggagcggacatggatgtcttgtgtcttgttggaacaagtgtgaaaccaaccaaacacagagggcgggtaagcaacagatgatccgtgcgctactcctctcgcaccttcggtcaaatgtgtcaaatagatctgccaagacagctaccaccggactttcctttgctatggtggccgctatgccgttccaagtctgttttatgcggtccaaacctcttgcggaatccttgaccacagtgcaattctgctcagggaggggagacatccggaggaaagatatggttttcttcccccgagaggacatcctagaatttcttcaaattctttcaatggttggtactaattggaagtctccgaatgtgaagcatctcaaaggctggtcgtag

SEQ ID NO: 33029 - DNA, 270 bp, Glycine max
  Peptide Sequence Number=SeqID_124714
atggagtcaggtgacatgcgggggtaccgtatggttatccacacctttcgtcatctaggggcaaacgagcccattgacgcgcagcgactaacatcatattctgcaccttttgtcatcctaacccatggggtcagggtttttactctagtcgtccacagacatgcaagcccgacgatgcacaaaattcttctctgctgggcgtggggcgatcaagttcgacggcgtggggaagtgtcgtggttgtcccactttatcgctttcagacactga

SEQ ID NO: 33030 - DNA, 568 bp, Glycine max
  Peptide Sequence Number=SeqID_124715
tctttgaggtggtcagcatttctccgtggactcctctttgggcgacttgtctgtccgatgcggcggtaatgatggcccgagttatgttggggaacggttatgaacccgggatgggtttaggcaaagacaatggcggcataactagcctgataaaaacccaaggaaatcgtgggaagtatggtttaggctataagcccactcaggcggacatgaaaagaagcatcgcgggaggacagaacagtggatcagagctgccttgcgggtctgcaaaagtgctgagacgaaggtcaagtggtcgcgatatattcgaagatgatgttcaagtactttcggaggtactaatcgggacccgtcttcacgactcgccgagcaagaaagttatcggggagagatcgatctcctcagatgggtgttgtgccttctacactccaccaaaagctgaaattcgtagcggaggggcacttggtcatcgtgtcagcgaggaagatatcttggtaagctgcccatcctccatgccttatgtggaagccgcagaagaatcgttagaaccgctttccagtcttttgag

SEQ ID NO: 33031 - DNA, 360 bp, Glycine max
  Peptide Sequence Number=SeqID_124716
atgcgattagagaagaaaccatggtcgccactcctctgtgacgaactcatcgaggaaatcttgtctcgtcttcccgtgaaaccttttatccaattcaagtgtgtgtgcaagggatggaactccctgatgtcagatccctatttcatcaaattgcaccttagcaaatctgctgcgaaggacgatttggaacaccttcaactgataaaaaatgtctgtctcggatccatccctgaaatccacatggaatcgtgtgatgaaaaatgtttaggaatattggagactttgaatagaaatttgataggaaggagaattctttatggaggagagaactttgtatttttgcttgatacaaatgtgtag

SEQ ID NO: 33032 - DNA, 1152 bp, Glycine max
  Peptide Sequence Number=SeqID_124717
atgaaagcagtcaaaaatggggtggttggaataccgagaaaatgtttggaggcaaaagcaagaatcttggcaagtagaggcgaatgggccccgttcatagacattctcgcactgttgatcttcagaggagtcctctttccaaatgtggatgggttggtggatctagcagcgattgacgcttttctcgcctatcatgaccacaaggaaagcccggttgtcgctatgctagccgacctatatgacacctttgatcgaagatgtgtgaagagcagtacgaggattgtttgttgtactccagctctttatgtatggttggtttcacacctttttcaccaagaggtgaggcatgcttgcccgttagaaagccaccattcatgcacagagaaaggaggggcaaattgggaccgactcttagcaaacaaagaaggagcgtctgtcaactggttccctcaagggaaaaaaggaagaaccggggttcttatttcgtgcggaggatttccgaatgttcccttgatggggacaagggattgcatcagttacaatctcgttcttgctataaggaaacttggctaccctatgagaggggcaccactagaggaagagttcgcgcctgtcatttcacgaggtttcaataagaccaacgtggagacatttcagaaggtccgcaaggcatgggaggtgttgcaaaagaaggacaaaaaactcaggggcagtaacaatgggcccatcggtggctaccgtaagtggttgaaagcccacgtgcaaggtttggattggctcccgagattgagaaccgctaaaagggaggaagtggaggcaccggaggaagacgaagaggtgcaggcccttagggcagaactcgagcaagcccaaacagtcaaagaaagattcaaatcagcagctctgatgatccgaaaggagaatgccaaactgagagatataaatgtagctaccaccaaagccttggaacaagaaactaagagggcttgtagggaagagcacggccggaacaagttccgaggggctctgtggggcagcaacagcgagcttaagctctggagagaggaaagggaccaatcacgagtagacagtttgatcttgaaagatgagttgaaggtttgctcgaggtctaaaagaaacctgtctcagtag

SEQ ID NO: 33033 - DNA, 73 bp, Glycine max
  Peptide Sequence Number=SeqID_124718
gaatctcgcaaaggtttcaacccgttcttcgacgttcttcattcgttcttcatcgttcttcgatcttcaacgg

SEQ ID NO: 33034 - DNA, 747 bp, Glycine max
  Peptide Sequence Number=SeqID_124719
atgaggtcctgggtgaggggtcagtggatcccgtttgatgcagatgctatcagccagttcctgggataccctttagtgctgggagagggtcaggagtgcgagtacggccagaggaggaaccggcccgatgggttcgatgaggaggccatcgcccatttgctatgtataccggggcaagattttgcccgaactgctgccgggagacgggtgcggatcatgcgcaccaacatgaccaccctgactcagatctggatgactttgctgctcagcaacatccagcccagcgatcataattccgacctccccctgccaaagtgtcagctggtgtacgccatcctgacacggatgagcattcacgtggctcagttaatcgctaatgccatctatctattcgcagacgtgccgccacctcatcaggctggtccagtcagatcgtttgatacggagcagtatttgcggcatttggttcgccagcaggcggccaaccaccgggcacatgtacagacccatgattgtctttatcagatgagcctcagcctgcagagccagggctttacttcttttccgtgccctactccggaccagttcagggcagaggtcgcatggcctggagattggcctgaggcccgggcaggagaggcacctgcagaggcaccagcagaggctcccgacgaggcagatgaggcccgcgaggacgaggagatggccgatttacttgatttcttaggaggaagcggggccacatga

SEQ ID NO: 33035 - DNA, 210 bp, Glycine max
  Peptide Sequence Number=SeqID_124720
atggaggccataaaagagcaaatggccacaatgatgaaggccatgatgagcatgaaaaagataatggaagccaatgcagttatagttgccgctattagcgctgtcgctaaggtgaacccgatgctcccatctggcctcaagcaaagggaatcatccaacctcaaatatggtaccgggcaaacccccctcgaggtcgaacggtatcgataa

SEQ ID NO: 33036 - DNA, 417 bp, Glycine max
  Peptide Sequence Number=SeqID_124721
atgactgatccaggttcacttctcctgaagcttgggaaagaggacaaatcaccaaagcaggtgcgggtcagaggttatttgataaaatttgatgaagacgccctcaacacattcctgaagacccctatgatcattgaggagggggagacattactagcttactctagatttgcactcttgaggcctgatcctcaagagttggctgttaagctttgcatcccagggaggggattcgagcttaatgctgatggtcagcctctgaagatcctcaggaagaacatgaccacactcgctcaaacatggagtgttctttcttactccaacttgatccccacctcccacccttctgatatcacattggatcaggccaagttgatttatggcattattatgaagatgggcatgaatttgggctaa

SEQ ID NO: 33037 - DNA, 378 bp, Glycine max
  Peptide Sequence Number=SeqID_124722
gttttcgggaaaaaaaatcgagtggaagtgcttccggaaacgcctaccgtaagagattttgtgaaaattctttcatcgttcttcaccgttccttcgttcgttcttagtcagttctttggtcttcaaccggaagtttccttggatcaattgactaataatcaaagtgaaactaaggttaaaatcaactcaaaaatcaagctttgtccgcaaaaaatcactaaaaacctgtcatacgctaatttcgtctggggattattacttgatgacatgcaacctttgattagccgcttcgagatacttggcaccctttgttgcacaatatgtgaagtcccgagacgcgccggaaatcaaaagaaagcatggttacacaatccgtga

SEQ ID NO: 33038 - DNA, 705 bp, Glycine max
  Peptide Sequence Number=SeqID_124723
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctaactttactatcgaacttaaccaagagaactatagaggtagaaggaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33039 - DNA, 657 bp, Glycine max
  Peptide Sequence Number=SeqID_124724
atgaaggagttttacaccaacctttatgaccctgaggataaatcacctaagcaggtgagggtgagaggtcacttagtgaaacttgatgaagatactcttaatacatttctgaagacccttgtagtgttggaggagggggagaatttgtgtacatattccagatttgcactcctgaggcctgatcctcaggagttggctactaagctttgtatcccagggaggggatttgagcttaatgctgatgggcagcctttgaagattatgaggaagaacatgaacactctagctcagacatggagcgttcattccttttctaacctcattcttagctccaacacatctaatgtcaccttggatagagccaagttgatttatggtattattatgaagatggatatgaacttagggtacctcatctcccaccagatctctctgattccacaacatgatacatccaaacttggattccctgccttgatcacagctctatgcaaggccagaggagtccagtcagattctagatccctagagaacttgagccctgccattaacttggcatatattaagaaaaaatgttggaatcttgatgatccaacagtgacatatagagggccaaggaaagccaggggtaacagatcagaggtccccactacttga

SEQ ID NO: 33040 - DNA, 103 bp, Glycine max
  Peptide Sequence Number=SeqID_124725
gtcgacggtatcgataagcttgattcctcaattgcgatgaggaaatcagacctacgtagttctttcttatgcgtgaatcaagtgattgttttttacttgaaag

SEQ ID NO: 33041 - DNA, 192 bp, Glycine max
  Peptide Sequence Number=SeqID_124726
atgggatccgcgggggctctgaagtggatcccccgggctgcaggaatattgaccaaagaattctatcatttcagaattgagatttgctctctgaggattcctgaacacaagggaagggttgtccctgtgtggttcagactttgtaaaatgagttttacaaagagagtggaaaatctcaagtgggctgcttga

SEQ ID NO: 33042 - DNA, 177 bp, Glycine max
  Peptide Sequence Number=SeqID_124727
gaagtttgtgatgacattgttgagaggttggagcgtcatttgagtctaggggtggtcacgccaggctcatcgactcatgaggtgatcgaagaatgcctcaggatggccaggagtgtgacacaggaccatctagtatatgttaggtctagacgcaggcggcacacggatcagacatag

SEQ ID NO: 33043 - DNA, 773 bp, Glycine max
  Peptide Sequence Number=SeqID_124728
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagacaaagggacctacatttgcttatatttgctgactaggttcttgtgtctgtgtgaggggcagcctgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33044 - DNA, 180 bp, Glycine max
  Peptide Sequence Number=SeqID_124729
atgaaagaaagagaacagaagatcttcagaccagataaattttcagcaaggtcgttctcgactggcgatatcccaccccacatgaacgaagaggaaaagaccgaaacacccagcgtcctctccaaaaacactaccctcgagacaatcctattgatccgtgatcgtacgtgtgatctctga

SEQ ID NO: 33045 - DNA, 672 bp, Glycine max
  Peptide Sequence Number=SeqID_124730
atgcgagcacaacgagaggaggagggtatcacacagctactgtgcataccggggcaagatttcacccgtgccgctgcaaagagacgagtgcagatcatgcgcaccaacatgaccagtcttacacagatatggatgacgttgctacttagcaacattctgtccagcgaccacaatgtcgatctctccctgcggaagtatcagttgggatcgcccccacaagacacccagtggacccggaggagcccaacagggccctggggtttccagctctggttacgggcctctgttagtcctatagggtgcctatcccccacagcaaggtcatgccatcgtgacatagggatcgcgcccgcaagtcacccagtggacccgaagaagtccaacagggtcttggggtttccagctctgattacaagcctctgtcagttctacggagtgcctatcacccccagcaaggtcatcaggccccccactaaccgagctttcaacaagaattattgcacccccaggcaggcgcagggcgagacaccacagcagcctggggatggccgacagcgggcaataaacgcaccgccgccacctccagagcccttcagctcatctacaaaggctgaagcgttacctacgacccgtggccgcccaacaagcgaccaagtccaaagccaaaggtaa

SEQ ID NO: 33046 - DNA, 207 bp, Glycine max
  Peptide Sequence Number=SeqID_124731
atgttggcatctccggaaagggtgcagacgaccacattggactccgcttgtcaatcagacttggggtctccaaatgaccaggatgggatggtcgacaaaagcggggcttttgctcctacgtatcctcaattggagatgaggaactcagaccaacatagttcttgcgagcggcatgagtctaaaatagtctcagcgttctttcactaa

SEQ ID NO: 33047 - DNA, 186 bp, Glycine max
  Peptide Sequence Number=SeqID_124732
atggcaagcgatcaggaaatacaaatgatggaaactaatgctctccaagccttagctcaggttatagggaatccaaataggggagaagctggtggagctgttgagtaccaagggttggaccgcttccaacgaaacaatcctccttctttcaatggtggatacaaccctgatggtgctcaaaactag

SEQ ID NO: 33048 - DNA, 174 bp, Glycine max
  Peptide Sequence Number=SeqID_124733
atgtggaagaggataatgagggtggaattgatttcaattggtgaaatcaaaagaaaaatgaaaaagaagaagattgcaatttacgggagtcgatttgatgaagaaatgagtgagataggaaggtttggaggtttgggaatggaggaacgtcgcaaggaggaaggggctgcgtag

SEQ ID NO: 33049 - DNA, 324 bp, Glycine max
  Peptide Sequence Number=SeqID_124734
atggtttttctcttaaggcttgtagtgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggacgcatcaacaagaatcaagccaaggctattgtgcaagcaatcaatggggcaagcacaccaatgaatatgatgatggatggctcaattctcacaaagagagaatcaaggattcaagtcacaaaatgtcaagaactttatttcaaacaattacccatttcttga

SEQ ID NO: 33050 - DNA, 770 bp, Glycine max
  Peptide Sequence Number=SeqID_124735
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgcgtaatctcttgctctgaaaacgaaaaaaccgccttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33051 - DNA, 845 bp, Glycine max
  Peptide Sequence Number=SeqID_124736
agcagcgcaagaattgtttgttgtgcactggctctctatgtgtggctggtttcacacctttttctccaagaaggtaggcccgtctatccgctacaaggaaggaagaatcaggattctatcttcatgcgaaggatgtccaaatgttcccttgatgggaacaaggggttgcattaattataatcccgtcctcgccataagacagcttggctaccccatgagaggagtgccatcagacgaaagcatcacgtctttcatcgcacggggtttcagtgaccacaacgcgagggacagagagcttaggggaagcagtaatgggatcatcggcggctatcataagtggctgagagtccggacacaaggattggattggctcccaaatctaaagactgtgagagacaatgaggttaaagcttcggaagaaagtgatgaggtacaagccctaaaggcaaagcttgaaagagcccgggtagtcaaagagaagttcaaggcagcaatagtgagctcaagctctgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttccccgattgctagccaaggccaaagcaatggcggacacctactccgcccccaagaagatccacggacttctcagctatt

SEQ ID NO: 33052 - DNA, 240 bp, Glycine max
  Peptide Sequence Number=SeqID_124737
atgtcatcggactcgccgtctctggatgacaaaggtgcggaagaaaaccgaaagagtgtttatatggataaccacttgggtatctccgcctgtcacctaacttcacgcgtcaggattaatagaaatcgtttatgcggacaaccgcttgggtatctccacatgtcatcagactcacaggtcacgatggcaaaaggtggggtgatcgacaaaagcggggcttttgctcctacgtatccttaa

SEQ ID NO: 33053 - DNA, 204 bp, Glycine max
  Peptide Sequence Number=SeqID_124738
ctccaccgcggtggcggccgctctagaactagtggatcccccgggctgcaggaattcgatccttcttcgggtccactagggccgacagaggcccgtaaccagagctggaaaccccagggccctgttggacttcttcaggtccactgggtgtctttgtggggggagattggcattgcggtcgctgggcagaatgttgctaagtag

SEQ ID NO: 33054 - DNA, 519 bp, Glycine max
  Peptide Sequence Number=SeqID_124739
tgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaggatccgaccggggggggcgcacggctgtagaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 33055 - DNA, 300 bp, Glycine max
  Peptide Sequence Number=SeqID_124740
atggcggcaggaaaatatcagtcgcgactttacaacgaccgatgtcgtatcggtgaatcaagttttcatccgaggtgggctaatgttttcgttagtgaacaaatgaaagcatgccggtgtcggtcaaacctgatgagaatcatgaaacaggccaaatacagtctaaaggcccaagtggagaaggacgaaggcccaagtggagaaggacaaagcccccgagtggagaaggatgaaggcccaagtggagaaggacgaaggcccaagtggagaaggacaaagcccccaagtggagaaggatga

SEQ ID NO: 33056 - DNA, 207 bp, Glycine max
  Peptide Sequence Number=SeqID_124741
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctatcaagcttatcgataccgtcgacctcgagggggggcccg

SEQ ID NO: 33057 - DNA, 546 bp, Glycine max
  Peptide Sequence Number=SeqID_124742
atgcccatgccgtctcttcaacacccgcatgggtcaaaccccagcaaacacctcatgcctaaggcacccacccagagggaagccccccaagttccaactccgaacacggctcgaccggccggtaattccaacacgacaaggaacttccctccaaggccattgccggaattcaccccgctcccgatgacgtacgaagatcttctaccatccctcatcgccaatcatggagggggagcagttaatgcagttgaatccgatgggccccacgggtctaaaccgttgagagatgtggcaacccctaggaggtttatctttgaggccctacaaaagggaggtgtaattccccatagtgggtgtaaggaggattcctgtctgctacatcccggcaagatgcatgacatggagacgtgtttggaagtagaggaattgttacaacggatgatagaccaaggtcgactagaagtcggcattaaaggaaaagaagagccgcatatatgcatgcaatctacggaggggagcggtgttgcgaagcccaaaccttggtga

SEQ ID NO: 33058 - DNA, 293 bp, Glycine max
  Peptide Sequence Number=SeqID_124743
ccctcactaaagggacaaaagctggtaccgggccccccctcgaggtcgacggtatcgataagcttgatatttgcagtcattcggggttcattgagaagtattgcacgcctaggcaggcgcagggcgatgcaccagaggtcgcggacgcaccaccaccacctcatcaggctgatcctactgggtcattaggcatggagcggtatctacaacacttggtttgccagcaggcggccaaccaccgagggcaggtgcagatacatgactgtctctaccagctcagcctcagtcagtag

SEQ ID NO: 33059 - DNA, 99 bp, Glycine max
  Peptide Sequence Number=SeqID_124744
gaattcgatcgttccattgagcattgtagggctctgaagcgtaaggtgcaaggtctaattgatgcgggctggctgaaatttgaggagaattgcgtgtaa

SEQ ID NO: 33060 - DNA, 232 bp, Glycine max
  Peptide Sequence Number=SeqID_124745
gaattcgattccctatatgccctatctattgttcatgccttctttacatgttgggtggatcagatcccctttcaactctcattatgggaaggaggcccagatggtgtgggggttaacctccccagcacaggattgtctgatttctcaaagcagaagcggattcgttgaggatctttggtcagagcctgatatcatagctagccttcctccgtcgactagcgtattccactag

SEQ ID NO: 33061 - DNA, 409 bp, Glycine max
  Peptide Sequence Number=SeqID_124746
ctccaccgcggtggcggccgctctagaactagtggatcccccgggctgcaggaattcgatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccg

SEQ ID NO: 33062 - DNA, 861 bp, Glycine max
  Peptide Sequence Number=SeqID_124747
atggggacaaatcaaaatggcaaaaggttttatcaagtcaaggttaaaagtctagatgtcactagcctcgaggaattgggacgattgatgggacctctccaaaggcaagctttccgcaaagtgtacgggaagattttagatttgaccgcagcggaggtatttacggaagctgtcgtatccctcgcccaatactatgaccagtcgttgaggtgtttcacgtttggggacttccaaatggtaccgactattgaagagtttgaggaaatatttggatgccctcttggggggagaaaaccgtatcttttttcgggttttcttccttccttgagcaagattgcagctgtggttggagattcagcaaaagagttggatcgcatgaagcaaactcggaacggcgtagtgggcctgcctcggaaatacttggaaggcaaggcaagggatatggcgaagccaagagaagtgggggccccgccattgacgctttcctcgcgtatcaccattgcaaggagagtccagtggtggccatcttggcagatttgtttgatacctttgaccggagatgtgagaaaaatagtgcacggattgtctgttgtttacccgctctctttgtgtggttggtttcacacctattccgacaagacacaagacacccatgtccgcttcaaagctatcgctcatgcgccgaaaaaggaagagtcgattggggaccagcatttggctggaataggaggcaacgcaatcaattggtttcctcgttggaaggaaggcaaggaaggagttctcttctcgtgtggggactaccctaatgttccattgatagggactaggggtgtattaattataatcccgcactcgccataa

SEQ ID NO: 33063 - DNA, 195 bp, Glycine max
  Peptide Sequence Number=SeqID_124748
atgaagacatcttggttgagctgcccatcctctatgccttatgtggaagccgcagaggaatcgttagaaaccgctttccagtcttttgaggtgccttgcgtgtgcgatgcagcagtaatgatggcccgagttatgttggggaacggttacgaacccgtgaatgggtttaggcaaagacaacggcggcataactag

SEQ ID NO: 33064 - DNA, 708 bp, Glycine max
  Peptide Sequence Number=SeqID_124749
atggttggtttcacacctttttcgccaagaggtgaggcatgcctgcccgttagaaagccaccgttcatgcacagagaaaggaagggcgaattgggaccaactcttagcaaacagagaagagcatctgtcaactggttccctcgatggaaagaagaagaacggagttttatctcgtgtggaggatttccgaatgttcccttgatggggacaaggggttgcatcaattacaatcccattcttgcgataaggcaacttggctacccgaagagaaaggcaccactagaggaagatctcgcacctgtcatttcacgagggttcagtaagaccaacgtggagacgcttcggaaggtccgaaaagcatgggaagtggtacaaaagaaggataaagagctcagaggcagtaacaatgggcccattggtggctaccgtgagtggttgaaagcccacgtgcaaggtttggattggctcccaagtctgagaaccgctaaaagggaggaagttaaggcatcagaggaagaggaagaggtgcaggctcttaggacagaactcgagcaagctcaaacagtcaaagaaaggttcaaatcagtggctcttagaatccgaaaggagaatgccgaactgagggatgaatatgtagctaccaccaaggccttggaacaagagaccaagaggcctcgtagggaagagcatggccgaaacaagttatga

SEQ ID NO: 33065 - DNA, 751 bp, Glycine max
  Peptide Sequence Number=SeqID_124750
atggatgttggatggctgacattccaagaggatcggtccaatgtgaaaaccaacccgctcgccaatcatggagggggagcggttaatgccattgggtcagataggccgcgtaggtctaaacctttaaaggacgtggcaacccctaggaggtttatctttgaggccctacaaaagggaggtgtgattccccatggcgggcataaagaggactctgatttgttgcatcccggcgagctacatagcatggaaacatgtttggcagtagagggattgttgcagcgaatgatagatcaaggccgactggaagtcggtgatgagggaagagaagagcagcagatatggatgcagtccgtggatgagagaagttttggaaggcctaaacctttggtgatatatttcaccaagggcgcagcttcgcaaaagccccaacacccctcggcagctaaacctgtccctttcccataccaaaaccgccacgcagtcccatggaggtacacacctccgaacaaagaaggagaagaagccaccgacatcaattcgttgttggccaaggtaaccaatatcacggggctgagcggtgtgacccacagtggtcgtgtatttgtgcccctcgatctaccaattcagcccacgaaaatcaaggggaaggcaaaggtagtggaagaacaagatgataaaatgcccctcactccgaataaggatactccggtgatcaagcttatcgataccgtcgacctcgagggggggcccg

SEQ ID NO: 33066 - DNA, 528 bp, Glycine max
  Peptide Sequence Number=SeqID_124751
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaagttcttctgccaccttgtgctgatgaggtagccattgttgccttggcttctcttccttactcctactgtcaagcattctgcattgttgatgcagtgctcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 33067 - DNA, 873 bp, Glycine max
  Peptide Sequence Number=SeqID_124752
atgttccaacatcttccaccccaaatgctgaagtcctctcttcatccagtaaagaggaatcaacagaggaagaggatcaagccacagaggagacccctacaccaagggcaccagaacctgctccaggtgacctcattgacctagaagaagtagaatctgatgaggaacccattgccaacaagttggcacctggcattgcagaaagattacaaagcagaaaggggaaaacccccattactaggtctggacgaatcaaaactatggcacagaagaagagcacaccaatcactcctaccacatccagatggagcaaagttgcaattccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgttgaaagagatcatggacctcatcaagctgctggactgctgaaaactgtcaccaagttggagattgctatgaagtctagtcagggaatcttgcacattccctctgacatacaaacagaaagagtgatgatatcagaagtgttgtcgagaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccactgttgccacag

SEQ ID NO: 33068 - DNA, 287 bp, Glycine max
  Peptide Sequence Number=SeqID_124753
gctgttgcttctggaggaagcaaccttgctcgcctgggcgagctgggcggcaagcttctcccctattttgctataaatagggggagaagtgaagaagaaaagggttcagccttcttggcacttctctctctctcgaaattactgagaaaaattatttccgtgaagaaaatccaagccgaagcgcttccgtcacgttttcgtaacgtttccgtgagtaattacgcgaagattatcgaccgttcttcaacattcatcgttcgttcttcgttttcttcagtcttcaacgg

SEQ ID NO: 33069 - DNA, 444 bp, Glycine max
  Peptide Sequence Number=SeqID_124754
tggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaaggggaagcaaggggaaagggagtcaagaacttcccccattgctagccaaggccaaagcagtggcggacacctactccgcccccgaggagatccacggacttctcagctat

SEQ ID NO: 33070 - DNA, 255 bp, Glycine max
  Peptide Sequence Number=SeqID_124755
atggggatatcaatttcccccatcacctctcgccgactaccgttgaaagctcgcactaccatcgaactcggttttagatgtgatgcattaaaaagaagcttctccaaggtggtcattggcatcacatttaaacttgaaccattatcgatgagtaccttagcgacgacatggtccatgcatctaacagacacatgtagagctttgttgtgccctctcccctcaactggaatctcctcctccgtgaacgtgagttag

SEQ ID NO: 33071 - DNA, 687 bp, Glycine max
  Peptide Sequence Number=SeqID_124756
atgaagggatggccattcctcagagagaggcaggtccagttgagggacgatgagttccctgattttcaggaggagataggctgcaggcgttgggcgccactcgtgacacccatggttaaattcgacccggagatagtcatggagttttatgccaatgcctggcctaccgaggagggagctcggtatatgcgttcctgggtctctagttttgatgaagaggccatcgctcagctattatgcacaccggtgaaggatttcgctcagaccgcagtagggagacaggtgtggatcatgcgcaccagcatgaccacccttacccagatatggatgacattgctgctcagcaacatcttgcctagtgaccacaactctgacctccctctgctgaagtatcaattggtgtatgccatcctgacacaggtgagtgttcacgtggctcagctgatttctgataccatttatcagtttgcagggacggtgcctacgagacaccctatggactcggagaggtccaacaggatcctgggattcccagctctgatcgcgggcctctgccagttctacggagtgcccgtcgccaccagcaaggtcattcagcctcccattaccagagccttcatcgagaagtactgcatccctaggcaggcgcagggccaagcaccacaggagcccgaggaggatcagtag

SEQ ID NO: 33072 - DNA, 416 bp, Glycine max
  Peptide Sequence Number=SeqID_124757
tgctccagtggcttctgtttctatcagctgtccctccctgttcagctactgacggggtggtgcgtaacggcaaaaagcaccgccggacatcagcgctggcaaggcgcgtcccattcgccattcaggctgcgcaactgttgggaagggcgatcggtgcgggcctcttcgctattacgccagctggcgaaagggggatgtgctgcaaggcgattaagttggggcatcaagcttatcgataccgtcgacctcgagggggggcccggtaccagcttttgttccctttagtgagggttaatttcgagcttggcgtaatcatggtcatagctgtttcctcggagtgtatactggcttactatgttgacactgatgagggtgtcagtgaagtgcttcatgtggcagagaaaaaggctgcaccg

SEQ ID NO: 33073 - DNA, 162 bp, Glycine max
  Peptide Sequence Number=SeqID_124758
atgaagcatccaaatgataagaaagcttgctttgatctggacaaggtagatcaggaaatagaactagctgctatagccatgctcgttgaagaaaacagaagaggatcagctggtgcagattttgaagagacacaaaattgcaattggatggcacatatctga

SEQ ID NO: 33074 - DNA, 659 bp, Glycine max
  Peptide Sequence Number=SeqID_124759
atggtgaaagttggaactctacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagacgatttcttattgcttgttaacatccttttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 33075 - DNA, 225 bp, Glycine max
  Peptide Sequence Number=SeqID_124760
gaattcgatccggtagggggccttccgcatgaaagcgaaaggaagcgaccgaccaagaaatcatacatgcaaaaagagaaagggaatggttatgcagctagaattggagttgctacaaacttgactgctgaactctgggcttgggctgtccgtactggtctccggattgccttggctcgaagcttcgaaaagggatattcgaaaaaaaaagatagggcagactaa

SEQ ID NO: 33076 - DNA, 57 bp, Glycine max
  Peptide Sequence Number=SeqID_124761
gaattcgataactcttctcctatttgtgaaaggtactcccttgaaatggagggctag

SEQ ID NO: 33077 - DNA, 556 bp, Glycine max
  Peptide Sequence Number=SeqID_124762
atggctttacatgtgtcggtcaaatacatggaacacgttatggccaaagtactcatcgacaacagctcaagccttaacatgatgcccaagagcacattggagaagttgccattcaatgcctcccacctgaggctgagttccatggtggttcgtgcctttgacggtgaggaagatgtcctggtaagttgttcttcctctatgccgtatgtgaaagccgcggaggagttgttggaaatgactttccaatcttttgaggtagtgagcatcgcttccgtagattctctccctaggcagccccgcctgtctggtgtggcaatgatggtggcctgggtgatgttggggcacggctacgagcccgaaatgggtttgggcaaaaacaatggcggcagggccggcctagtaaaggtcagaggaaaccacgggaaatttggtttgagctataaacctacgcaggttgatgtaaggaaaaacatctcggaaaggaagaacaaaggccaaagcccgcggtcgggacagatcaagcttatcgataccgtcgacctcgagggggggcccg

SEQ ID NO: 33078 - DNA, 798 bp, Glycine max
  Peptide Sequence Number=SeqID_124763
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaccagtactgcgatgagtggcagggcggggcgtggctgctgccagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 33079 - DNA, 798 bp, Glycine max
  Peptide Sequence Number=SeqID_124764
ctccaccgcggtggcggccgctctagaactagtggatcccccgggctgcaggaattcgatccttgtgaggaatctaggcgcacaaagtctcaaggcgatacaaagagtccacaaggcgtggagaagcccattgaggaaagacaaggagcttaggggcatccgtaatggcgtcatcggaggttatcatggatggctaagaattcacacgcgggggttagattggctctccaagttgaaagttatcgatgaggaggactttgaagctccggaggaagatgaagaagtccgagctctaaaattagagttagggaaggcaagactcgccaagcagaagttcaagtcagctgctacacacatccggaaagagtgcaccgagttacaagaggaaaacgcggccactgcaaaagcccttgaacaagaaaccaaaagggcccgaaaggaggaatatggtcgagagaaattccgaggagcattgtccaaaaggagtttggttcaacacttggaagccacggagcaaagcatgctagctatcatagggcaatacaaggaagaattgaaccagtctgtggcccatgaacaaaagctagtggaggattttgcacgagtgtatgccaaaaaagaagcaagagggagggtgattgatgcgttgcatcagaagcgactatgtggatggatagtaggggtgtggatagataaggatctagcttctcaaagaagcttgttgagaaatcttctcaaagaagccacgaggaagcctcttaatgaagcttctagagaaagctacatggagctgcctcg

SEQ ID NO: 33080 - DNA, 393 bp, Glycine max
  Peptide Sequence Number=SeqID_124765
atgtgttcttcaccgtcaagagcggaccctcttgactgggaaatgttatctttgttattttcccgattggattcctccattctccaatgtgttcttcaccgtcaagagctgtcataccctaatttcgtccggggacctttgctcgatgacgtgcgaccattctttggtcctcgtgagaaggcggttgcttctggaggaagcaaccctgctcgcctgggcgagctgggcggcaaccacctcccctattttgctataaataggggaggaaatgaagaaggaagggccgaggcgcttccgaaacgtttccgtaacgttttccgtgaggaatctcgcaaaggtttcaaccgttcttcgacgttcttcattcgttcttcatcgttcttcgatcttcaa

SEQ ID NO: 33081 - DNA, 132 bp, Glycine max
  Peptide Sequence Number=SeqID_124766
atggttcagctaagcacacatcactacgataagcctaacatcttcactaaagtgctaagtgccacctgtcgcgctaagccccaaatgcttacgggattttacaacttcaagttgggcttagcgcgatgctag

SEQ ID NO: 33082 - DNA, 489 bp, Glycine max
  Peptide Sequence Number=SeqID_124767
atgttggtgcgcatgatccgcactcgtctttttgcagcggcacgggggaaatcttgccccgtcgccctccaatgtcaggatgtggcccaggaactgataaaaggaaactactggccccttaaccgggagcgcaagtctcgcacactgaaaacgaggacgcgtagccctctaaaggcgagggcgtgcagccctctgcaggcgaggatgtgcagtcctctgatggcgaggacatatagtcctctaaaggtgataggtactagtacccaagggtccacctttatcatgagggccggtgtagttgtgggtgatactgagggccttccaaagggttttgtaggggtataccaccaactgcttgcccttcagtggcatatccgagccaaggctcgaagtcggctagattgtgatggggaatttcatgtgtctcccccacggtttaagagacatgtgcatgatcagtttggggttgttggctctcaatgggtatag

SEQ ID NO: 33083 - DNA, 393 bp, Glycine max
  Peptide Sequence Number=SeqID_124768
ctctctggtcttgacccacggcgagctttttctctcgtaatgccccgtaggcctctctcgggtgacctaagcatttggtacttcgatcttttattaggttggcgccaggttcgtattcaaaccttctttccaaatcagtccttgttcatttcattcgtggtgctcttggcacaatggtctaatctggaggagggaagttggatgtttttctctatttatcatcactacgggccatatggccagatcgacgttgtcagaataatagtgtgcccctttgaaaaggatgaatgccccacccatgtgatatctgctaaaggcttcgtcagtgaggtgagaatttcagccctatctctccttcggggttcaacctccttaagcggtcagcgggcataa

SEQ ID NO: 33084 - DNA, 822 bp, Glycine max
  Peptide Sequence Number=SeqID_124769
atggcagagccatcaaagaagagaaagggatcatcctccaccgctgctgctgctgcccatcgccgccacggcccatccggagcacccacagcaccttttcctccttctttgtcatctccaagatcatcaacattgttttcatccgatgatcaacgtctacagtacctttctcagttttcttctagaataatcttagaccctaagtacctagacgtagaattctttaatgatgaaacgtttgattgctatcaagtgtttcaaaattctggtcttgttgaattcatgtcattaaaattgccatattatcctgaacttgtaaaagtcttctactgcaatttaaaaattcaggatggtattattatgtctgaggtgcatggtatttctatggtcattgatcaatcactattcttttctttgactcatttacccagtcaaggtgcaccttttgagggcaccattgttgatgactggaaatttgattattcgagtcatgatgctcgccgtatggtctgcaatgatcaggctgaaatgaccgtgacctcctttgggtatcgtaaagatcgaaatggacaatggctgaagaaggatgcactccctcctcaagatgaacgtactccttcacctcctcctcaacgtgaagattctgcactcatgaatgaagtcctctccgaattacggggtcttcgttcttatgttggtgaccgcttcgactcgttggattcacgctttgccggtatggacattcgtcttacacagcttgaagaggatgtcggatacattcgtcagagtttcgatcttccaccaccacctccgtcttcttag

SEQ ID NO: 33085 - DNA, 1245 bp, Glycine max
  Peptide Sequence Number=SeqID_124770
atgttcgtaaggaagaaatggccccgcggaaacttgcctcaaagagatccaggaaggataaagcggccgaaagaactagttctgctcccgagtatgacagtcaccgctttaggagcgctgaacaccagcagcgcttcgaggccatcaagggatggtcatttctccgagagcgacgcgtccaactcagggacgacgagtataccgatttccaggaagatgggcatcattagttacccccatggccaagttcgacccagacatagtcctcgaattttatgccaatgcttggcctatggaggagggcgtgcgcgatatgagatcctgggtgaggggtcagtggatcccgttcgatgcagatgctatcagccagttcctgggatatcctttagtgctggaagagggccagagtgcgagtatggccagaggaggaaccggtccgatggttttgatgaggaggccatcgcccagctgctgtgtataccggggcaggttttgccggactgctgcaggagcgagtgcgaatcatgcgcacaacatgaccacctgacccagatatggatgacattgctcctcagcgacatcctgcccaccgatcataattccgaccttcccatgccgaagtgtcagctggtgtacgccatcctgacacggatgagcatccatgtggctcagttgatcgctgatgccatctatatttttgcaggtatggcgcctactaggcaccctttggacccagataagtccaacagggccctgggatttcccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagccttagcatgcagagccagggctacgcttctttttcatgccctactccagaccagttcagggcagaggttgcatggcccggagattggcccgaggcccaagcaggaaaggcacccccagaagctcccggcgatggagaagaggcccacgaggacgaggagatggccgatttgcttgacttcttgggagggagtggagatacgtga

SEQ ID NO: 33086 - DNA, 505 bp, Glycine max
  Peptide Sequence Number=SeqID_124771
aatcacttgataaaaaagaactacgtaggtctgatttcctcatcgcaattgaggaatacgtaggagtgaagggaaacacccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33087 - DNA, 246 bp, Glycine max
  Peptide Sequence Number=SeqID_124772
atgagatcaagtcaaaagccttcgcttaaaaagaggttctatcaagtcaaaatcaagagcttagaggtcaccagtttacgaaagttggggcaattaatgggtcaacttcaacagcaagccttccgcaaagcctatggtcagatttgggacctagctagggtagaaatgatgcaatcctactccgcaagggcattggatagaaaaactccaagtagattgggccagagatgcaagagaaggccctag

SEQ ID NO: 33088 - DNA, 506 bp, Glycine max
  Peptide Sequence Number=SeqID_124773
ggagtccggagacgtcggcggggcccgggaaagagttatctttctgtttaacagcctgcccaccctggaaacggctcagccgggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 33089 - DNA, 945 bp, Glycine max
  Peptide Sequence Number=SeqID_124774
tgggtgatgttccagatgagcggcatcggcccgatgttcggccagctgggctttttccacaagttcgccggcaaggactacgaggacaagcgcccgcgagaccgctacgtggccgaatccaagcgcctgctgggcgtgctggacaagcgcctggatgggcgcgactgggtcatgggcgagcaatacaccattgccgatatcgccatcctgccgtgggaacgtggcccgcgtgctggaaaccttcgtggcgcgtccggccgtggtgaagggcctgacgatcccggcctgacggcccccaattggtgccggtccggcggctcatcgcggcccgccggagcggcccgatccgcgcattcaggagatcgttccccttacgaacaccccgacgtgcgcgctggccggcagcaacggagggatggaatgaagcacttcgggatcaaggcggtggcgctattggcgctggcgggcctgggcggcggtatcggcggcgcccacctgttgaccgccgtccgcaagacggacagcacggcggtcgtcgatccgcaggaccgccggctggccgaagccggcgcctacatcgcgcgcaccgccgactgtatcgcctgtcatagcgcgccgggcgacaagccgttctcgggcggcctggcgatgcagacgccggtgggcaccatgtactcttccaacatcacgcccgacaagcgcaccggcatcggcgcctatagctacgccgacttcaagaacgcggtgcaatacggcatccgcaaggatggcgccacgctgtacccggccatgccgtatccgtcgtacgccatcatgcccgacgcggacatccaggcgctgtacgcgtatttcatgtcgcaggtcgagcccgtggacaagcccagcgccgactccaccattccgtggcccttgaacatgcgctggcccatggcctggtggcagctg

SEQ ID NO: 33090 - DNA, 684 bp, Glycine max
  Peptide Sequence Number=SeqID_124775
aattgcaactgtggtcaaggattcagcaagaggtttggaccgcgtaaaacagactcgaaacggcatatcgggcgtaccacggaagtacctagaagacaaggcgaggggtatggccagtcaaggagattgggtcccgtttatggatgtgttagcattgctaatttttggggtcgtcctcttcaagagagatataactactttggggacctattgctaaagcctagaggtatgcattccatcaacattcggttccccccgatgaaggataggaaaggagggagtcccttttgtctcattagtaaagggtacccaaatcaaattccggctaatagggacgaggggtgtattctacaagtcaaggtcaaaagacaactaggataccccagcatcaaggaattagggcggttgatggaacccctccaaatgcaagccttccgcaagacttacggaaagatcttagagttgaccatagcagaggtgtccatagaagccattgcatcacttacccaatactacgaccagcctttgagatgcttcacattcggggatttccaattagtaccaaccattgaagaatttgaggaaattctaggatgtcctctcgggggaaggaaaccatatctttcctccgggtgtctcccctctttagcagaattgcaactgtggtcaaggattcagccagag

SEQ ID NO: 33091 - DNA, 327 bp, Glycine max
  Peptide Sequence Number=SeqID_124776
atggaacacagctccaaactcgaaaatggaggacacatgaatgacatccgcaattcattcatggggctccgaaaaagagtgagaatggaggattgccttgagggtcctcacttaggcaatcatgaaacacagctccaaactcgaaattggaggacacatgaacatccccaagtaataacattcatgtggctctggaaaagggcgagaatggaggattgccttgagggtcctctcttaggcaatcatgaaacacagctccaaactcgaaagtggaggacacatgaacagccccaagtaataacattcatgtggctcggaaaagggtga

SEQ ID NO: 33092 - DNA, 617 bp, Glycine max
  Peptide Sequence Number=SeqID_124777
atggggacaaatcaaaccggcaagaggttttaccaagtcaaggttaaaagcctagataccaccagcatcaaggaattagggcggttgatggaacctctccaaatgcaagctttccgcaagatttacggaaagatcttagagttgaccatagcagaggtatccatagaagccattgcatcgctcacccaatactacgaccagccgttgagatgcttcacaatgcaactgtggtcaaggttcagcaagaggtttggaccgcataaaacagactcggaacggcatagcgggctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtacctgtcttggcagatctatttgacacatttgaccgaagaatggattgggaccagctcttggccgggataggaggtagaacaatcagttggttcccccgatggaaggaaggaaaagaaggagtccttttctcatgtggaag

SEQ ID NO: 33093 - DNA, 333 bp, Glycine max
  Peptide Sequence Number=SeqID_124778
atgccttcttttatacatgagcttcaccgtactcaaaatatgagtagcatacactgttccagcactcaaaacatgagcttcatcgctctcgtggagctgcattcgtcagctctgccaacgggaaaaaacaataacgtttttatatataaacccattgttgctttccagcactcaaaacatgagcttcaatattgctctcgtggagctgtgtttgtcagctccgccaacgtagatgctgccaatgaatacgcacggcagggcgaggttgctgtggcaaccaaggacgacgtagagctcttcgcggaagtgggtgatgctattgtgcggccgtga

SEQ ID NO: 33094 - DNA, 351 bp, Glycine max
  Peptide Sequence Number=SeqID_124779
atgttgtggaagcttgggaggattgatggggacccggtgttgagagaaacgaggatatgggctacgtgggagtacgtgagctcagttggaggtgggcaacaggggatggtggatttatgcgcgcattgtggatgtggaaaacttgtgtgcaccatcgcccgaccgccacctagtaccacatgtgatgggtaccccataatcctacaagtttgggatgaggaagtgttgaaggagtggtacctggagatatgtcgcgggggtcaggagaccttggggacgtcaggtggggtgctattgcccaaaaccaagcttgaccaatcccgacccaccccgggcatagtcggtcagtga

SEQ ID NO: 33095 - DNA, 726 bp, Glycine max
  Peptide Sequence Number=SeqID_124780
atggccacgttctcaatttacacggttgtcaagtactatagtggaagtgtttggcttgtgtcctattgcccatcgacggttgactttagttgtagttgtatgagaatgcaatccattggtcttccatgtgatcacatattggttgtgttggtttctttaaattttatggagttgccaagtagtttggttttgaataggtggtcaaaagttgccacagaaaatatcaaagacaaatatccaaattctgcaatgtattgggattcccaattgatggccaggtatgccactttggttgaagtttctagacaagtttgcgaagctgcatattatgatgaagacgagtatgacaaaatgttgtgtttcctgtcaaatgaggttaaaaggctaaagtcgaagaaaaatagcgaaccatgtatcgatgacaatgatgagcaggcagatcagcagggtcataattatgatggtattttagaccctgttgttgttcgaactaaaggatgcggacaagttggagtaaatgaatctgggaagcaaagaagaatccaaaagtgtgggcaatgtggtggaagtggccacaataagcggtcttgcaccaatcgtcctcgaaatgcaaatgtttgtgtttgtggttcgtttatttcatcaagcgaacaaactaacaccatgtgtcaacctatagatgaatataactatcaactggtgtttgagaatgcaacacaaatttag

SEQ ID NO: 33096 - DNA, 285 bp, Glycine max
  Peptide Sequence Number=SeqID_124781
atggctctcactcttatcccaaagaaagaccaagggcaaggcatcttagggaagactagctccataaagtgctttaaatgtcttggaagaggacacattacttctcaatgccccaccaagaaaccgatgattatgaggggccaagatatttacagtagacaagatgaggctactacttcaccttcctcaagtgaaagtgaagaagcaaaaggggaagaatctagtgaagaaatctacccccaagaagaaggacgaccattaatggttaaggaggagtgtaaggag

SEQ ID NO: 33097 - DNA, 262 bp, Glycine max
  Peptide Sequence Number=SeqID_124782
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaagggagggtacatcccttgtggatctttgcttgtaaaggtttttacaaggttgaaagaaatctcaagaaccgctggttgcttggggactggatgtagacacgg

SEQ ID NO: 33098 - DNA, 780 bp, Glycine max
  Peptide Sequence Number=SeqID_124783
atgaggggccaagacatttatagtagccaagatgaggctactatttcaccttcctctagtaaaagtgaagaagcaaaaggggaagaatctagtgaagagatctacccccaagaagaaggacaacctttaatggttaaggagaagtgtaaggatgtaagtgtctcctccaagaggttagctaagaaggaaagacattttgaagtaaagacaaatattaaagaaatttcccttcttagacaacctccacattttctcctttgtaaaaagacacttgttagcattgccacatctcttgggcttgagtttattcctcaagtaaaggagttcttggatgagggtttggttcgcaagagcttaaatccttgtgctttgttggtgcccaaaataggtattattaggcaccaaatccctaaaataggtggtatgatgaatgttttgagtggtgcaaccctcttttgtgaaatcactcgtgcacccaacaacttcatgatttgtgtacatagggactcattaggttgtgatcaaggggttcccatgaactctaagagaataaaggtcattcctaagtggcccactccaccaacaccactcattgagttggtgaggaaccatgttccttcatgggaagatgcccaagaaatgggttttcagacattaccttacttcaacataccaaacaccactaatacatatgtttttgttctttttacatgtgttggcggaaggagcccagagtatgaagaacctcaggatttgaggtcaaatcctttccaaggttga

SEQ ID NO: 33099 - DNA, 54 bp, Glycine max
  Peptide Sequence Number=SeqID_124784
atggtgttgagagaaatcgcatgtttgtcatcatcaaaaggggagaatgtgaat

SEQ ID NO: 33100 - DNA, 375 bp, Glycine max
  Peptide Sequence Number=SeqID_124785
atggaggaaggattttctcaagagtcagatagaactaacaatttttttgaggaagtgaccatccttcactggaactttctttatacagaacaaattccaagatatgctaaattcttgaaggagttgtgcactaataagcgaaagcttaaaggaagtgaaagaattagcatgggcagaaatgtctctgcattgattggtaaatctgtcccccaaatccctgaaaaatgtaaagatccagctaatagaagtgttgcatatcctgctggtttcatagaggatgtcttagttagagttggtgaactgattttccctgttgatttttatattttgaatatggaggagggattttctcaagatcagttcccatcattctag

SEQ ID NO: 33101 - DNA, 246 bp, Glycine max
  Peptide Sequence Number=SeqID_124786
gacaatgtagatgctaacttagattgggaaataagagtagagcaacaacttaaaaagaagtctacgtcaaaatcttatggctctcacacttatccaaagaaataccaaggtcaaggcgatcttaggggtgacccttctaagcttacatttatagtaagtcaagaagaggcactattcaccttggaaagtaagaggaaaagttgggaagccaatctagggaagaatcacccacttccaatttgttaa

SEQ ID NO: 33102 - DNA, 471 bp, Glycine max
  Peptide Sequence Number=SeqID_124787
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtccatcactttcattacatagatgtggattgccccgcgaaatag

SEQ ID NO: 33103 - DNA, 699 bp, Glycine max
  Peptide Sequence Number=SeqID_124788
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagcggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcgggaaagaagaccct

SEQ ID NO: 33104 - DNA, 1089 bp, Glycine max
  Peptide Sequence Number=SeqID_124789
gactacactgtctccccttcagagggctgcatgcccttgccttcagaggactacacgtcgtcaccttcaaaggactacacatcctcgccttcagagggctacacgccttcgccttcagaggactacacatcctcaccttcagagggctacgtgccctcaccttcagaggactacacgtcctcgccttcagaggactacacgtgcttaccttcagaagggatacacgccctcgccttcagaggactacacgtcctcaccttcagaggactacacgtcctcgccttcagagggatacacgccctcaccttcgtagggctacacgtcctcgcctttgtagggctacacgtcctcgtcttcagaggactacacatcctcgccttcagaaggctacatgtcctcaccttcatagggctacaagccctcaccttcagagggctacacgtcctccccttcagaggactacacgtccttgccatcagagggctacacgtcctccccttcagaggactacacatcctcgccatcagagggctacacgtcctcgccttcagagggctacacgccctcaccttcagaagactacaagtcctcgccttcaaagggctacacgccctcgcctttatagggctgcatgtcctcgccttcataggactccatatctttcctgggccacctcctgatattggagggcgatcgactttgcgatcacaaccagaggaggaggctatcgtgcagctactatgcataccggggcaagatttcacccgtgccgctgcaaggagacgaatgcagatcatgcgcaccaacatgaccactcttacacagatatggatgacgttgctacttagcaacattatgcctagcgatcacaatgtcaatctccccctgtggaagtatcagatcgcgcccacaagacacccaatagacccgaaggagtccaacaaggccctagggtttccagctctgattacgagcctctgtcagttctatggagtgcccgtcgcccccagtagggtcacaggcccctataacatggatttcatcaagaagtactacgcccttaggcaagcgcagggcgaggcatcatag

SEQ ID NO: 33105 - DNA, 399 bp, Glycine max
  Peptide Sequence Number=SeqID_124790
atggagaggagtataattgatgctgccagtggtggagctcttggtgatatgacccctgctgaggctaggaatttgattgagaagatggcttccaactcccaacaattcagtgtaagaaatgatgctattgtccttagaggagtccatgaggtggccacaaattcatcttcacctactgaaaataaaaagcttgaaggaaaacttgatgccttggtcaacctagtaacccaacttgccatgtatcagaaatctacacctgttgcaagagtctgtggtctatgttcttctgcagatcaccatacagacctttgcccttctgtgcagcaacctggagcaattgaacagcctgaagcttatgctacaaacatctacaatagacctcctcaacctcagcagtga

SEQ ID NO: 33106 - DNA, 363 bp, Glycine max
  Peptide Sequence Number=SeqID_124791
atgacacagccaaaagtttatacggataaccactcgggtatttccgcccgtcagcgtgactcaaaagtcagtatgacagatcttgtgagcgcagaagatgacgtaaatctccgcgtgtcaacgggctttcggccgcgattgatgaagggcacagaagacgacgttagtctctgcgtgctatcaggcttttcgtgttacagacagcaaaaagtttatatggataaccactcgggtatttccgcccgtcaccgtgactcaaaagtcagtatgacagatcttgtgagcgcagaagatgacgtaaatctccgcgtgtcaacgggcttgtcggccgcgattgacgaaaggcgcagaagacaacgttag

SEQ ID NO: 33107 - DNA, 459 bp, Glycine max
  Peptide Sequence Number=SeqID_124792
atggatttcttttcaaatgagagttttgaatgcattcaagcatttgaaaactcaaattttattcctttcatgtctttaaaattgcctgtttattctgatttagtcaaagccttctattcaaacacagaaatccaagaaggcaccctaatgtatgaagtttatgggattaagatggtcattgaccaatccctattctatgattcaacccaattgccaagtaaaggtgtaccatttgaaggtacactgattgacgattggaagtttgatttttctgtgcatgatgcccgccggttggtttgcaccaaccaagcggatatgaccgaaaggcttcttgccggttcattggcttttgaaagtcgcatccttcattatctaattgttcgcatcttgcttccaagatcttcaaacattgcacaggtttctgaagaagatctcattgttatgtggggattttcataa

SEQ ID NO: 33108 - DNA, 326 bp, Glycine max
  Peptide Sequence Number=SeqID_124793
caccactcattgagttggtgagaaaccatgttccttcatgggaagatgcccaggaaatgggtgttgagggaagaagcccagagtatgaagaacctcaggatttgaggtcaaatcctttccaaggtggagggaatgatgcaatcctaccccgcaaggcattggctagaagactccaagtagattgggctagagatccaaggaaaggccctagggttctcatgagccttagggtgagcttagctattagagagcttctcaaggaagttttctcaaagaagcttctcaaggaagttttctcaagaaagcttctcaaggaagctacctag

SEQ ID NO: 33109 - DNA, 1011 bp, Glycine max
  Peptide Sequence Number=SeqID_124794
attgttttcacctccggtgcgaccgaatccgacaacctggcgatcaaaggtgcagccaacttttatcagaaaaaaggcaagcacatcatcaccagcaaaaccgaacacaaagccgtgctggatacctgccgccagctggagcgtgaagggtacgaagtgacttacctggcgccacagagcaacgggatcatcgacctgaaagagctcgaagcggccatgcgtgatgacaccattctggtttccatcatgcacgttaacaacgaaatcggcgtcgttcaggacatcgctaccatcggcgaaatgtgccgcgcgcgcggtatcatctatcacgttgacgcgacccagagcgtgggcaaactgcctatcgatctgagccagctgaaagtggacctgatgtccttctccggccacaaaatctatggcccgaaagggatcggcgcgctgtacgttcgtcgtaaaccgcgtatccgcatcgaagcacagatgcacggcggcggtcacgagcgcggcatgcgttccggcacgctgcctgttcaccagatcgtgggcatgggcgaagcgtaccgcattgcgaaagaagagatggaaaccgagatggcgcgcctgcgcacgctgcgtaatcgtctgtgggacggcgtgaaagatatggaagaagtgtatctgaacggcgatctcgagcagggcgctccgaacatcctcaacgtcagcttcaactatgttgaaggcgaatcgctgatcatggcgctgaaagacctggccgtttcttccggttctgcctgtacgtctgcaagcctggagccatcctacgtgctgcgcgcgctgggcatgagcgatgaattggcgcacagctcgatccgtttctccctggggcgtttcaccacggaagaagagatcgactacaccattcaactggtgcgtaaatccatcggccgtctgcgcgatctatctcctctgtgggagatgttcaagcagggcgtggacatcaacagcatcgaatgggcgcatcattaa

SEQ ID NO: 33110 - DNA, 333 bp, Glycine max
  Peptide Sequence Number=SeqID_124795
atggcggccctggctcgtcagccagcgtttccgcctggccgctgcgcacggtcgccacgagggaattggtggtgcccagatcgatacccaccgccagacgacgctgcactgcttcgcagtttatcgagaaaacggagtttgcgcacagtgtctgccgccacgtcccaggtctttgttcagttgctccaccatctgctgatggcgggtatcgaacatgcccttcacgcgcgtgatgaagctttccagacgcgcttcgtctttggcctgttcaatctcatccaagctcttcgcgaagctccagctgttccaatcagaaacgcggtgtcgcgcacg

SEQ ID NO: 33111 - DNA, 662 bp, Glycine max
  Peptide Sequence Number=SeqID_124796
gggctagcgtgaacgccgtcaaagaggatgggccatcgcgggcaaagagattaggagacgtagctacttctagacgcttcatctatcaatcactgcaagcggcgtgcatggtctcccgtggtggaggcgaaaaggacgaatgtttatttcacctcggggagtcgcacgacatggaaacctgtcccgtggtagaagaattgcttcagcggctcatggactgggggcagcttgaagtgtccataggagggagggaagaaccacaaagttgcatgcagtcggaagagaagaaggctcctctaacccccaaggccctagccatttcgtggaagtatacccctcccgcgtccagcgaaagagttgcaaccgaagttgactccctatcaactaaggtaaccaacatcaccggcctcagtggcgtaacccgcagtggtcgggtgttcgcttcccctcacccggcggaattgccctctaaagggaaagcgcccatggtccaagagcccaaagatatagccaccccctcgaaagaagtagatcctccagtgggaagaggggctgaaaagaaagaaggtcttcaaggaaaaacagtgactttggaagaggcccatgagttctccgcctcatccaacaaagcgagtttaaggtacaaggatctccttgcttga

SEQ ID NO: 33112 - DNA, 201 bp, Glycine max
  Peptide Sequence Number=SeqID_124797
atggcggagcgtggccatggaatgtattacacgccacaaacatttgctcagtatccgacacagatgctgacaaagaagaagcggggagacatcagggcagaagaaatcttgatcaccaagctcgaagatgggatcgaccatgtgacacatcctcatggcatcacggacaccaaaatgaatgatttgcatgtctctgtttaa

SEQ ID NO: 33113 - DNA, 359 bp, Glycine max
  Peptide Sequence Number=SeqID_124798
atggctttttatggaatcgcgggtctctttagtagtttttattttgggtcgattattttttgggatataggtggtggttttgatatcttcaataaaaaagggaaaaaggtacgttttgttcgttggggatttcctggaaaaaatcgtcgtattattctcgaaatacctatgaacgagcttcactccatcagaataataacagaagttaaagaagagggtatttttactcgtaccagtacttttgagagtatcgtttatctggaaaccatagaacaggggtttattcccttgactcgtattgaagataatttgaatgggaatcaagcttatcgataccgtcgacctcgagggggggcccg

SEQ ID NO: 33114 - DNA, 477 bp, Glycine max
  Peptide Sequence Number=SeqID_124799
atgactcatgtgaatatgagcgacccttctatgccatcacactatgggaagagaatgattcgggcacttcaagtgattcaagcaatgaagaagagacaaatctttttcttatggaaaatggtgaagttgaaagtgttgagatatggagttccaaatgggagatataaatggattcccaaaagaataggaaaggtacgccttgatgccaaggagcttatgtggtatttggacaatggttgttcaaggcatatgatgggagacaagaacaaatttgtctctttgaaagcaaaggagggaggctatgtaacctatgggaacaacaacaaaggcaaaattcttagtattgcctatgggcccgatatctaccctaaggctcataagaatcctagggccttctcttgcatctctggcccaatctacttggaattttctatccaatgcccttgcgggataggattgcatcataagttctcataa

SEQ ID NO: 33115 - DNA, 162 bp, Glycine max
  Peptide Sequence Number=SeqID_124800
gcatctgactgaaacaagtatgcgagcggggaattctgatctgtatggattcctcgagccacaatccattcagagttacataagagttgaatacagagttcaaaacgcgatcggacactggcagatggtggtcattgtgcccaaggaacacctagttgtcag

SEQ ID NO: 33116 - DNA, 127 bp, Glycine max
  Peptide Sequence Number=SeqID_124801
agagcctgaaggtagcaccatatcctcccatatcaatcatgagcctttcaacctggcgacctcgtatggcgagtctcgagaggaagccaaaaaagatcctagagcgggaaagcttagccccaactga

SEQ ID NO: 33117 - DNA, 204 bp, Glycine max
  Peptide Sequence Number=SeqID_124802
atgaccaaacttggtctgtgcttgccaacggacacgactgtgtctgaatggcaaaggggtgcggataaccgtaaggtgcggataaccgtaaggtgtctccgcgggctaccagctcttgagtcatggcacaaaaggcggtgtggtcgacaaagcgaggctcttgctcctacgtatcctccaatgaggaaactcagacctacgtag

SEQ ID NO: 33118 - DNA, 531 bp, Glycine max
  Peptide Sequence Number=SeqID_124803
atggtttcttataatgtccttggccaaaagatccttctggaaaggaatgtgaagctgtatatcacagaatttgatgaattcaaaagagaagttgagaggaggaattggcataaggagctcactaacttctcagagggaagcattgatgttgctattgttaaagaattttatgctaacctctatgaccctgaagacaaatcgcttaagcaggtgaggatgcgagggcacttaaataaatttgatgttgactccctcaacaccttcttgaagacaccagtggtcatagagaaaggggagagcttgcctgcatactccaggtttgcaaatctgaggcctgttcctcaagagcttgcagcccgtctatgtatccttgggaggggatttgagctgaatgcagacgggctgcctttgacctttgaatctctgagcctagccattaagttggcttatattaaaaggaattgttggaacctggatgacccttcggtcacttttcggggaacccagaaatctagggctaggagatcttag

SEQ ID NO: 33119 - DNA, 465 bp, Glycine max
  Peptide Sequence Number=SeqID_124804
atgaagcacttcactgacaccctcatcagtgcccaacatagtaagccagtatacactccgctagcgcccaatacgcaaaccgcctctccccgcgcgttggccgattcattaatgcagctggcacgacagataaaagccaagagtgaagtgctttctatattcaaggagtttaaggtgttgagtgaaaaacaaagtggaaaagcaatcaagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33120 - DNA, 218 bp, Glycine max
  Peptide Sequence Number=SeqID_124805
atggataacgaagagggagtgcaagaacagatgaaggccgacatgtcgactttaaaagatcagatggcttctatcatgaaagccatgctaaaaattcaaaaatcaatagaagacaatgctgcggcggcctcttccaatacaattagggaagcggaaccggtgctacagcccgcattgaacttgggccgggacagaagcgcaacgagtttcaatcggag

SEQ ID NO: 33121 - DNA, 390 bp, Glycine max
  Peptide Sequence Number=SeqID_124806
atgtgccctcctccgtcaaaggtcaacactaaaggtgcactgaagaaaccgatgaaaagaagtcaaagatccacaaagcgtgatccgtcttactgggagtatgttgatgcttttcattctgttcaaagcagcaactctccagtgaaacgaagtttcattcgtgacgttgtggatgtgaaagcggacggtaattgtggatatcggtccattgccactttattaggtatgggggaagattcgtggtcgcatgagtacatgaacctcttcggtggcacagagagatttgaacaattaaagttgtccctacttgttgatggcttttcaaaggttagtgtggacaagtggatggatataacggacataggatatgtgattgcttcacggtataac

SEQ ID NO: 33122 - DNA, 470 bp, Glycine max
  Peptide Sequence Number=SeqID_124807
cgaagcctttagggagcttagcgcatatccttgcggcagatgttcagcttagtgggcactatccagctaagccaattttgcaaaagctgaatttctgcaacttccgccagctaagcggaccatgtctcgctaagcggccaatggcttctagaaagagaaagagtattggttcaagacccacagcgcagtatgacacaaggagattctcttccttagatgtttggaccagatacacaaataatgttctggggagaaacattttaccagagaggaaagtagagatatatcattctgagctagatgagtttaaggttgtgtcataccctaatttcgtctggatattcctccagaaggctgttgcttctggaggaaccaacttggctcgcctgggcgagctgggcggcaatcacctcccctattttgctataaataggggaggaagtgaagaagaaaagggttcagccccttag

SEQ ID NO: 33123 - DNA, 65 bp, Glycine max
  Peptide Sequence Number=SeqID_124808
atgggggtgaatagtagtgtcatgggtgagaataacaactccctttttgagctcatgaggcccaa

SEQ ID NO: 33124 - DNA, 312 bp, Glycine max
  Peptide Sequence Number=SeqID_124809
agatcctttctaataggcgcttcagtcattgcatcctttggttatcaaaaagagcatgatgactcttgggtgaaaaagggtgctcatgttgatgaagaaggacatggtggagaagattcatctcttcttcaaaagattttggataggttcgatggtcttcaaacctttgttggtgaaaggtttgatactttggagttacaaaaggacatgtgcttcaatgagatggagtcaagaatcaccaaggtcgaagaagatgtttcttatattcgttcaagctttgatctaccaccaccgctgccaccatcatcttag

SEQ ID NO: 33125 - DNA, 486 bp, Glycine max
  Peptide Sequence Number=SeqID_124810
atgttgggtcatactcaggatcgttgctttaagttgcatggttatcctccaaattataagaggactagtttttcctcagaagtcaagaaacattattcatcttctgaaccaccacacaaggttgctcaacaagtatctgtagatatgtctcactcaccatcttcctctggtgactcgggttcccagtttcaacttactgcccaacaatatagccaattgatgaatcttttagaaagtcatgctaccaatgttgtcatccctcaaggtgtttcttctaccagtgattctggtgccaacattcatatttcttgttcccttcatcattttcgatcttaccaacttgtttctcataaaactgtcactctgcctaacaatgatgttatacctatcattgccattggttcggagaagcaagcttgcaagaggattggtaaaggggctctcatccaaggcctttatgtctttagatctcaaggacactcttga

SEQ ID NO: 33126 - DNA, 80 bp, Glycine max
  Peptide Sequence Number=SeqID_124811
gtactaggttgcctcctagtagcgcttctttaacgtctttagctggacgcctgatggcttgtaggtcggggatcctctag

SEQ ID NO: 33127 - DNA, 285 bp, Glycine max
  Peptide Sequence Number=SeqID_124812
atgctggtcgcgacggcagcgtttatcgtagtggcgtacccaccaatagcggtcggagactctttcatgaccaccaacgcgagcgcccgccagccacaaaacggcgccgacgaaaatactcaacaccgcgccatgagcaaagaattgcggcagagtaaccaacgccgaccaccatcacaaccaaccctaaacccatcagtatgttaccgagtaacgaagcgtttctgcgtttcatatgtcacctccggaccttgggctacatgggaatatccccaaaatttatag

SEQ ID NO: 33128 - DNA, 520 bp, Glycine max
  Peptide Sequence Number=SeqID_124813
aactagtggatcccccgggctgcaggaattcgatcgcgctgctggacaattcgcagcgtctgttcacgccgggactctttgcccgtgtccgcttgccgggtagcgctgaattcaaagccacgcttatcgacgacaaagcggtactgaccgatcaggaccgtaaatatgtctatatcgttgataaagagggtaaagcccagcgtcgcgatattgcgccggggcggttggctgccggtttacgtatcgtcaagcaggggctgaaccctggggataaagtcatcgtcgatggtttgcaaaaagtgtttatgccgggaatgccggccgatttttgccgccgtgctgtcgattctgatttttatcaccggcttgatcgccattccgctgttgccggtgcgggcggaatatcccggcgccaacccgaaagtgatcgccgaaaccgtggcgacgccattggaagaagccatcaacggcgtcgaaatatgatgtacatgaagtccgtcgcagctctgacggcgtattg

SEQ ID NO: 33129 - DNA, 524 bp, Glycine max
  Peptide Sequence Number=SeqID_124814
gggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 33130 - DNA, 531 bp, Glycine max
  Peptide Sequence Number=SeqID_124815
atgcctcaaaatgttctttacgatgccattgggatatatcaacggtgtgatcttatttcattatgggggaaagttggaaccttcttacgtgccgatcaacgtctcattttcgccaaaagttggcccagggcttccccggtatcaaccagggaacaccaggatttatttattctgcgaagtgatcttccgtcacaggtgctccagtggcttctgtttctatcagctgtcccctcctgttcagctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 33131 - DNA, 201 bp, Glycine max
  Peptide Sequence Number=SeqID_124816
atgggaaatcaacagaggcaagggtatacttcaggaggatttttaggcttccaacagggtccttatagtcaacaaggacagtggaggtcacaccctagcaatcagttcaacaaagatcagggtggaccttcgaataggccaatccaacaagggcctaacatctttcagaggaatactaagctagaagagactttgacttag

SEQ ID NO: 33132 - DNA, 846 bp, Glycine max
  Peptide Sequence Number=SeqID_124817
ggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtgtgcgacagggtccgggcacgacggggctctcaccctctctggcgcccccttccaggggacttgggcccggtccgccactgaggacgcttctccagactacaattcggacgccgagggcgaccgattttcatggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 33133 - DNA, 594 bp, Glycine max
  Peptide Sequence Number=SeqID_124818
atgcccactgggaggaaggaagccatatcaccatctaggttctatctttccacgacaagagttgccaaggtagtgaaaatctcagcacaagagttggaccaggtaaagcaaaacaggaatggggtagtcggagtaccaaggaagtgttggaggaaagggcaaaggccttggaaaatcaaggtgaatgggctttcttttattgacatcttggcgcttttgatctttggagttgtcctctttccgaatatggaagggttagtggacctagcagtgattgacgctttcctcacctttcatcatggcaaggaaagcccggtcatcgccattttggccatgtatgacacgttcgaccggggatgtgaaaagagcgacgcaataattttttgttgcgcactggctctctatgtgtggctggtttcacacccttttctccaagaaggtaggcccgtctatccgctacaaggtcaccgctcgtgcgtcgaaaaaggaaaggcgaattgggaccaactcttggctagcatggagaggcgtctgttaatttgttccctcgctagaaggaaggaagaattaggattctatcttcatgcggaggat

SEQ ID NO: 33134 - DNA, 2775 bp, Glycine max
  Peptide Sequence Number=SeqID_124819
atgaggctgttaatctgggaagattactactatgaacccttgccatctcctttcccaccacgagatggggaaggatgctggttttcttcggagtctcagcttattcaggaggaggacagagtctgtgtattgattaacaaaatgatggtgaataattcagtcagtattgctggagaagggatagttggacgggcggcatttacaggaaactatcagtggattcttttgaacaatttcactagagatgcttatccgccagaggtatatcctgagttgcattaccaattttcagctggaatgcagacggtggcagttattcctgtgcttccccatggggttgttcaactaggttctttcttgccgataatggaagatataggatttgtgaatgatgtaaagaacttgttcttgcaattgggatgtgtacctggtgcccttctatctgaagactattcagcaaaggtttctaataaaaaatttgctggacctgtgactgttaatccacctctcattacttcagattgcactccctcggtagctaatggttccaaccaacttactaattctcctcttgcttcaaggcctgttgctcagccaccttatcctctaaggggaggaataaataattaccagggttctttattgacacctcaagcccataacccgaacctgatatttgatggcatttgccaaccaaaggctcattcaatgatcaaaacaaatgtctgtggccaaccaaagaagaccgttgttgaggctgaagctaaagtgatacctgcaaattttgattcatgtctgcaacagcattctgtttataatgctagatctgaattcaatgagttatctagtttcaatcaatcaaatctgagtgactgctgccttaaatatattgaacaacaaacatcaggtgttgggagacagagtcatgttaatcctaacatgaatttatcaagtgccttaaatatgcctctactaaaaaccaatggaggaaaaattctgcaacagaatcagagttctagtagcagttcactacttggaggaatcccaatatgtagtgggagtaatcttttgaggacaaatatgattaactgctcagtttcaaatcctcccaaagtatccacttctgatttttctggaacacacaaggttgggtttggtcttcaaagtaacaatgcaacaactaatgctgggctttgttctgtgcctaatttcactaatcaatcagttaccagtcacatgaatctagaaggctctgatcagaagaatcaggcatatgatgctttcgcttcagctgatcaaaggcaagatgatgatttgcttcaggctgctcttaagattccatctcttaatcttgaggagcatgtgcctatgggtgatcaaatccctggttttgttcaagattgcctcaataaagatgttaccagtcaacatatgatgaaaatgaatgttaagcatgaagaagcctatgctcaacttccatctggtgatgacctcttcgatgttttaggtatggatttgaaaaggagactactcaatggaagctggaataagttgcttgccacagattcagatgacaacacagaacatctagataaaaaggcaacatgcatgaatttgcaaggtgtaggtcctgataatagttattcagttaatgaagcaatatcagaaagtggcatcttctctggaacaggcacagaccaccttttagatgctgtggtttcaaaagctcaatcttctgcaaaacagaattatgatgaaatgtcatgcaggacaacattgacaaggattagtacagcctccattccttctcctgtctgcaagcaagttatgcctgatcatgttgtcccaaggggattgtttgattttcctaagaccggagttaaaacagctgctgctgaaacaagttctcttaggtctgggtgtagcaaggatgatgctggaaactgctctcaaactacttccatatatgggtctaagcttagttcatgggttgagaatagtagtaatgtgaaacgtgaaagcagtgtttcaactggatactccaagcgaccagatgaagtttgcaaatcaaatcgtaaaagacttaaacctggagagaaccctaggcctcggcctaaagatcgccaaatgattcaagatcgtgtaaaagagttgcgggaaattgtgccaaatggagcaaaatgtagcatagatgcacttctggaaaagaccatcaagcatatgcttttcctgcaaagtgtaacaaagcatgctgacaagctgaaacagacaggggagtctaagatagttagtaaagaaggtggattgctattaaaagataactttgagggaggggctacatgggcatatgaggttggctcgcaatcaatggtttgtccaatcattgttgaagatctcaatcctcctcgtcagatgctagtagagatgctttgtgaggaacggggtttctttctggaaatagccgacttaatcagaggattaggtttaacaatcttgaagggggtcatggaagctcgcaatgacaagatctgggcacgctttgctgttgagataatattcagacttaatcggaatttacatataagcattagcattgcaaacagggatgtaacgaggatggaaatatttatgtcactggttcgtcttttggatcaaacagtgaagggcggtggtgcatcttcatcgaatgcaattgataacaacatgatggtgtatcaatctttcccacaagctacccagataacagcaactggtaggcccagtagtttgcaatga

SEQ ID NO: 33135 - DNA, 249 bp, Glycine max
  Peptide Sequence Number=SeqID_124820
atggcgacaacagctatggaggaagcaccagcacatgcaccttctgatgtggagcagcctagacatgcagtggaggcttgtcgagcaataggtgaaaggttggagtggttgctcaacctaatgatagtgactgaaggcgtagaaacatacgatgtcatgcaagactgcctaaggatcactagaagtgtcactgtggatcgcaatgtatatgtgcggtcgcgacgcaggcgacgcacagatcacacatga

SEQ ID NO: 33136 - DNA, 750 bp, Glycine max
  Peptide Sequence Number=SeqID_124821
atggatgatcacaaaaacgagtcatcatcatcaccacctctacaccaccctctcgacgattccaccacgtcgaacctcgccacaactgctgccaccaccaccaccaccaccaccactttgtttgcatttgtcggcgaatggatgatcttgttcatcacgttttcaattgccttgttcttcattcccctcacccctgccttcactctgcactcaaccaccgcttcagttctcaacatcacacaaaacaacttcacagccaacttgggtgtgagtttcttcgtggaaaccacaaacccttttgaagggagcatcaactacgcttccttcaacgcctcactcttccacaacaatcaaaagctctcaactttggtctctcttcaacaagaaacaacaaccctactagccatgtttcacaatgtgtctttgacaattgatgaatggggtcatcatcatcatcgtgatggagcatcatcgtcgtgtggttttgcattcatggacttgtggttcagcgttgatgctaagagggacaagcttcaaggccattgtggtgaggtgaagttcgaactctgcacttcctctgaagcaacaaacattgttgcagtaccgtcgtttcttgcttcatgtgatgtttacagtgccttggtgcacaaggttaggctcggcgtgttactgcttttgatgatccttcttcttgtgagtgctgcaccggttccactcctcgttgagcaattctcttgctttgattcttga

SEQ ID NO: 33137 - DNA, 129 bp, Glycine max
  Peptide Sequence Number=SeqID_124822
atggatggagatcaagatttgaaagatgaagaaagttgtgaaaagggacagagcaaattaaaagggaagctcctatccgcacctcctatcacgttcttctctctcacatacttgattcgtaagcaataa

SEQ ID NO: 33138 - DNA, 594 bp, Glycine max
  Peptide Sequence Number=SeqID_124823
atgtcttccaataagaaaagccttcttagaaccgtgttcacagcaaacggaagctgtggttgcagcaaaacaaaatcctctgaagtgcacgagccaacaccaaaatccaaaacaacacacattcaccaaaaggctaacaacaacaacaacaacaaccacaaccttagcagcatggcttcttccaccacttcccctgagcaagttgatgaagaggagttcacttccaccacaatctccgaatccgagacatttcacgatcacaacaacaacaacaacgacgacaacgttgtactcaaacgaagcccccttgtgaatagcgtggcgattgagaaggattcgtcgaatccgtatcatgatttcaggcattccatgctccaaatgatctttgaaaaggagatcgagtcagaggacgatcttcaagaccttttgcaatgctttcttcagctgaatgcgcagtgtcaccaccacgtcattgttaaggccttcaatgagatctgcaaagaagcatttcctcacaaggttagtaccactcctgccgtctctgaaccttctccctctcaccggagccccctcatcgttcaaaagagccggtga

SEQ ID NO: 33139 - DNA, 855 bp, Glycine max
  Peptide Sequence Number=SeqID_124824
atggttaggaccagaggattaggtcagcgagtcgctgtgactgcggatcacgtcgatgagccagtcatccctgcgccagatgttcaggatgacccgatagaggcaccagctgctgtagaggacattcctacggacattcctgtggacacaggcgcaaagcctgctgaggacgcgcatgagggattttcgggtggtccaagcgacccatccatgttgaccctgtatgcggatcacgttgcttgcagcgtatggacgggagaggagcgtcctgaattgaagctatcctctcatgggaggaaggtccacagtttaggcaggtctgtccctgccattgagggacttgttgctggtacaggactaagtcctctgatcgcgtgttcggtagacaccggtgatcggggacttttgtccgcgtttgtggagcggtggcaccaggagacgtctagtttccatctcccggtgggagagctcaccatcacattggacgacgtctcctctcttcttcatctttccattattggcgacttacacgcatttgagcccttgcacgtggacgatgcggttcaagatgctggtggacttgttgatggtctctccagagtcctgctagggctgagacagtccagtgtcacggactgtacgtacgcctgcaatgggtacgtgatatatagcagcgccgatgccaggcagagtgcaaccaatgtccatgttgtctacttggaggccctttgtgacctcagtatgacagagaggtacgcctggagagtggctgctttggttcatatgtacgaccagctgaacgatgcatctatgagccacagtcgacagcttggcggttacatcacactgctgcag

SEQ ID NO: 33140 - DNA, 402 bp, Glycine max
  Peptide Sequence Number=SeqID_124825
atggttatttataggaaaaggccatttggggtaggggcagctcacccaggcgagctggcccaggcgagctggtttcttatagtcgaaggcattagctcgcccagggatctaatggatgccttcattaggcagtatcaatacaactttgacatggatccagatagaatgcaactactaaacatgtgcaagagagataatgaatcattcaaagaatatgctcaaagttttgcagatctagtgtttgctgatgaaagaattgaagcaagtctaaggaaaggaaaatttaattatgttgcttttgtgaatcctggtaatgggggatttgggaggagtggcgagaggaaaaacaagggagaacctcatgttgtcaatgtagttcccgatagccaaactttccactag

SEQ ID NO: 33141 - DNA, 156 bp, Glycine max
  Peptide Sequence Number=SeqID_124826
atggaggaagaaaaacgaaggaagaggaagaaaaaaaggaaaagcgaagtcgaggcgctaccgaatcgcaaccgtgaatcattccctacatcgtttctcttgctagccttgtaccctgtacaacagcttaattctagccgatcactagtgccgtga

SEQ ID NO: 33142 - DNA, 1122 bp, Glycine max
  Peptide Sequence Number=SeqID_124827
atggggaatgaacatattgggaccattgtcgagggccctaggagcaatcaaatacttactagtaatggaaacacttcatatgtagacttcttgacaaggctagccatcaagcacctcgtaacctttatcgaacgtccccagactaatgatcaggcaaagacaaccaacacagtcatcctcagggccctatgcattagacccaacaagtatatgggtctatggaaggaggaactccctagaaagcttggtcccaactgggaaggccaatttagggtcgtggcaagcctagacagcagagtatacatgctaccagaactagatggcacatcaaacccaatgtccacccttggtgagtctcatagctccaaaggcttgtcaaacccaaggcttgtcctagattcaataacccaaggtccacccttggtgagcctcgtatctccaaaggcttgtcaaacccaaggtccgtccttggtgagtctcacaggctcatcaaacccaaagtccgcccttggtgtgtctcgcagctccaaaggcttctcaaacccaaggttcatccttggctcgtcaaacccaaggtttacccttggtgagtctcacttctccaaaggctcgtcaaacccaaggtttgtccttggtaagtctcacaggctcatcaaactcgaggctcatcaaacccgaggtccacccttggcaagtcttgcttctctaaaagctcttcaaacccaaggttcatccttggtaagtctcacaggctcgttaaacccaaggtctgcccttggtgagtctcgcttctccaaaggctcgttaaacccaaggtctgtcctttatgagtctcacaggctcgtcaaacccatgagtgacgaaactcattgcagaagtaatggaggatcgatacttcaaaacatcgtcccttaccctctcaaagccagcaacgacaggggagataatggcgacccagcattgtggctacgccgcgcgtgggggtacgccttaacatccccaccaccactcctccatgctcccccaatgaaaggttgtgccctcctccggaggcgagaaatgcctccaccggggttgttgaatcaaacccccggagtcactgtcgctcatgcccatggtgga

SEQ ID NO: 33143 - DNA, 351 bp, Glycine max
  Peptide Sequence Number=SeqID_124828
cagatcaacctaactaccctagcggatcaacctaactacagcagtgcaaaagtagaagaaatggaaacggcgcttaccttgacggtggacagtggcgaagctcttcacgggaacctcctcaatgcacctcactgtaactccacgtcactgcaaatgacaatgccccggaagaagaataccaaaattgcgcaaggaaacaaagaccatggcacgcagggaaacgaaaagctgggtgaagaagaagaagaatatgaaagccgtgagagagaaagtgaagcgctgggtgaagaagaagaagaatacaaaaagtgggagagagaaagtgaagcgctaggtgcacaaatgttttaa

SEQ ID NO: 33144 - DNA, 510 bp, Glycine max
  Peptide Sequence Number=SeqID_124829
atgcgccagtttggatgcgtccagagtattcatgatctgcctgtcgattcatgggtgtcatttgacgagatagatggcaggtggatgcactactcagaccatcttgtgccagcaggtgagatgtgtgttgtgccaggtcagtgtgcgcccgactacatcgactggttcttcgtcatttctcatccattcatgaccgcgacacagacatcaaatccttcacaagatgcacctgctacgcagcccaaacgtatccctcatatccctcaggtcccagagccagcagcagcatcgacacttgccaggtctgatgtggacgagcccagacatgcagtggaggcttgtcatgcgatcgctgagaggttggagcgtcatctcaacctaggggtagtcgcgccaggcagattgacacatgaggtcatcgaacaatgcctcaggattgtcaggggtgtcacagaagaccgcattgtgtatgtgaggtctcgacgtaggcggcgcacggatcagccatag

SEQ ID NO: 33145 - DNA, 228 bp, Glycine max
  Peptide Sequence Number=SeqID_124830
atgtcgcatccaagcattcgactaaacatcttgcagtctaggatctatgagcatttccctaaatttggaaatattattgctgatgaggattactatgagaggaaaccatgtgcttgtcgctggaagtgtgagaagacattacttgcgatgacctatagccgcttgccaaaagatagcaggaagcttggaacacatgataaatatgaggatggtcattactacaactga

SEQ ID NO: 33146 - DNA, 201 bp, Glycine max
  Peptide Sequence Number=SeqID_124831
atggcaccgccgcctgcactggaggttcccgcggtggtttggggagagagagagataatatgcgaggagcttaggagctggattttgaagggaagagaaaaagcttattcaaagacaatcagaatgaaaagactgtctttggattaccaatacaactactatggtcaacacgggacccgtcatagtactccttattgctag

SEQ ID NO: 33147 - DNA, 575 bp, Glycine max
  Peptide Sequence Number=SeqID_124832
atggtgagtgtgaaaggcggttttcataacgtcgtcaacattcatcaatatctgatagtaaccttggaggagatcaagcttggagaaccaagccgcgtcaccgagctcgtcaatacagaactgccacgtgccgttgtgttttttaacgagcaagaccagggacgagaaaggacgaacattgataggttcagcactggggatgaggtgaatagtgtgattagtgggtcacgaggggaaggtggtttaggtcgaaggaagctctttagggacaatccgaaggctggagttcgcgtcgcctttgagctcaactgtatgcctttctcggatgaacttcatgtgagtggcatacacttagcgaggcatatagctcgcttagtgggttgggaaaccctagaagaggatcagtttgagatgtgctcgcccaacgcgcagccagcccgcccagcaagccttcgaaagctgaaaggtccaagagcctttaaaacactaaagttggcaaaaataaagcatagagttagagagagcgcactagaggaagctgagaagacagaaaggaagcagctgagagagcttag

SEQ ID NO: 33148 - DNA, 378 bp, Glycine max
  Peptide Sequence Number=SeqID_124833
atgactacaccatccgacacatctgatgttggcccgtcaaatttacagttatcaacaattgtgcaccgatttgaggcgtcattccgtgttgagaagcatgggacaaaaatactactttcaatgtggacgtcgtgggacctctacataggcaaacacacaaaagattgtggtcgtggtagactttacgaatggatgatcactatgaataatgacctatcatgtgttgctaagtcctggatccaatatttaactgacgatcatttgaaggctggagatgaggtcgtcttctactacaacttcaaccaaaatttatgggaggtcctctataggaagcaagtcaaatgggatgaggaagaggacgaagctaactccatttga

SEQ ID NO: 33149 - DNA, 279 bp, Glycine max
  Peptide Sequence Number=SeqID_124834
atgaacaattcatccaggtctgatgcagcagcaagtaagttagaagaagctagtttaaaaaatatagcatgcataacatctggccttcaaactgtaaaaccagggacttttgattctgtggggtctacagagttggagaatgtcggcaaagctggcttggtgacaatccaaggaaaaatctcaactgtgttgggaactattcttgtttgtgcatatatattcgttacctttttccctgaccaagcagagaagctattccaattggcctctgcaggctaa

SEQ ID NO: 33150 - DNA, 1503 bp, Glycine max
  Peptide Sequence Number=SeqID_124835
atggcagagtatattgctgaaagcaagcctcttgggggtttaatatttttgcttccccggatgttcagttttgaaaacaaagatggtatgggaagtaatcatcaagatgagagtaaagaaccgctgaagaatgtattggatgaacttgaaaaaatacttatacatgccaacttaccttatcctgtttattttgcattcgaggatgataacattgatgctgtgttaactgatatcaagaagaatgatgtcactggtcagcctgctacagcaacaactggcggatacaaatttgttgtttcggccacagaaccaaagaaagttgtatctcctcccattacaaatattcagggatggttggcaggactgaagacagatgatgatgctcatcaattacccaccattgcaatagttgcttcatatgacacctttggggctgctcctgcattatcagtgggaagcgatagtaatggaagtggcattgtggctcttcttgaagtagctaggttgttttctctcttatattctaatccaaagacaagaggacaatacaatctgctgtttgggctaacgtctggtgggccttataactacaatggaacccataagtggcttaggagctttgatcaacgtctgcgtgagagcattgactatgctatttgcttggatagtattggctcttgggaaaatgaattgtggattcatgtatctaagcctccagaaaatgcctttattaagaaaattcatgaagatttttcaagtgttgcagaagaattaggctttaaagtgaatctgaagcataagaaaattaacatttccaatccccgactgcctattggtttccacttcctgttcttaatcatttcagcttgtgcttcatgtcttattgaagtagcttgggagcatgaacagttttcaaggctgagagttactgcggccaccctctctgaactctctacagcacctgaatttctagagaagactggtggcttggttgatggaaggcattttgtcaatgaagcggctattgtcagaagtgtgaaattaattgctgagagtcttgcgaggcatatctatggacatcaaggaaagaacattcagatctttgcagacaacagtaacttggctgtcaatccttcttatgttcgatcatggttagatgttttgtcccaaacgcctcgagtagctccatttttctcaaaaagtgatccttttgtcatggcactgaaaaaggaattagaagatcatactgatgacgtaaatctgcatagagatgtgcttgatgggattgtcactttctatgattcaaccagcacaaagcttaacatttatcaggttgctagtgtcacatttgacttgctgttgctactagtattgggatcgtatttgattgtgctcttcagtttcttggtcatcaccactaggaagagagttgctattagctccaatagcattcccaccatctcaaaattcccaaattacaaatccctcaaatttacaatgtaa

SEQ ID NO: 33151 - DNA, 459 bp, Glycine max
  Peptide Sequence Number=SeqID_124836
atgtgtccaaaccaatccatgaattttcgaagagattcatcatctgcttgtcacaggctagccagtacggcaaatgtcatacgatgtgaccggctggtcgcatattacgcactgaagcattcgacaagagtatcaaaaatgtcgatggaccttggagaaagtccaccataccaggtcaatgtcgcccctttgagggatgtggagaagacacaacacaagattgcattgtcattggtgtacagattttcctgggtgaggaaagaatccaaatgttcatctggatcgatggtctcatcatactactctaggttgagtggtttccaacctagggctttcttagctcctcctcagggcgtcactccgtctccgcaatgcggttttggagttgttggagagtatcagtatttggcatcgctactgcaagaggattggagccttcaaaaggggtctcgtgtctga

SEQ ID NO: 33152 - DNA, 1008 bp, Glycine max
  Peptide Sequence Number=SeqID_124837
atgatttgcggttattctcagcttatgttgaaatctcaggaaaagaagcttgtgcctttaccttcagaaaatggtgtcggtgcaggcttgttagctgtcttagaagctgatgtaaaggagatagttagttttgctcgtgaaacttatgagaaggagggaccattgttggttgtcgcgtgtggaagagataccatttctactgcaagttccataaaacgtttagcatctgagaatgcttttgttgttcagatacaaaatccaagattgcatctgaataggtttgacatggtgattacacctaagcatgattattatcctttaactccagaaggacagaaacaggttccttggtttcttcgaagttggataactccacgtgatcctccagattgtcatgtggttctgaccatgggggcgctacatcaaatagatttcagttcaatacgtagtgttgctgcttcttggcatgatgagtttgcacatgttcccaggcccttgcttgtggtcaacatcggaggaccaacaagaaactgtcgatatggtgtagaccttgccaagcagttagcagcttctttgctcagtgttcttgctagttgtgggagtgttaggatatccttttcggagaggactccacagaaggtgtccaatattatagtgaaagaacttgggagtaatccaaaagtttatatttgggatgggcaaggacataaccggcacatgggccatttagcttgggccgatgcatttgttgtcacagcagattcagttagcatgataagtgaagcatgcagcactgggaagcctgtttatgttctgggagctgagcattgcaaatggaagttcactgaattccacaaatcattgagagagcagggagttgttcggccttttacaggttctgaggatatatcagaaagttggagttatccaccccttaccgatactgctgatgctgctaaaaaggttcatgaagcacttgctgcccgagggtggaaactgaaggtatag

SEQ ID NO: 33153 - DNA, 312 bp, Glycine max
  Peptide Sequence Number=SeqID_124838
atggctgaaaacttgacatgtggcatttttgttgggtttttgcgttttatagcgagtgttttttccgtttccgtttgttttacagtttggtttgctgcggtgttctctttggttgcggggagtcaagtttggtttgctacggtgttctctttggttgtggggagtgaagtttggtttgttgcggtgttctctttggttgcggggagtgaaggaagcgttaactgtcatgcggttgcattgttggtgaaatgggtttatgcacccaaaggtgatctttacaagaaatcacaaaaatgccaatatttcagttaa

SEQ ID NO: 33154 - DNA, 760 bp, Glycine max
  Peptide Sequence Number=SeqID_124839
atggatccattcggtccgaaccgattcccgaaccgaaaactctccgccacggaacgcttcctcggcgttccatctcacgcgccgccgcacttctcaaactccgccgcctcctccaacgacgagctcctcgaggacgacgtcgttttcttcggcggcgactacggcgccgaacacaaccaccacagcgcctccactccttcctcttccttgtcattgtcttcctccgccactccgaacaacaacctccacaaccattcccacggcatcctcgccgcgctccccgagaacgaaacctcgcacaacctccgaaacgtttcgcagcacttccacaaggcatcaatctcttcaatctcgtccgcctcctcttcatcctcctcctcgcgcgtcattcccgccatcccgcggcctccgccgccggcgcaaccttcgtccgtcatgttccaccagtctgcgccggtgaaagtcccaatcctgtcgatgaaggcgcggcggagataccgcgacgtcgatgacgacgacgaagacggcgaggaggacgacgaagaggagatggtgcctccgcacgaattcgtagcgagaaactcagcgcaatctccgatgctcgcttattcggttctggaagggatagggagaacgctgaaagggagggatatgcgtcaggttcgaaatgccgtttggcgccaaacagctcctctagtcgggaaaaggcctttgttcagttttgaagtatcggagtccagtgtgcgtgggtttgtgccgg

SEQ ID NO: 33155 - DNA, 429 bp, Glycine max
  Peptide Sequence Number=SeqID_124840
atggcaggaactgattcacacacaactatgattgatggcctgggtgttgttggatggggagttggtagaatagaagcagaagctacaatttttggccagacatgtgtggttttgaccattggaggacttattgtaagaaatatttatttatctcatatttttgcagcccatgagcatggtcctaccaagtgttgttgggttcaaataattaggcaaactccgagatggtgtcacagctacttacttggtgttgattgttacacaaatgctaagaaaacattgggttgttggcgagtttgtagagttttatggattttggtggatgttttgacagtagtacgttgtcacaaatacgttggatctactaaattgtgccacctactaagtagttcaatctacactgctgtgtttggaaagtcattactctaa

SEQ ID NO: 33156 - DNA, 1482 bp, Glycine max
  Peptide Sequence Number=SeqID_124841
atgacggaggtgcttcatttctcatcctcttcgtcgccagccacttcttcttccgatggcattctccaagaaccaccaccaccttcttctgtgagcgtggtggtggatgggttttctacggtcaccgactgtgacgcgcgcagggtcacggtcaccgacagaacgcaccaagagctttctcttctggcaattcttgtgacccttttgaggaaatcgctgattgcttgcaacaagagcgacgagggacagggcgccatggagattgggtggcccactaacgtgcgccacgtggcgcatgtcaccttcgacaggttcaatggcttcttgggcttgcctcgtgagttcgagcccgaagtctccacaaggcctcccagtgctagtgtaagctgtaggccctcactaggccatttgcctaaggaggttgcatgtgcaactgtttttggagtttcaacagaatccatgcagttatcgtatgacacgagagggaacagtgtgccaaccatactgctactaatgcaaaggcacttgtatgctctcggagggttgcaggcagaggggattttcagaattaatgcagataatagtcaagaggagtatgttagggatcaattaaataggggattggtcccagaagatgttgatatacattgtttggcaggacaaattaaggtgtatgatattggttttgataatcttgtgcttttcaaggcttggtttagggaactgcctactggtgttctggattctttatcaccagagcatgtaatgcaatgccagactgaagaggattgcgctgaactggccagccagctacctcacaccgaagcttcccttttggactgggctattaatttaatggctgatgttgcccaagaggaacacttgaataagatgaatgcacggaacatcgccatggtttttgcaccaaatatgactcatatggcagatcctttgactgcattgatgtatgcagttcaagtgatgaacttcctaaagaatcttatattaaggacactgcgagagagaaaggattgtgtggtagaatcgtctcctggattttgtttagagccttctgatgagaacggggacagcagtcttccggagtcctgccagcaagatgatgatgttgctgctgaaaatgaagaggccggggaaacctttgtttctgagaaaactgaattagaatgttcgcctgagtccctccaaagcaaatattcaactgaaggaggatgtggcagtttgataggctctcctgagaatctggtttgtgaggaggacttgtattgtgagtttccatccaaaggaaacatcgggaagagtaagagtgttcaatcaagtaattccagttctaaaaaggggtcccaaaaaaccagaggcatgctccaacctgtgatccatgcaacagtggctgctgataaaaagggtattagcaatctgagccgcatagattcgagatcagagcggatagaagcctggcggtga

SEQ ID NO: 33157 - DNA, 271 bp, Glycine max
  Peptide Sequence Number=SeqID_124842
atggccggagacgcgaccatggtcggaggtgttgatgccagcgaaggtgacgcgagacactaccatggtcgaaggtggtggcgcaaagtgaaggtgaggccagaggaaggtgttgcggtggtggtcggaggtgttgacgccgacgaaggtgacgcgagacgaagggacgatggagaagcttctggaccctttgtgaatgtgggaaggttttggacgatctggaacgcccattttattaatgaggatgaatctggaccgttgaatagcttag

SEQ ID NO: 33158 - DNA, 561 bp, Glycine max
  Peptide Sequence Number=SeqID_124843
atggatcatgagaatccatacacacatttgtctactttcatggagatgtgcagtatcatggagatgtgcaatatcatcagagctttcacattctccttggccggtaaggcaaagacatggctccaatcacatctaaacaaaagcctcaacactcaggaagaggtggaggaaaaattcattgctagtggtttaaaacctcaaacaaagatgattcttgatgcctcagctagagatactatcatgtcaaagagcctagaggaaccaactaatagccactattcagcacttggtgattatcaacaggaagaaaaggctcattatctacagaatcaagccaaacctcaacagaactaccaaggctacagaggtggctcaagttcaaatcagccttatggccagagaccacaaaataataatgcatattctggtcccactaacacttcttatgtaggtccttctaacaactcttatgtaggttattcaaataggggtccacaacaaccacaagctcagccaaatagaatctcaaagatggaagatactctaacacaatttatgtag

SEQ ID NO: 33159 - DNA, 612 bp, Glycine max
  Peptide Sequence Number=SeqID_124844
atggctcgccttggcgaatatgtgacatcagcactaagtaacaattcgtctgcgcacatagttacatcacctagctccccacctcctcctcctgagtcagcaccttcagcgtcttcgccgaagaagactagaaaaacagcacgactcagatcattggctatcagacccatcaagatggagagactagtggttcatatggatcctacaactaggaaagctaattgtccccagagaaagaaattaaggatgcatttgggaatcgtcgctcgagacaaggcaaaatttgatattccagaagcgttcgaccaaaggacgaagaagaaaaaccttaagacggaggaagatgatgacactgtctatgagaagtatggtattaacaaagaaaagtggcaacaattttgtcatattcgcagagacccttcatgtgaggaggttagaaagaaggctcgggtcatccagaaactaaacactgccccttacgtgttgtctcgtgggggttatgatttactagaagaaaagttaatggaggaaaaaaatgattggatcaagcatcccaatccgacagcacagaaacaatcgttgatcctttatctcccattagacgacatatga

SEQ ID NO: 33160 - DNA, 213 bp, Glycine max
  Peptide Sequence Number=SeqID_124845
atggcgattaatctctggatcgggctacaagtgaccctcgccttgtcgtcgcaacttgcctcaccatcacacctccatggcaccatgactcgtgttgccatcacacctttgaggcctcgcaccgcgcctcaccttgctgtcaaagctccgtcgtcacagatctggggaaaccattgggaggaagatgaaaagagagatttggatgaaaaatga

SEQ ID NO: 33161 - DNA, 1206 bp, Glycine max
  Peptide Sequence Number=SeqID_124846
atgcctcgggaaaaagcaatttcttcatcagctgctaagccatctgagcctgaggagccagttgaatctgatgagaaggttgattttgaggaggcaaatgatccagaggaagcaatggaagaagaagtagaatatgaagaagtagaagaagaagaggaagtggaagagatagaagaggaggtggaagaggtggaagaagaggaggaagtggaggtggaagaagatgaagaggaggaggaggaggaggaagaagaggttgaagaagtggaagaagatgatgccatgcaaaatcatagcagtgatgaaacaaaggtggaagatgaggatgagaagaaaaaacatgctgaactcctttcaattcctcctcatgggtctgaagtatacattggtggcattcctcatgcctcagatgaggatttgaaatctttatgtgagcgtattggggaagttgcagaggttcgaataatgaagggaaaggattcttccgagaacaagggctttggttttgtgacctttagaagtgtggaattggcttctaaagccattgaggagctaaataataccgaattcatgggtaaaaaaattaaatgttcaaaatctcaagccaagcaccgtctttttattggcaatgttcctagaagctggggtgttgaagatctgaagaagattgtaactgagattggacctggagttactggtgtggaactagtcaaggatatgaagaacaccaacaataaccggggctttgcttttattgactattataaccatgcatgtgctgagtattcaaggcaaaagatgatgagcccaacatttaagctaggtgagaatgctccaacagtgagctgggctgatcctaaaaatgctgagtcctctgctgcatctcagaaatcttctccatcaacaaccgctatcatcttctctggtctccctcttcctccacgctcaacatcaacactgaccagacaacacccaaccaaaccatcagccactatattaggactgagcccgactacgctgacaaattcaaccacctcaaaaaccaatcagagaacaaatcagagttttttttttgggggagggggggagcatgctggagattgcagccacaggaagctggaaaaactaggattggcctttcttaggattttccaggggaaggaaaaattagatagcaagttagagttgatagttagaggggcttaa

SEQ ID NO: 33162 - DNA, 222 bp, Glycine max
  Peptide Sequence Number=SeqID_124847
atgaagaatgatcacggaatcgatcacgaaaacgaaatgaggggtggaggttgcacaacagctcacccaggtgagctgcttgcttccttcgaaagtaaccttgctcgcccaagcgagctggttgcttcagccctaagcttcgtagtgggcccaggggctgaaaaatgccccaaaaatgacccttttgccctccttttgaatattttgcacatttccctctaa

SEQ ID NO: 33163 - DNA, 222 bp, Glycine max
  Peptide Sequence Number=SeqID_124848
atgcagcatgtgactagccagcaggcggctaatcacaggggtcagagccaggaccacagtcttttcccgtggcctacccccgagcagttcggagccacggttgcatggcctggggatgagcctgattttgagacaggggaaagacctgcaggggcccctagggacgatgatggagctcaagaggatgacgacatggctgatatgctagatttcttcacttga

SEQ ID NO: 33164 - DNA, 294 bp, Glycine max
  Peptide Sequence Number=SeqID_124849
atggcttcgaaaaaacttccagccaagaggtttaagaaagatgtcgctggagagggttccagtgcggccccacaggagaggcgagtccagctgagggacgaagagtatactgagtttcaagaggaaattgctcgaaggcaatggactcagtttgtatcacccatggctaagtacgatcccgagatagtcatggagttttatgccaacgcctggcccacggaggagggagccagaaacaagcgctcctgggtgagaggccaatggatccccttcgatgaggatgccattaattag

SEQ ID NO: 33165 - DNA, 193 bp, Glycine max
  Peptide Sequence Number=SeqID_124850
cgcaactctgaaccgcttagcgctcattagtgaattttggcttagcgcgtgcttttctcgctcagcgaatggactgaagcagtgcactttgctggatgatccgccacttagcgcaaatgcacagctcatccttcttccagatgtttcctcgcgctcagccgaggagtgttgcgctcagcggatggctcactaa

SEQ ID NO: 33166 - DNA, 1032 bp, Glycine max
  Peptide Sequence Number=SeqID_124851
atggcgcaaataagcacagcgcaagaattggaccgagtaaaacaaaatagaaatggggtagtcggaataccgaggaaggacttggaggagaaagtgaaggctttggcggatcaaggcgaatgggcttcattcattgatgtcatagagctattggtgttcagagtcgtcctttttccaaatgtggatgggctagtggatctagcagtgatcgacgccttccttgcttatcaccatagcaaggaaagtccggtcattgctgttttggccgatgcctatgacacatttgaccagagatgcgagaagagtggcgcaaggattgtttgttgcacacctgctctttatgtatggctagtctctcacctctttcatcatgaaagtagacctgtttgtcccttacaaggtcactgcatgtgtaccaagaaaagggaagcaaattgggagcagctcttggttggcatgcatggggcatctattaattggttccctcgatggaaggaaggaggggccagagttttatcctcatgtgaagggttctcaaatgtccccttgatgggaacgaggggttgtatcaattataaacccgtccttgccataagacaacttggctatcccatgagaggagcgtcgtcggaagaaagtgtcacgcctttcatcacacgaggtttcagtgaccccaatgcaaggacatttcaaaaggtccgaaaggcatggggtgcggtgcaaaggaaggataaagagcttaggggaagcaacaatgggatcatcggcggctatcacaagtggttgaaggctagaacacaagagatatcttggctcccgaagctaaagatctcaagtgaggaagaggctgaaacccctgaggagagcgaagaggtgcaagccttgaaggcagaacttgaaagggcccgaagcattggaaccagaaacaaagagggcccaaaaggaagaatgaggccaaaacaagttccgaggggctttgagggggcatcaacaacgagctcaagcttcgaagggccaagagagaccagttga

SEQ ID NO: 33167 - DNA, 114 bp, Glycine max
  Peptide Sequence Number=SeqID_124852
atggacttatggagagaaataaggggagtgtattttattgggtatattttaggggaaaacaaatctaaagggagtgcagtagcaacaggggaagcggaaacagcattagcctaa

SEQ ID NO: 33168 - DNA, 354 bp, Glycine max
  Peptide Sequence Number=SeqID_124853
atgacgagtgtagcagtgatgaaagcaccaagaaaagctctcgagcgaaagtattatgttatcttccaacttgaatggaagtttatcggtttatcgtatagttattatggtgaggaaccaacaatgtatcatgcaagtgttgaaaatccatctggtgagaatgttaaagttacactagaagaattgaagttctggaaaattggggagaatataactttcaggattgatttctttcctttcaagaatagcaatggaaacttagtgtttggtggcttgatatggaacaatggtatacaaagtgttaggagtcctattggtctcaacttactatttgtaacaccccatttgtcgtaa

SEQ ID NO: 33169 - DNA, 180 bp, Glycine max
  Peptide Sequence Number=SeqID_124854
atggaactgggaagcataacccactttcttcagtgcaagaatatttttgtcactggtgccacaggattccttgccaaaatttttgtggagaatgtgctgaaagtgcaacaaaatgtgaacaaactctatcttcttttgagagccacagatgttgaatccgccactcagattgcacaatga

SEQ ID NO: 33170 - DNA, 1005 bp, Glycine max
  Peptide Sequence Number=SeqID_124855
atgccttcagcatatgtatgtggtgagagaggaggactcattatagaggattcatgccaattgggcgtgtcactaaatggagtgcccggactagacattgacatggaaaagaaagcggtggaggataagttgtaccaacttcaacaagagggggctacagaggatgatattaaaatggcaatgaaggacttcggtatgaaaagagcaactatatatggatggccaaacacgtatgtctttacaaaggcaatgggagaaatgcttatagaaactctaaaggaaaacgtgtccgttgttattgtacgtcctacaatggttaccagtacttacagagaaccttttcctgggtgggtcgaaggagtaaggaccattgatagtttaattgttgcttatggcaaaggaaaattaacatgctttcttgcagacatcaaggcaacttttgacgtgataccggcagacatggtggtgaatgcaataataagtaccatggtggcgcatgcaaataagccatgtgataatatcatatatcatgtgggctcctctttagaaaatccagttagataccacaatctccaagactatggctttagatatttcaaggccaaaccatatgtaaacaaggaaggaaattatgtcatggttcgcaaagttacagtgttagacagcatggctagctttcagagatacatgttcattcgttacttccttccattaaagggactagagctagccaatgctgccttttgccaatattttcagaggacgtatcttgacattagaaggaagatctatacagtgatgcggttggttgacctttacaggccttatttgttcttcaatggcgtttttgataatatgaacacaaaaaagttgcggatagcggcaagagaaagtggggtagagatggaggagtatttgttttactttgatcctaaaatgattgattgggaggactacttcatgaatatccatattcctggtattgtcaagtatgtcttcaagtga

SEQ ID NO: 33171 - DNA, 171 bp, Glycine max
  Peptide Sequence Number=SeqID_124856
atggaagggataaggagagagaaagtggcgagtttatggagggctgaatggaagggatttgaatggtttagaatgatgaagaaggagaatgaagaaggtggttggaagaatcactcctccagaattggtgtcacacacaaggtggtgttcctcgataaaccaatttcttga

SEQ ID NO: 33172 - DNA, 723 bp, Glycine max
  Peptide Sequence Number=SeqID_124857
atggcgactcgggacgttgttttctctgctaacgtagatggcaatggcggctccggcaaagagccacctggcagcggcgacagctataccccacaacgcccaactgtggatttaatcaaggagaaagtggccaaaattgtctttgaggaagataatccttcaaagcctatggttcatattgaagaatttgtgtttcaaggtctatgtgctccttggcaggatgctttggtggtgaaacttttggggaaaaacattgacttccacaccatgaaagatctcttaggaagaatttggaaactgaaggttgggtttgacatattagatattggcaacaatttttatatggtcaaatttgatattgcggatgacagacagaaaggaacgacaacagcgaagcagactccggtgacaattaatactacaatcattccactggtggttacgcctccgaatgttaaggagaataatggggacattactattggagccaatattgatgaggagagagagtacctgcattggcagtggctagttgtcaagggaagatcaaggagcaaatctcataaaaatcagagtaaaagtggcaacgaatctattacaaaaaatcagcgccaatctacaattaattataagaaagagaaaggggttgctgccaaacctaaggcatgcacaggatatttcgtatgggcctcaaggagaaggtatgccaacaacctacaatag

SEQ ID NO: 33173 - DNA, 510 bp, Glycine max
  Peptide Sequence Number=SeqID_124858
atgtcaggatatacacgtgattctcctcaaatttcagctagcccgcatcaattagaccttgcaccttacgcttcagagccctacaatgctcaatggaatgccccggggcttctccgtgacaagcacacgttgcgttcgagtcgtattctcggagaaatggaggttgatgaaccttggttggggctttctcgctgcaaaattcatttcttggttggtgttttggtttatgctaaagggatggcctttgtggataactgggcggtaggtaaggagaagacccacattgatcctttcactggcgaagaccaaatccgcaaagctttgaaggtgccacttgagctgctaggttctccacctttgggcgtattctttgaaagatccgtgcccccttttttgcacatgttttgtagttgcatcctatccgaagccattataccgaccctgcctaacaaaggcaacattaggtcctcccaggaatggactcgggaaggttccaagttagtgtaccag

SEQ ID NO: 33174 - DNA, 779 bp, Glycine max
  Peptide Sequence Number=SeqID_124859
atggtgaaagttggaacctcttacgtgccgatcaacgtctccattttcgccaaaagttggcccagggcttcccggtatcaacagggacaccaggatttatttattctgcgaagtgatcttccgtcacagtggcttctgtttctatcagctgtcccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagaattcgatggctcttctgtggctgcttccgctacttcgctggcctcttttgagtccataccaaggctcattgatgaaggaattatagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33175 - DNA, 186 bp, Glycine max
  Peptide Sequence Number=SeqID_124860
atgggacaccttagtgatcaagggattcccatagactctaagagaataaaggtcattcctgattggcccactccaccaagtgtcgagggaaggagccaagagtatcaagaaccttggtatttgaggtcatatcctttccaagggggaggggatgatgcaatcctaacccccaagggtattggatag

SEQ ID NO: 33176 - DNA, 362 bp, Glycine max
  Peptide Sequence Number=SeqID_124861
aggcgagtgaagtgaggaacgtgttacctgctcatgaaccactcaatctacagtattgcaaagacaaacatcaagttgatctcctccccggagcttcattgccttacaggccaacttacaaaagcaatccccaagagactcaacgtaaggatgcacatgccaaagttgagtatgtgaaaagattgtatgaccaagtgaaggtgcaaattgcaaagaagaaagaaagctatgtcaagcaagcccacaagaaaaggaaggaagtggtacttgaacacggtgatgatcctgaacatttgaggacaaatgttttccaagaaggagggaatgatgagaatcatgaaactggccaaatacagggctaa

SEQ ID NO: 33177 - DNA, 126 bp, Glycine max
  Peptide Sequence Number=SeqID_124862
gaagattaccccttggcataagtatattgtgatgcaatcctatcccgcaagggcattgggtagcagactccaagtagattgggctagagatccaagggaaggccctagggttctcatgagccttag

SEQ ID NO: 33178 - DNA, 438 bp, Glycine max
  Peptide Sequence Number=SeqID_124863
atgaagcacttcactgacaccctcatcagtgccaacatagtgcataataacatcggttttgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33179 - DNA, 327 bp, Glycine max
  Peptide Sequence Number=SeqID_124864
atggaggctggatctttgagcttcaatgaggtctttcaatggagaagaggtgagaggaggcgccatccactagggaataagccatggaagaaggagcttcgccaccaagaatgtgccttggataagaagcttggagaggatgcttcaatggaggaaaagaaagagagagaaagagagaggggggagcatgaaattaaaggaggaaaagggggagagaagttgaactttgagttgtgtctcacaagactctcattcatcaaagctacaacaagtgttacacatgcttctatttatagactaggtagcttccttgagaagctttcttga

SEQ ID NO: 33180 - DNA, 493 bp, Glycine max
  Peptide Sequence Number=SeqID_124865
ggcgaattggagctccaccgcggtggcggccgctctagaactagtggatcccccgggctgcaggaattcgatcttcgatgtcgcacagaagaccttaaaaccctatcttgacgcgggtaaagtggtgccgtttagcggcacatcggagattcttccggggctaaccggcacggttcatcccggacacacgccgggttcagccttctacaccctggaaagtaaaggcgagcagatcacctttgtcggcgacatcattcacgccgcggcggtccagttcccgcagcctgcggtgaccatcacctacgatgaagatgagaacaaagcggcaagcgtacgcgagcatgcgttcgctgactttgtgaaaaacaaggacctcattgccgcgcctcatctgccgttcccgggcatcggctatgtgacgaaaggcgagaaaggcggctatgcctgggtccctgtgacctataccaaccgggacgccagcagcgcgaaataa

SEQ ID NO: 33181 - DNA, 330 bp, Glycine max
  Peptide Sequence Number=SeqID_124866
atgggagccaagttagcatatgacaccggaatttgggggatggcctttgtggataaatgggcagtaggtaaggagaagggttgggtaatgacattgttgggttggatgactaaatttgccttttttcagacccacatcgatcctttcactggcaaagaccaaatcctcaaagctttgaaggtgcgtagcccaccattttccatagtagaatactggtgccactttgagctgccaggttctccacctttgggcaaagaagcatgtctgaggtttcctggggcgtttgaactacattgccagattcatatcacagctcaccattatctgtga

SEQ ID NO: 33182 - DNA, 907 bp, Glycine max
  Peptide Sequence Number=SeqID_124867
atgcagggcaccgtggcgcagacgccgggcatggccttcccgatttccagctaccaggccaatgtgccgcagctggatgccgaggtcgaccgcgtcaaggccaaggcgcagggcgtgcagctcaccgaactgttcgacaccctgcagacctacctcggttcggcctacgtcaacgacttcaaccagttcggccgtacctggcaggtgatcgcccaggcagacggtccgtaccgcgagacggtcgaggacatcggcaagctgcgcacccgcaacgaccgtggcgagatggtgccgatcggttcgatggtcaccatcaagcagaccttcggcccggacccggtgctgcgcttcaatggctatccggcagcggacctggccggtgaagccgacccgcgcctgctgtcctccgccgaggcgatgaacaagctgaccgagatcgccggcaaggtgctgccggtgggcatgaccaccgaatggaccgacctgagctaccagcaggcgacccagggcaaggcagccttcatcgtgttcccggtggcgatcatgctggccttcctggtgctggccgcgctgtacgagagctggtcgctgccgctggcggtgatcctgatcgtgccgatgaccctgctgtccgcgctgttcggcgtgtggctgaccggtggcgacaacaacgtgttcgtgcaggtcggcctggtggtgctgatgggcctggcgtgcaagaacgcgatcctgatcgtcgagttcgccagagagctggagatgggcggcaagggcatcgttgaagcggcattggaagcctgccgcctgcgtctgcgcccgatcgtgatgacctccatcgcgttcatcgccggcaccgtgccgctggtgttgtcgcacggtgcaggcgccgaagtgcgctcggtgaccg

SEQ ID NO: 33183 - DNA, 615 bp, Glycine max
  Peptide Sequence Number=SeqID_124868
atgccacccaccaggcaccctctagacccggataagtctaacagggccctagggtttctagcattgatcacgggcctttgccagtcattcagggttctcgtcacacctagtaaggtgattcgaccgccgatcacccgggccttcattgagaaatattgcacgcctaggcaggcacagggcgatgcaccacaggccgcagacgcatcgccaccacctcatcaggctgatcctgctgggtcattaggcatggagcggtatctacaacacttggtttgccagcaggcggccaaccaccgggggcaggtgcagatacatgagtgtctctaccagctcagcctcagtcagcagggccagggtttcattccttttgcgtgccctactccagatcagtttagggctgaggtcgcatggcccgaagattggcccgaggcccaggcaggggaggcacctgcagaagctccgagcgatgtagaggaggcctgcatggatgaggagatgacagattgctcggtttcttgggagggagcagagccacatgactatgggatccccagattcattcttttttatgtttcatcctttatcatttacatgttatttattttaatgacttga

SEQ ID NO: 33184 - DNA, 216 bp, Glycine max
  Peptide Sequence Number=SeqID_124869
atgttggccacccacttcgggtatcgagctacagctaagaaactcgcatcgaactactttcttacttcttctttgatttttaaagacatctcgggtctcatccttcgtagctttcgcttaactggggaagacccaggattcaatggcaacttatgctgcacaatgtcggagtccagactgggcatatcttggtatgaccacgcaaagatgtcttga

SEQ ID NO: 33185 - DNA, 513 bp, Glycine max
  Peptide Sequence Number=SeqID_124870
atggtcgctacagacgtccgaaaagagtgtgccgggttacgagaagaaaatgcagttaccacaaaagcccttgaacaagaaaccaagagggctcgcaagaaagagcatggccgtgacaaattccgtggagcattgtggggcagcaacagtgagctcaagcttcgaagggaagagagagaccgatcacgagcacatagcatggtcttaaaagaagagttagccgcttgctcaagtctagccacgacccatgagcatagggtggtggacgagtatgcccaagtgtacgcggaaaaggaggctagaggaagggtgattgactcattacaccaagaggcaaccatgtggatggaccgattttctcttaccttgaacgggagtcaagaacttccccgattgctagctaaggccaaagcgatggcggatacctactccgccctcgaggagatccacggacttctcgactattgtcagcatatgatagatttaatggcccatataattaggaaccgctag

SEQ ID NO: 33186 - DNA, 240 bp, Glycine max
  Peptide Sequence Number=SeqID_124871
gaattcgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 33187 - DNA, 312 bp, Glycine max
  Peptide Sequence Number=SeqID_124872
atggcttatgtgtggttacattacatgtattacaggtggtatgcatgtgaaaaacagaagagaatgtccatgaccttgaatggaggaaagagatacaaaaagcagaaaaattgcataaaactggatgatgttgggctttcacataatagaggaagagagaatatatatatgtgtgtgagtgtgtgtcaatctcctgcagaagcagaaggaacaaaaagaagtggaaaccaagcaattccaaaagggaacaaaacagctataaaggagcctaaagagtgtgtgagagaggagttatggggtctatatatatga

SEQ ID NO: 33188 - DNA, 204 bp, Glycine max
  Peptide Sequence Number=SeqID_124873
atggttaaggaggagtgtaaggaggtaactgtctcctccaagagacaacctccacattttctcctttgtaaaaagacacttgttagcattgccacacctcttgggcttgagtttattcctcaagtaaaggagttgttggatgagggtttggttcgcaagaacttaaatccttgtgctttgttggtgcccaaaaataggtgttaa

SEQ ID NO: 33189 - DNA, 654 bp, Glycine max
  Peptide Sequence Number=SeqID_124874
atggctctcactcttattccaaagaaagaccaaggtcaaggaatcttaggggtgagaccttctaagcccaaagatgataaggggaagacaatagaaaagcaaccccttaaggctagtatgcaagagaagactagctccatgaagtgctttaaatgtattggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctctaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggaataatcaacatgaaaatacagaaaaatcgaattcctgcagcccgggggatccactag

SEQ ID NO: 33190 - DNA, 106 bp, Glycine max
  Peptide Sequence Number=SeqID_124875
gaattcgataccaccaaaggaagtcatggataagagtttgaaagtagaagaagatgagtggagggagaaggacagaaggagcataaaattttatgcctcaaatgag

SEQ ID NO: 33191 - DNA, 717 bp, Glycine max
  Peptide Sequence Number=SeqID_124876
atggaaaaacggctttgccgcggccctctcacttccctgttaagtatcttcctggcatcttccaggaaatcctcccgccccgttcgtaagccatttccgctcgccgcagtccgaaccgacccgagcgtagcgagtcataagccagtatacactccgctagcgccccaatacgcaaaccgcctctccccgcgcgttggccgattcattaatgcagctggcacgacaggtttcccgactggaaagcgggcaggaacaaaagctggtaccgggccccccctcgaggtcgacggtatcgataagcttgatcctcaaggatgtaggggcggcgcgcggtcgagatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33192 - DNA, 883 bp, Glycine max
  Peptide Sequence Number=SeqID_124877
ctccaccgcggtggcggccgctctagaactagtggatcccccgggctgcaggaattcgatgctcaagattgatgctgataatctcaacgcattccttgagacagctgtgggccatcctgggaagattctcaagaaagatctgactacactagctcaggtgtggagtgttctctcatactccaacttggcccccacatcacatacttctgatttgatagtggagagagctaggctgatctttggcctagtctctcacatggatatgaacataggagcgcttatctctggccagatgacttctacagcccagtctaacacttctagacttgggtttccagctctgatcaccgcattatgtagatccagaggggttgtctctgatagcctcacttttgagcgcctgagcccggtcattaacttggcctacatcaggaaaaactgttggaaccccaaggctctaacaatttctatccgaggggttaggagggtgagggctaggccagctgagctcccttccacttttgcggctcctactccagcatccatgtcagtggtggcgcctctaggatctattccctcagtcgagcagttcaaagagatggtagtctggtctaggaatcaaccttctcttcacaaggaagataaaggtcccacagctcaggtaccacagaatatggaggatgagttctctgaggccaccattccagagccatttactgcaggggaggaggcaggtgacacacagatgacacaagtagctactgccacttctgagagatctcttgaggccacttcagagcctcctgcatcagcagtggacctaccttcacctcagcacgcaacagacccttctactcctgtcctagagatacctaaagactag

SEQ ID NO: 33193 - DNA, 493 bp, Glycine max
  Peptide Sequence Number=SeqID_124878
gagctccaccgcggtggcggccgctctagaactagtggatcccccgggctgcaggaattcgattccccggctgtctcacgaggaatacactgtaggatgggtgtgcgcactccccgtcgagctggcggcggcgcaggaaatgctggacgaagtgcacgaagaccatgagcgcgacggcaacgatgagaatctatactccctaggatcgattgctgggcacaatgtcgccatcgtctgcctgccagcgggatgtattggtaacaaccctgcagcggttgtggcgacacagatgaaggctacattcaagggaattcggttcgggctgatggttggcatcggcggaggagtacccagcgccgcagcggacatccggcttggggacgtggtggttagccagcacgataagacgtttggcggggtggtgcaatacgatgctgcgaaggcgacgacgagcgggttcgaacggacgggatcgcttaacgcgccaccgaag

SEQ ID NO: 33194 - DNA, 246 bp, Glycine max
  Peptide Sequence Number=SeqID_124879
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttcaattcttcctgcaacttcaattcttcatttgactttttatcttgccttgtgcattgtgcagcccgatcttattccttga

SEQ ID NO: 33195 - DNA, 133 bp, Glycine max
  Peptide Sequence Number=SeqID_124880
atggagctcggcttcaggtgtgatgcattgaaaggcagtttgtccaacgtgcttttgggcatgacattcaacgacgagccgtgttcgataagaaccttggccacgatgtggtccaaatacttgacgaacacat

SEQ ID NO: 33196 - DNA, 351 bp, Glycine max
  Peptide Sequence Number=SeqID_124881
atggaggaaggaaaggagggagttctcttctcatgtggggactacctaaacatcccgttgatagaaatgaggggttgcattaactacaatcccacacttggtataagacagctagggtaccccatgaggggagcaccagcggaagagagcctctctcctttccttgtgagagatttcggcgcgcaaagtttcaagattatacaaagagtccacaaggcgtgggaaagcctgttaaggaaagataaagaacttaggggcatccgtaatggcatcgtcggtggttatcatgaatggctgaaagttcgtacacgagggttagattggctctccaaattgaaagctatcaactaa

SEQ ID NO: 33197 - DNA, 438 bp, Glycine max
  Peptide Sequence Number=SeqID_124882
atggaagacgatgttaatcttcgcgtgtcaacgggttcgttggccctgattgacaaaagggcgtctccgcatgccaacggactcacgggttacgatagtgaaagtctctaccgggagatgctgacatctccgaatgacgaggtgcggataaccggaaggtgtctccgtatgctaccagactcttgggtcatgatagcaaaagtgcggggcgagaaagtcgctagcgcacaggatcttggttggcaatcaaagggagaggaccacttcaggcaaggatgggcattctcaccctgggtcaaggtttatggtgagtcgggattttggctcaaggcttgtagaacggctggacatgatatatgtcagggtgttggtttggccagcgattcagggataaaggagatgtcccacaatatttccatgatacacatgcaacaatga

SEQ ID NO: 33198 - DNA, 273 bp, Glycine max
  Peptide Sequence Number=SeqID_124883
atgaaaacattaagcactactttggaaggaaaggcagatcaagctatgcctcggtggattgaaccaaagagtcatgttcaaactggaggctacaagtgtggatattatgtcatgcattgggtgtggtgcatagtgagcggcggtttgaagaatgaatggaataggtggttttgtgatggaataccgctaaacaaagaggtcatgacaacactccgcaacaaatgggcgagatattttctccagattaagaacatggaagttagaaaaatttag

SEQ ID NO: 33199 - DNA, 351 bp, Glycine max
  Peptide Sequence Number=SeqID_124884
atgactagaggcaatccatctgacttacaaccctttgatcctgagatagataggacattttatagattagttagacatcatttaataccttttgagcatcatgaacattctgttattggtgattttgagcattattgttttgaacattctaattttgaacattttgagaacatggcacaacctccaccccgtgagaggactctaagggaaatggctgcacctgatttcacctacgaaagcttgtgcatccaataccctgatgaggatgtcccatatgttcttaaaactggactaatccttttgcttccaaattttcatggccttgagatgaagacccacacaaacatctga

SEQ ID NO: 33200 - DNA, 237 bp, Glycine max
  Peptide Sequence Number=SeqID_124885
atgtcggctgaaaaatatcagtcgggatacttcagcgacagatgtcgttctattgagttttctattcaatcccttaatgaaatatgcatgatgtcggataaggaaatgttcgatcggacgtcatgcggtcatgcttcttttttagacctcgatcggtcatctttcctggcggacgtcgactgtcaattttttccgatcaatatcggtgaaaaatatttttttgccgagatgggctaa

SEQ ID NO: 33201 - DNA, 339 bp, Glycine max
  Peptide Sequence Number=SeqID_124886
atgacgaacgatggttcgaagatgacaagcaagtttgcgaagttggacaagtttgaagggcaggatttcagaagatggcagaagaagatgcactttctcttgacaacattgaaggtggtgtatgtgtctgagtcccgacaaattgtccggtgttggaagtgtgggaaacttggtcatttaaagagcgattgtcgggtgtcaaaggaaaggatacaaggagatgtatgggctgctcttgaatccaagtatagagcagaagatgctcaaattgaggagtcgctgagggctcaggaaattgacaaagtcaatcgaattcctgcagcccgggggatccactag

SEQ ID NO: 33202 - DNA, 204 bp, Glycine max
  Peptide Sequence Number=SeqID_124887
atgaatctcttcgggggcggagtaggtatcccttatcgccttgtcgaagccggcactttgaacttcggaggaagagcatcgagctgtcctcctattgcttcagttgccgggggccggcctaactcttccatagacaaaactattggcgatgctgcgatgttgggttgggacaacgtgcctggtgccggtcggggcgggggataa

SEQ ID NO: 33203 - DNA, 255 bp, Glycine max
  Peptide Sequence Number=SeqID_124888
atgggaatactcgattctagcaaccctaaggctccattttcactttttgctttcattttcttgtgctttcgttcatccccacaagcctatcttggggtctggtatgaattggcatgttacatcgaccctgttcctcattttttcatgtttgaacatgagcctaccaagtgttcggtgaaatgccttaatggcctttgtgtgtggctagcatttgaacttgctgcatcatgggcatgcaaggttgcttcaggatga

SEQ ID NO: 33204 - DNA, 387 bp, Glycine max
  Peptide Sequence Number=SeqID_124889
atggcatccaggaaaagaaaaagctcagcttctagacctgcagctcagtatgatactaggcgattccaatctttggaagcttggaatagatacatggacaacattctcgaccggaatatccttccagagagaaatgtgcaaatttattatactgagttcgatgagtttgaagtggagttggagagggccaaccatggaaaactccttagaaaagatctaactacactggctcagacatggagtgtcttctcttactccaacttagctcccacatcccacacctcagatttaaacatggacagagctagagtaactcctctaggctcggatttccaacctttatcaccgccctttgcagagctagaagagttacctctgacagtctga

SEQ ID NO: 33205 - DNA, 351 bp, Glycine max
  Peptide Sequence Number=SeqID_124890
atgaaggccgacatggaggccatgaaagagcaaatggccacaatgatggtggccatgatgagcatgaagaagataatggaagccaatacagttatagttgccgctactagcgctgtcgctaaggtgaacccgatgctcccatctggcctcaagcaaatgaatcatccaacctcaaatatggtaggcaaagatttgggaagtacggacgaccccatgatgtgcaaattcaaaacgagcacgccttcccatcatatagattgcctcccaactatacaccacccaatgtggcatacactctcaatgaaaatctcaataactcatcgaattcctgcagcccgggggatccactag

SEQ ID NO: 33206 - DNA, 987 bp, Glycine max
  Peptide Sequence Number=SeqID_124891
atggttactcccatggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaagaatgcgagtatggccagaggaggaactggtctgacgggttcgatgaggaggccatctcccagctgctatgtacaccggggcaggattttgcccggactgctgcagggaggcgagtgcgagtcatgcgcaccaacatgaccaccctgacccagatatggatgacgttgctcctcagcaacatcctgcccagcgatcataattccgacctccccctgccgaagtgtcagctggtgtacgccatcctgacgcggatgagcgtccatgtggctcagttaatcgctgatgccatttatatttttgcagtccaacagggccctgggatttcctacactgatcacaagactctgccagtcgttcggagtccccgttgcacctaccaaggtgattcgggccgcctatcacccgggcttttattgagaagtactgtacccagagacaggctcaaggtgatgctccacaggccgcagcacgccccaccacctcatcaggctggccaagctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcctggcgacggagaagaggcccacgaggatgaggagatggctgatttgcttgacttcttgggagggagtggagatacgtga

SEQ ID NO: 33207 - DNA, 204 bp, Glycine max
  Peptide Sequence Number=SeqID_124892
tgcccagggcttcccggtatcacagggacaccagattattatctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 33208 - DNA, 362 bp, Glycine max
  Peptide Sequence Number=SeqID_124893
tgcctagaggtgtttgggagaccctcgaagcaatgagagtgccgattcgtggcatgattcgactcactgctacttctagtacatcggaggaacccgcacgcacgcttcagcggactgtggagtggatactacctacacctactccatatcgactagtggagccagttcaagtgatagaggtgtcatcctctgaagaagaccctaaggaggacccagaggagttacctcctgagcctactgatgatgaggacccactccctgatgtggattctccagaggatatcatgtcagcatctgaggcaaactctacggaggagagcggccctggagggacagcgaatagtggagactcttcatcatag

SEQ ID NO: 33209 - DNA, 738 bp, Glycine max
  Peptide Sequence Number=SeqID_124894
atgcccctcttgggggaagaaaaatcgtatcttttcctccgggtttcttccctccttgagcaagattgcaactgtggtcggggattcggcaaaagagttggatcgcatgaagcaaactcgcaacggcgtagtaggcctgccacgaaaatacttggaaggcaaggcaagggatatggcgagccaagagaagtggggcccgtttgcggatatactagctttgttgatttttggggttgtcctctttccaaacgtggacggtttggtggacttagcgcgattgatgctttccacacatatcaccatagcaaggagagtccaatggtggctatcttggcggatttgtttgacacctttgacctgaggtgtgagaaaaacagtgcacggattgtctgttgtttacccgctctttgtgtgtggttggtttcacacctattccaacaagacacaagacccctgtgtccgcttcaaagttatcgctcatgcgccaaaaaaggaagagtcgattgggaccaacatttggctgggataggaggcaacacaatcaattggtttcctcgatggaaggaaggcaaggagggagttcttttcttgtgtggggactaccctaatgttccgttgatagggacgaggggttttattaactataatcccgcacttgccataagacagctaagggtaccccatgaggggagcgccaataagaagaaagtttctcgtcttttccttgtgaggatctag

SEQ ID NO: 33210 - DNA, 234 bp, Glycine max
  Peptide Sequence Number=SeqID_124895
atgtggtcgctgggcagaatgttgctaaatagcaacgtcatccacgtaagggtggtcatgttggtgcgcatggtccgtactcgcctttttgcagcggcacgggggaaatcttgccccggtatgcatagtagatgtgtgatagcctccctctctggacgtgctcgcacagttggtcgccctccaatatcagggggtggcccaggaactgataaaaggaaactactggccccttaa

SEQ ID NO: 33211 - DNA, 109 bp, Glycine max
  Peptide Sequence Number=SeqID_124896
atggattggatgcataaacttgagaatgatgaaggccaagttgtaggagagcatcatccacagaagatggttcaaggaaaatttgtcccaaatttcggggaggcacttg

SEQ ID NO: 33212 - DNA, 409 bp, Glycine max
  Peptide Sequence Number=SeqID_124897
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttcccctggcggctcctcgtgcgctctcctgttcctgcctttcggtttaccggtgtcattccgctgttatggccgc

SEQ ID NO: 33213 - DNA, 375 bp, Glycine max
  Peptide Sequence Number=SeqID_124898
atgggtaaagtcgagaaggtgcaagagcagatgaaggccgacatggaggccatgaaagagcaaatggccacaatgatggaggccatgatgagcatgaagaagataatggaagctaatgcggttgcagttgccgctaccagcactgttgctaaggtgaacccgatgcccccatctagcctcaaccaaatgaatcatccaacctcagctatggtaggcaaagatttgggaagtacgggcagcccccattatgcgcaaattcaaaacaagcatgccttcccaccatatggcttgcctcccaactatacaccacccaatgtagcgtacactcccagtgagaatgtcaataactccactcctatactcattgagagttga

SEQ ID NO: 33214 - DNA, 813 bp, Glycine max
  Peptide Sequence Number=SeqID_124899
atgggtgaagtagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttaggaagtacggatgaccccatgatgtgcaaattcaaaacaagcacgccttcccgccatatggcttgcctcccaaactatacaccacccaatgtggcgtacattcccaatgaggatgtcaataactccactcccatactcattaagagccaacaacctcaatctgatcatgcacatgtctctcgacccatggaggagacacatggaatgccccaccacaatctagccgacttcgagccttgcctcggatatgccactgaagggcaagcagttggtggtatacccctgcaaaatactttggagggccctcagtgtcacccacaaccacaaccctcacattccacagcggttaaaaaccctcatgctatggcagaaatgggaaagaggaaaggctcagggccattgaaggagaacatgtgcaaaaagggagacgataatcgtgatggtagacacatttatcggtactctactatgaaaagatggtgggctgcgcaccctcaaagctttgcggattttggttcttcgccagtgaaagggatcgatgtggtttcgaaaagaggtaaatttgatcatccttactatgacgactga

SEQ ID NO: 33215 - DNA, 369 bp, Glycine max
  Peptide Sequence Number=SeqID_124900
atggggggtgcaaatagcaattttgtaattttgaattgggccttccagactgtttttcgaagctggattgcttctggaggaaacaacccagctcgcctgggcaagctgggcggcaacctcctccccctttttcctagaaaaaggcaaaagggggttgttctaagggtccctgatccccctgatttatgcatttcagctgttttgggtgaaaaaaattgtttccgtgaagaaaatccaagccgaggtgctttcgtaacacttctgagatgtttccgtaaccaaatccgtgaaggttttcctccgttcttcaccgttcttcatccgttcttcgttcttcaacgcgtaagtttccaaatccgagacttttaa

SEQ ID NO: 33216 - DNA, 312 bp, Glycine max
  Peptide Sequence Number=SeqID_124901
atgataagatgtgactgttggcgatattccttgaaaatcctctctggaaggcataggtcacatcttagacctcactcccatagaagagaaaaggaaagaaagcctcaagaggctaacattaacctcccatacttccatgggaaggacaatgtagaggctaacttagattgggaaataagggtagagcaacaacttaaaaagaagtctacttcaaaatcttatgtctctcactcttatccaaagaaagaccaaggtcaaggcatcttaggggtgacatcttctaagcccaagatgataagggaaaggcaatag

SEQ ID NO: 33217 - DNA, 653 bp, Glycine max
  Peptide Sequence Number=SeqID_124902
tcggtgctgctgcgcatgcagctatttttatggtaagagattatgatccgactattcgatacaacgatctattagatcgtgtccttagacatcgcgatgcaatcatatcacatcttaactgggtatatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctagggatagtaaatcatatcacaggagaaattttgcgcagagttccattaccattaatgggtggctccgtgatttcttatgggcacaggcatcccagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgcagtaggataa

SEQ ID NO: 33218 - DNA, 269 bp, Glycine max
  Peptide Sequence Number=SeqID_124903
atggtcagaacacgaggtttaggtcgtgccataggtagagttgtaggcagagatagacctactgaccaggatgctactgatgttcccgagaggcgtaggcctactgcctcagcccgtaagctacgcgacgtcgctgacatgtctgacgatgtccctgagcaggctgcggaggcacctgagatgcgtgcggacgcacagggtgctgatagtggtgaggggtcagatggtgatgatgctgctgagggattccctggtggtccacgtgaccc

SEQ ID NO: 33219 - DNA, 1002 bp, Glycine max
  Peptide Sequence Number=SeqID_124904
atgtcatggctgcaaagtaagggtgcttttccattaagcccaaagcaacacttccttcaatatttgggtgttcaagctgctggtgtaagaaataatagatggcaatgctggtggcttgctttaacttggtccatttggaaacttagaaacaatatagtcttctctaatgcaaatttcgatgctaataaactgtttgaagaagcaatattcctcctatggtcttggcttaggagtattgagaaggattttacagtgcattttaatcactggtcaaaaattgctgataaaaaagtagcagcagctgaggcatggattgaagctctcaaggccagcgagaaggaaatactgatggaaacaaaaatagctcaaagacaactcaaagaatcaaaattggagcaagagctggaggtttacaccaaagagaatatgctttcaagaagagttagtagtagtgaggagcttcacaattcatatgcatattttacacttaggtggcacaatccagtttttagtttacaattacacgaaccccagaaaaagcaccagatgctggacaccatggtttggaaagctgatcctagtggtttttattccactaagtcagcatataggctattgatgactttctacagacctgttccgaggaggattttgcagactattgaagcatgcaatgcacacaaaaaattctctatagagactaaatggggcactatgatgggcagctatcctttttcagaagaacaaccaattccggttacatggagaagtcttgtctatagctttggagcggtgctgcaagaactactaacagggagaaggccagtggggaatttttggggaagaagcaatgacaaggtggtgaagattcttgatgagaggctatgtcacattcccttagatgaagcaaagcaggaacaaagtatggagagaccaaccatgagggaagtggttgaaatgcttgcacaagcaaagaaaccaaacacattccaaaagcagtga

SEQ ID NO: 33220 - DNA, 246 bp, Glycine max
  Peptide Sequence Number=SeqID_124905
atggttcgccagcagacggccaaccaccgcgggcaggggcagggctcccctccttttgtatgcccttccccagagcagttcagggctgaggtcgtgtggcctggagattggcccactgaggagggaaccggacccgcaagatccccaggcgaagcgaaggaagcccacatgaatgaggatatgaccgacctgctcggtcacctgggagagggcggagctacacgaccaaggtcgccgcacttgtga

SEQ ID NO: 33221 - DNA, 483 bp, Glycine max
  Peptide Sequence Number=SeqID_124906
ttcctgggccaccccctgatattagagggcgaccagctgtgcgagcacatccagagagggaggctatcacgcatctactatgcataccggggcaagatttcacccgtgccgctgcaaaaagacgagtgtggatcatgcgcaccaacatgaccacttttacatggatatggatgacgttgctatttagtaacattctgcccggcgaccacaatgccaatctccccctgcagatgtatcggaatcacacctacaaagacacccagtggacccggagaagtccaatagggccctggggtttccagctctggttacgggcctctgtagtcctacagggtgcccgttccccccagcaaggtcacgtcatcatagggatcgcgcctgcaagacacccagtggaccccgaagaagtccaacagggtcttggagttaacgaggccccaggcaggcgcagggcgaaacaccacagcaacattgggatggccg

SEQ ID NO: 33222 - DNA, 552 bp, Glycine max
  Peptide Sequence Number=SeqID_124907
atggagaaatacggcattccgcaaatctccaccggtgatatgttgcgcgcagccgtgaaggccggcagtgaactgggcaagcaggcgaaagagatcatggacgccggcaagctggtgaccgatgagctggtgatcgcgctggtcaaagagcgcatcgctcaggaagattgccgcaagggcttcctgctggacggtttcccacgcaccattccgcaggctgacgcgatgaaagaagccggcatcaacgtggacttcgtgctggagttcgacgtgccggacgagctgatcgttgaccgcatcgttggccgccgcgtgcacgcgccgtccggccgcgtataccacgtgaagttcaacccgccgcaggtggaaggcaaagacgacgtgaccggcgaagagctgaccacgcgcaaggacgatcaggaagagaccgtgcgcaagcgcctggtggaataccatcagatgaccgcgccgctgatctcttactacagcaaagaagcggcggcgggcaacacccaataccgcaaaatcgacggcacccgcaaggtggccgaa

SEQ ID NO: 33223 - DNA, 715 bp, Glycine max
  Peptide Sequence Number=SeqID_124908
atggaacctctccaaatgcaagctttcagcaagatttacggaaagatcttggagttgaccatagcagaggtatccatagaagccattgcatcgctcaccgaatactacgaccagccgttgaaatgcttcacgttcggagatttccaattagtaccaaccattgaagaatttgaggaaattctaggatgtcctctcgggggaagaaaaccatatctttcctccgggtgtctcccctctttaagcagaattgcaactgtggtcaaggattcagcaagaggtttggaccgcataaaacagactcggaacagcatagcgggcctaccacggaagtacctagaagataaggcgaaggatatggcaagtcaaggggattgggtcccgtttatggatgtgttagcattgctaatttttggggtcgtcctctttccaaacatagatgatttggtagacctagcagcaatcgacgctttccttgcatactaccatagcaaggaaagtccggtagtcgctgtcttggcagatttatttgacacgtgtgaccgaaagtgcgaaaagagtagcgcacggatcatatgtcgcttgcccgctctctatgtttggttggtttcacacctattccagcaagacacgaggcatccatgtccgctccagagccatcactcgtgtactgaaaagagaagaatagattgggaccatcttttggccgggataggag

SEQ ID NO: 33224 - DNA, 786 bp, Glycine max
  Peptide Sequence Number=SeqID_124909
atggcggatgccgccgccgatcacttcgtggatatcgcgcacggtgaacgccacgtggttcaggccccgtgggcggttcggcagcttcagcaggaacaggttatggtggccgccgcgcgcctgggtgcgcaggaagacggcgcgatcgatatagcgatcggaaacctggaaatccaacagctcgcgatagaaacgctcggtcgccgccagatcctcaacgaagaacaccacgtggccgatgttgatcggctgtgcctgcgcatagaccgggctgggttgatcgatgcggcgcacgtcgccccattggttgattggcgtgaccggcacctcgaccgcctgctggcggctgacgacgaagcgcagcgtcatgccgttgggatcgagacattccagctcttctcccacctgccggaagccgggcatcaacgccaaacgcggttgcaggcgcgccagatcggcgggcgaggccacgccccaggtcatgcggcgcagggtagaaccaccttcaaacgccgcaggcagcgccgcgctttgcaacgggtgcaggacgatccgcgccccgctcagggtagtgaattcgcgctgcggttcgccccaatgttgcgtggcgggctgcaggccgaagtcttgcatgaatttttcgcaggttggcagatcttcgacgccaaattccagtttttcgattccgattacgctcattgttcagcctcacgttctcgctgcatacggttttcaggcatgagtcaaccccggcccctgtttgctacgggccttattcctgcctga

SEQ ID NO: 33225 - DNA, 203 bp, Glycine max
  Peptide Sequence Number=SeqID_124910
ggcttcccggtatcaacagggacaccaggaatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 33226 - DNA, 246 bp, Glycine max
  Peptide Sequence Number=SeqID_124911
gaaaaagaatgtgtatgtgtttcttgatttcagggttgtcatcatcaaaaagggggagattgtggaagcaatgccttcaaaggttattttgatgatgccaaagaattcaagaatcaagagaaagattcaagagaagtttcaagtttcaagttttcaagaatcaagaatcaagaataatcaagaacaagattcaagattcaagattcaagaatcaagagaagacttaatcaacataagtatgaaaag

SEQ ID NO: 33227 - DNA, 878 bp, Glycine max
  Peptide Sequence Number=SeqID_124912
acttagccgccattgatgctttcctcgcatatcaccatagcaaggaaagtccagtggtggctatcttggcagatttgtttgacacctttgaccggagcgcaatcaattggtttcctcgttggaaggaaggcaaggaaggagttcttttctcgtgtggggactaccctaatgttccattgatagggactagggggtgtattaattataatcccgcgctcgccataagacagctagggtaccccatgaggggagcgccaacggaagggagtctctcacctttccttgtgaaagatttaggcgcgcaaggtctcaagattatacaaagaatccacaaggcgtggaagagtccgttgaggaaagacaaggagcttaggggcatccgtaatggcgtcatcggaggagaacttcgaagctccggaggagatgaagaagtccgagctctaaaattagagctagggaaggcaagactcgccaaggagaatttcaaagcagctgctacacacatccgaaaagagtgcaccgagttacaagaggaaaacgcggccactgcaagagcccttgaacaagaaaccaaaagggcccacaaggaggaatatggccgagagaaattccgaggagcattgtggggtagcaacaatgagctcaagctccaaagagaggaaagagatcggtcacgggaagaattgaaccagtctatggcccatgaacaaaagctagtggaggattttgcacaagtgtacgccgaaaaagaagcaagagggagggtgattgatgcattgcatcaagaagcgactatgtggatggataggttcaccttgaccttgaatggaagtcaagacctcccgcgtctattagccaaagcaaaagccatggccgaa

SEQ ID NO: 33228 - DNA, 240 bp, Glycine max
  Peptide Sequence Number=SeqID_124913
atgcgtccctgcacctatatattcagatttcaaattctgaaacctacaactcttctttcgaagattttggaaaggtttgatggttttcaaacctttgttggtgagaggtttgacactttggaattgcaagtggatatgcgcttcaatgaaatggagtcaagaatgacaaaggttgaagaagatgtgtcttacattcgttcaagcttcgatcttccaccaccgccaccaccatcatcttag

SEQ ID NO: 33229 - DNA, 264 bp, Glycine max
  Peptide Sequence Number=SeqID_124914
atgggctatctcgtgattgaggcgcaattgcgggcgatcattacgggggaaaaaaccgaagtgtcgcccccagaactggcgaaggaattgctggcggcgcgggtaaaaattggcgagctggaacgtcaactggcgacgccgattcgcttacctttctccagtgcgagcccggtatgcgaaattgaagcgggatatgctgcgggagtcagcgattgccgtcaggcaattcgtgaagccggttttcctattgagggggatgattag

SEQ ID NO: 33230 - DNA, 775 bp, Glycine max
  Peptide Sequence Number=SeqID_124915
ttgaactcttacgtgccgatcaacgtctcattttcgccaaaagttggcccagggcttcccggtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatgaattctctcccaaacttcataagagtgaacacatcctataactcgacaaaatcgacattgaaagtgtcgattgaagccatggttaatttcgagcttggcgtaatcatggtcatagctgtttccttcgggaaacctgtcgtgccagctgcattaatgaatcgccaacgcgcggggagaggcggctgcaccggtggcggcagcagaatatgtgatacaggatatattccggttcctcgctcactgactggctacgctcgggtggttcgactgcgcgagcggaaatggtttacgaacggggccgaagaatttctggaagaatggccagggaagatacttaacaaggaagtgagaagggccggcggcaaagccg

SEQ ID NO: 33231 - DNA, 240 bp, Glycine max
  Peptide Sequence Number=SeqID_124916
atgggacaccttaggtttgtcatactttttggtaggaatgatcaacatgaaaatacagaaaaaagtgatcaaggggttcctatgaatcctaagagaataaaggtcattcctgagtggcccactccatcaagtgttgaggaaaaaagcccagagtttcaagaacctcgggatttgaggtcaaatcctgttcaatggggaggatcaagcttatcgataccgtcgacctcgagggggggcccg

SEQ ID NO: 33232 - DNA, 236 bp, Glycine max
  Peptide Sequence Number=SeqID_124917
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggacatcagcgctatcaagcttatcgataccgtcgacctcgagggggggcccg

SEQ ID NO: 33233 - DNA, 544 bp, Glycine max
  Peptide Sequence Number=SeqID_124918
atgattatgagaggccaagacatttatagtagccaagatgaggctactacttcaccttcctctagtgaaagtgaagaagcaaaggggggagaatctagtgaagaaatctatccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctatgataggtggtataatgaatgtgttgagtggtgcaacactcttttgtaaaatcactcatgcacccaacatcttcatgatttgtgtaatcaagcttatcgataccgtcgacctcgagggggggcccg

SEQ ID NO: 33234 - DNA, 70 bp, Glycine max
  Peptide Sequence Number=SeqID_124919
atggagttaactgaccacaatagggagtccatcaagcttatcgataccgtcgacctcgagggggggcccg

SEQ ID NO: 33235 - DNA, 354 bp, Glycine max
  Peptide Sequence Number=SeqID_124920
atgactttacaactggctaacctctctattaccagaccatatgaagtaattgaagatgtgctagttagagtgaaacattttatcttcccggcagacttcgtggtaatggatatctgtgaagatactgacattcatacaagcccactccagaacaaaatgtttgcttacagtcttttcgctaagcgcacgcctcgtgctaagcgcatatttgttcatgcgctaagctgcgagtctcaagcgcttagcgatcaacccttacatctgaggcttatttggtccgctaagctggccaaggctgagctaagccaacttcaattcgacctgaattcggctaagctgcagcctaatcactaa

SEQ ID NO: 33236 - DNA, 321 bp, Glycine max
  Peptide Sequence Number=SeqID_124921
atgacacgcggagagaaatttggtcattccgcacccctttgccattcagacacaaccgtgtccgatggcgcgcagagacaaaaattggtcattctgcaccctttgtcatccagaggcggcgggcccgatgacacgcggagacaaaatttggtcattctgcacccctttgccattcagacacagtccgtgtccgatggcgcgcagagacaaaattggtcattctgcaccctttgtcatccagaggcggcaggcccgatgacacgcgaagatttcaaaatttggtcttccgcactcacaagatctgtcatacatgacttttga

SEQ ID NO: 33237 - DNA, 201 bp, Glycine max
  Peptide Sequence Number=SeqID_124922
atgcaaagaagcaatgtaccaaatatcatgctcggtgtgcaaagaaagggttgcctaagctaccagaagacaattgattctgaaagatggatctatgttggagatgcttcctatggtgaatcctttaatgcagaattgcgtggtactaagcgtgtagaattgataatacaaactcaggagcattatggcataagcgcttag

SEQ ID NO: 33238 - DNA, 141 bp, Glycine max
  Peptide Sequence Number=SeqID_124923
atgagcggaagacaaaggagaagaggtgagaggaggcgccatccactagggaataagccatggaagaaggagcttcgccaccaagatgagccttggataagaagcttggagagatgcttcactggaggggggatcctctag

SEQ ID NO: 33239 - DNA, 413 bp, Glycine max
  Peptide Sequence Number=SeqID_124924
atggctggacctccaattgctaaccaggtttcatcatccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagcc

SEQ ID NO: 33240 - DNA, 251 bp, Glycine max
  Peptide Sequence Number=SeqID_124925
ctggtaccgggccccccctcgaggtcgacggtatcgataagcttgatgtggaaaacgtcggaaaaaccgaaggaaaccggtcaaaaataaaaattctaagttcgggagttgtatttacgcttgaggaaggtattagcacctcttacgtcgacaaaagcggggcttttgctcctacgtaccctcctttggagaggaaatcagacctacgtagttctttcttatgcgtgaatcaagcgattctttttacttga

SEQ ID NO: 33241 - DNA, 49 bp, Glycine max
  Peptide Sequence Number=SeqID_124926
atgaaggaaatcaagcttatcgataccgtcgacctcgagggggggcccg

SEQ ID NO: 33242 - DNA, 174 bp, Glycine max
  Peptide Sequence Number=SeqID_124927
atggctggtatactcttccttttggaacaacaaaatagtttagagattacggagtgtcattattttggggacgctacaaaggctactacttcaccttcctccagtgaaagtgaagagcaaaagggcaagaatctaatgaagaaatatacccccaagaagaaggacaaccattag

SEQ ID NO: 33243 - DNA, 276 bp, Glycine max
  Peptide Sequence Number=SeqID_124928
atgggcatatcctcttcatcgtctggtgatgcacaagaagaagcaagtttgggaagtgcttattttcagcttctcgctaagccaatctgtcggcttagcaagccatccgctgagcgcaccactcttgaggctgagtgcgaggaagaatatggaagaaggattgtggaagcaatgctttccaagattattttgatgatgccaaagactcaagtcaagaatcaagagtcaagcaagtttcaagaatcaaagagtcgttcaatcaagattcaagattaa

SEQ ID NO: 33244 - DNA, 284 bp, Glycine max
  Peptide Sequence Number=SeqID_124929
acagcacctacaaaacaaatcggtacagactctcactgctcgattttgttggggtgacaccgactgggatgacattctttgccggttttgcatatgtggagggtgaatgcgttaataatttgggatgtctgactgattgtccttcagaacaacagtttgatgaatgcctgaagaaattcgaaatggcttgcataccttggccaatgtttgttgactatttcaaggaaacatggataataccacacaacgaaaaatttgtttctgcctggactaataaggggtga

SEQ ID NO: 33245 - DNA, 243 bp, Glycine max
  Peptide Sequence Number=SeqID_124930
atgcaattaccgcaagagcccttgaacaagagaccaagagggctcgcaaggaagagtatggccggaataaatttcgcggagctctatggggtagcaatagtgaactcaagctgcaaagggaagagagggactagtcgcgagcacatagcatggtccaaaagaagcttgtctcagtgtttatgcgagacggagaccaacatgctagctatcatcgccaagtaccaagaagagttaggtccttag

SEQ ID NO: 33246 - DNA, 518 bp, Glycine max
  Peptide Sequence Number=SeqID_124931
ggtataagggtagagaaatgctcgagccaaagttcgagtacaaggcgctacagcgctgaagtaatccatgccataactcccaggaaaagctcgaacgaccttcaacaaatggaccatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccaccc

SEQ ID NO: 33247 - DNA, 171 bp, Glycine max
  Peptide Sequence Number=SeqID_124932
atggcaaataaattaattaaagacatccaaccgaaatccgaagtcgttaaactgcttcagaaatacattgtaaacagcttttggtcaatcttcccaaagttgaagaaagcactcatttggttgcccagtaccatgaaagtctggaagatgatgtttttgcatttcttttaa

SEQ ID NO: 33248 - DNA, 629 bp, Glycine max
  Peptide Sequence Number=SeqID_124933
aagctggtaccgggccccccctcgaggtcgacggtatcgataagcttgataacaccgagactttttcaagtctcacaagttatccagaactacgtaggtctgaattcctcattggaggatacgtaggagcaagagcctcgcttttgtcgaccacaccgccttttgtcgccataactcaagagctggtagcccgcggagacaccttacggttatccgcacctcgtcattcagtgaccccgagtgtgattgatgaacagaggccaatgtggtcatctcgtgtttttcgagagtatctgcacacccttgctaggcagtcagcattttccgatggagactttcaagtctcacaagttatccacccgaacatacgtaggtctgagttcctcattggacacagttgtggatacgcagagaccaagatttgcattttgtcggccgcacccataatctttgtcatacagacccttaggcagacacagttgtgtccgatggcacgcagagaccaagtttggtcattctgcacccatgatacgcggagataccttatggttattcgcacccttttgtcatccagaggcggcgggcccgatgacaagcagagaccaagtttggtcattctgcacccatga

SEQ ID NO: 33249 - DNA, 335 bp, Glycine max
  Peptide Sequence Number=SeqID_124934
gtgctccagtggcttctgtttctatcagctgtccctcctgttcagctactgacggggtggtgcgtaacggcaaaagcaccgccgggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 33250 - DNA, 304 bp, Glycine max
  Peptide Sequence Number=SeqID_124935
ctccaccgcggtggcggccgctctagaactaggtggatcccccgggctgcaggaattcgatttgggaaccagtttttcaggaacaggggctgaaccaggaatcatttgtataggctggatattgaattcaggtcgttcctggtttgatggtgctttggtggatgatggagatgatggtacagagggtgaaccaggagctgaagtttcttttggtgaggtagccatggaaaagcagagcgggcgtgtaaagcaacggtcgaattcgttttggcttagtagtgaacgtgctattaatgttaagtga

SEQ ID NO: 33251 - DNA, 823 bp, Glycine max
  Peptide Sequence Number=SeqID_124936
atgtttccaaatggtgcagaaggaggcaacgttgaatctttgctaaatacctgtgtgtcaaagttcaaattattgcgagttttggatttaagttattcgacatgcaagactttgccccgttccattggtaagttgaaacacttgagatatttcagcattgagaataatcgcaatatcaagagactccccaattctatttgcaaactccaaaatttgcaattgttgagtgttcggggatgcaagaagctgaaagcattgcccaaagcattaagaaaattgattagtcttcggcatttgaagataactacaaagcaacctgttttgccttacagtgagattaccaacttgatcacgcttgcacatctgtatattgcatcaagccataatatggagtctatccttggaggggtgaagttccctgctcttaaaacattgtatgttgttgactgtcacagtctgaagtctttgccactggatgttacaaattttcctgaattagaaactctatttgttgtagactgtgttaatctggacttggaactgtggaaggacgaccatgaagaacaaaaccccaagttgaagttaaaatatgttgcattctggggtttaccacagctggtggccttacctcaatggcttcaagaaactgccaactccttacagaccttgttcattaaaaactgcgacaatcttgaaatgcttccggagtggctgtcaactctgactaatcttaaagcacttgaaatatcagattgtccaaagcttatatctctcccggataacatccatcacctcaccgcacttgaaaggttgagaattgtcg

SEQ ID NO: 33252 - DNA, 750 bp, Glycine max
  Peptide Sequence Number=SeqID_124937
atgggatcaagtcaaacaccttcgcttaaaaagaggttctatcaagtcaatgtcaagagcctagggatcaccagtctaaaagagctagggcagttaatggggcagctccagcggcaagcttttcgcaaagcttacggtaaaatctgggacctagccatggtagaagtctccatagaggccattgcctccctcgcccagagaccatacctcttctcagggttctatccctcattagctagaatttctaagatagtccaaatctcggcgcaggaattagaccacagaaagcaagtcgaaaatggggtggttggaataccgagaaaatatttggaggtaaaagcgagaatcttggcaggtaaaggcgagtgggcctcgttcatagatattctcgcactgttgaccttcggaggagtcctctttccgaatgtggatgggttggtggacctagcagcgattgacgcttttctcacctatcataaccacaaggaaagctcggttgttgctatgctagccgacctatatgacaccttcgaccgaagatgtgaaaagagcaatacaaggattgtttgttgtactctagctctttatgtatggttagtttcgcacctttttcgccaagaggtgaggcatgcttgcccgctagaaagccaccgttcatgcacagagaaaggaggggcaaactgggaccaactcttagcaagcaaagaaggagcatctgtcaactggttccctcgatggaaggaaggatga

SEQ ID NO: 33253 - DNA, 587 bp, Glycine max
  Peptide Sequence Number=SeqID_124938
tgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgcaaaaacgacgaccccttttttgtgctcaattctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 33254 - DNA, 141 bp, Glycine max
  Peptide Sequence Number=SeqID_124939
atggagccacggggtcctcttagacgcccagcatcaagttcatccgccaataccaatcaatatcctgctttgaatcgttgttttgaggttgggagagcgagaacacctgttcgcggtacaggctgttttggggttttttaa

SEQ ID NO: 33255 - DNA, 585 bp, Glycine max
  Peptide Sequence Number=SeqID_124940
atggtctcccgtggcggaggcgaaagggacgaatgtttgtttcacctcggggaatcgcacgacatggaaacctgtcccgcagtagaagaattgcttcagcggctcatggattgcgggcagcttgaagtgtccataggagggagggaagaaccacaaatttgcatgcagtcggaagagaagaaggaaagggaccggctccacacccatatacccccggacagtcccaagccaacgccatttgcatatcaaagtaataaggccgttccgtggaagtatacccctcccgcgttcaacgaaagagttgcaaccaaagttgactccctgtcagctaaggtgaccaacatcaccggcctcagtggcgtaacccgcagtggtcgggtgttcgcttcccctcacccagcggagttgccctccaaggggaaagcgcccatggtccaagagccaacagacgtagccaccccctcaaaagaagtagatcctccagtggtaagagaggctgaaaagaaagaaggtcttcaagaaaagacggtgactctggaagaggcccatgagttccttcgcctcatccaacaaagcgagtttaag

SEQ ID NO: 33256 - DNA, 335 bp, Glycine max
  Peptide Sequence Number=SeqID_124941
atgaaacccccagatgtccaggaggatcacatatttctgaaggattttcctcattctttagagggagtggaaaaggactggctatattaccttgctccaagaggcaatccatctgacttacaaccctttgatcctgagatagataggacatttcatagattagttaggcatcattttataccttttgatcattctgagctttccattactggtgaatctgtgcattatgttattggtgattttgaacatcctgatcttgagcattataattttgagcattctgattctgagcattctgattttgcacattctgagacatggcacacctccacccc

SEQ ID NO: 33257 - DNA, 345 bp, Glycine max
  Peptide Sequence Number=SeqID_124942
atggttcggcaacaacccgtgcctacctccagtccccaagcgacctgcggtccttgggatttctttcaaccttgtaaaaatccatttacaagcaaagattcacaagggatgtacccttccttgttctctttgaacctagtggatgtaccctccactagaactgatccacaagagatgtaccctctcttgttctcagtcaaacccaaggagaagggagacacaaaagaattcaagcggttagtcccttggtcttttggaaaagagagaagagagacacaaaaagaattcaaggcggttagtccttggcgaattcttttggcaaagggagaagagaatgaaagatga

SEQ ID NO: 33258 - DNA, 587 bp, Glycine max
  Peptide Sequence Number=SeqID_124943
ctggtaccgggccccccctcgaggtcgacggtatcgataagcttgatacagatttggtcttcgccagtgaaaggatcaaggtgggtccgaaaagaggcaagtttgatcatcctactaggacgactgagaaaactggggcaaataaagagggtgaggatgagggagaaacccatgttgtggctgccattcctgtacggccaaatttcccaccaacccaacaatatctttactcagccaataacaaactttctccttacccaccacccacgagaaagcctgtagaattcaccccaattccagtgtcctatgctgacttgctcccatatctacttgataattcaatggtagccataaccctagccaaggttcatcaacctccatttctccgagaatacgactcgaacgcaacgtgtgcttgtcacggagaagccccggggcgttccattgagcatggtagggctctgaagcgtaaggattttcaagtgcaagccattggtcagtttgctcaagcgatctgtgctcttgagtttggacttccaagaccgttcaatcagagattactcgtcttgcacgttggtggggttgcc

SEQ ID NO: 33259 - DNA, 640 bp, Glycine max
  Peptide Sequence Number=SeqID_124944
ggcttccccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgccgcacgccgcttcgccgcagccacggcctcctccgcctccttctgattatcgatccagcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 33260 - DNA, 854 bp, Glycine max
  Peptide Sequence Number=SeqID_124945
ttggaactcctacgtgccgatcaacgtctcatttcgccaaaagttggcccagggcttcccggtatcaacagggacaccaggatttatttattctgcgaagtgatcttccgtcacaggtattcttcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaatgcatcatttctgagaaaacactacctcttccagctagagattgtgaatattactcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33261 - DNA, 177 bp, Glycine max
  Peptide Sequence Number=SeqID_124946
atgcatgaatcgttatatagtacctgctttacagtcccattggttaatgatgcacccgatggtgaaattggtagacacgctgctcttaggaagcagtgggctaatgagcatctatcggttcggagtccaaaggagtacgcggctttattcgactatcttatctttctgaaaaaataa

SEQ ID NO: 33262 - DNA, 97 bp, Glycine max
  Peptide Sequence Number=SeqID_124947
atgcagcggtcccctcgattgccccagacttcaagcgtaatatcgtttaactacatcggaattcacgggagagggcagctcctcgccatccatgttg

SEQ ID NO: 33263 - DNA, 669 bp, Glycine max
  Peptide Sequence Number=SeqID_124948
gcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagtggtgcaagaattgtttgttgtgcactggctctctatgtgtggctggtttcacacctttttctccaagaaggtaggcccgtctatccgctacaaggaaggaagaatcaggattctatcttcatgcgaaggatgtccaaatgttcccttgatggaacaaggggttgtattaattataatcccatcctcgccataagacagcttggctaccccatgagaggagtgccatcagacgaaagcatcacgcctttcatcgcacggggtttcagtgaccccaatgcgagggacagagagcttaggggaagcagtaatgggatcattggcggctatcataagtggcttagagtccgaacacaaggattggattggctcccaaatctaaagactgtgagagacgatgaggttaaagcttcggaaaaggcagcaatagtgagctcaaactctgaagaggtgaaaggaatcatcatgggtcaaaggcatgatctggaaggacgagctaaaggcttgccttag

SEQ ID NO: 33264 - DNA, 1269 bp, Glycine max
  Peptide Sequence Number=SeqID_124949
atgttggatgaacacgacacccatgcaaaaagttttagaatggtaggagatagattgacacatagtgaagtacataatgtcaggctgaaattgatcgctaattgtgaaaaagatggtcgtacatataatgtatttactatttcagaagttgttgcacttattggaggtgattttgatatgaattcaagaagagatattattcttgagactcagaatgaccaattacaaaggatgcatgaattgcattctagctatctagagaaacgtgaggaactggaatcagagaggcaatacgcaaatcgaggcagaatttcaacatctaaaagaaaatttcagcagcttctttctccctccacgttgcttttcttcttctccaccattgttgcctcccttgaagctccaaattcctcctcatttctaccccaaattgtggaaaagtgtgagattttgagggttagaaaagccaaacttgggaaaaatggttgtgcagtgctagtcacgggaaagcttggaggggttgatgaggacccgatgctgagaggaacaaggataagggctacagtggtacctggagatatgccgcgggggtcaggagaccttggggacgttaggtggggtgctattgcccaaaaccaagcttggctaatcccgacccaacctgggcatagtcagtcaatgagaacctgtgacgtacctaagcagggtgatagggtactggtaatcaattaccagttgggtgtaatcgattacatagtgtcacctgctactgtttccaatgtgcaaaggctgtgtaattcgtttttgggcactggtaatcgattacatactttgatcgcgatggcagcgcagttgatctatgatcgcgttgtgatggagtgcctagagggtgtttgggagatcctcgaaggcaatgagaggtgccgattccgtggcacaattcgactcactgctacttcattagtacatccgaaggaacccgcacgcacacttcagcagcctgtggagtggatactacctacacctactccatatcgactagttgagccggttcaagtgatagaggtgtcatcctttgaagaggatcttgaagaggacccagaggaattacctcctgaacctgctatggacgcccttgacttaccagaggatgatgaggatccactccttgatgttgattctccaggggacattatgtcagcatctgaggcagactctacagaggagaatggccctggagggacagcgaatagtgacgactcttcatcgtag

SEQ ID NO: 33265 - DNA, 1038 bp, Glycine max
  Peptide Sequence Number=SeqID_124950
atggccccgaggaagcttgcctcaaagaggtccaggaaggataaggcggccgaaggaactagtttcgctcccgagtatgacagtcaccgctttaggagcgctgtacatcagcagcgcttcgaagccatcaagggatggtcatttctccaggagcgacgcgtccagctcagggacgacgagtatactgatttccaggaggagataggtcgccggcggtgggcatcactagttacccccatggccaaatttgatccagacatagtcctcgaattttatgccaatgcttggccaacagaggagggcgtgcgtgacatgagctcctgggtgaggggtcaatggatcccgtttgatgcagatgctattggccagctcctgggatatccgttggtgctggaagagggccaggagtgcgagtatggccagaggaggaactggtctgatgggttcgatgaggaggccatcgcccagttgctatgtataccggggcaggattttgcccggactactgcagggaggcgagtgcgaatcatgcacaccaacatgaccaccctgactcagatatggatgactttgctgctcagcaacatcctgcccaccgaccataattccgacctccccctgccgaagtgtcagctggtgtacggcatcctgacgcggatgagcatccatgtggctcagttaatcgctgatgccatctatatttttgcaggactctgccagtcgttcggagtccccgtggcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacggcatttggttcgccagcaggcagccaaccaccgggcacatgtgcagacccatgattgtctgtaccagatgagcctcagcatgcagagccagggcttcgcttctttttcatgccctactccagaccagttcagggcagag

SEQ ID NO: 33266 - DNA, 249 bp, Glycine max
  Peptide Sequence Number=SeqID_124951
gaattcgatccctccagaatattcctccaaaaggctgttgcttctggaggaagcaacctggctcgcctgggcgagctgggcggcaaccacctcccctattttgctataaataggggaggaagtgaagaagaaagggccgaggcgcttccgaaacgtttccgtaacgttttccgtgaggaatttcgcaaagatttcaaccgttcttcgacgttcttcattcgttcttcatcgttcttcgatcttcaacgg

SEQ ID NO: 33267 - DNA, 408 bp, Glycine max
  Peptide Sequence Number=SeqID_124952
atgaggggcatcgtgcatgagcctcaataccctcatctccagaggactatacgtcctcgccttgagaggactacacgtcctcaccatcagagggctgcacgccttcacctccagaggactatacttaccctcaccgttagaggactacacgtcctcgccttgagaggactacacgtcctcaccatcagagggctgcacgccctcacctccagaggactatacgtcctcgccttgagagggctacacgccctcaccttgggtactagttaccctcaccgtcagaggactacacgtcctcgccttgagaggactacacgtcctcaccatcagagggctgcacacccttacctccagaggactacatgtcctcgccttgagagggctacacgccttcaccttgggtactag

SEQ ID NO: 33268 - DNA, 335 bp, Glycine max
  Peptide Sequence Number=SeqID_124953
ggatcaagacagaacccatatgcaatgcctatgcaaaagacacaatgcgggaatgtacacagtatgacaatatttaccgaacataagcaaaagggtatcatcccctttgaagaacatattgtagcagtagggactactagcaacaataggttttcaaagagaaaagctctagatgaggggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacagggaag

SEQ ID NO: 33269 - DNA, 287 bp, Glycine max
  Peptide Sequence Number=SeqID_124954
atgtccgattcaggcggatcgcgtatcgagacgatagtaattgaacaatggaagctctcgagaaattcaaatggtcataacttttctggaggaagcaacctggctcgcctgggcgagctgggcggcaaacacctcccctatgttgctataaataggggaggaagtgaagaagaaaaggccgaggcgcttccgaaacgtttccgtaacgttttccgtgaagaatttcgcaaggtttcgaccgttcttcgacgttctcattcgtcttcatcgttcttcgatctcaacgg

SEQ ID NO: 33270 - DNA, 696 bp, Glycine max
  Peptide Sequence Number=SeqID_124955
ggaacaaaagctggtaccgggccccccctcgaggtcgacggtatcgataagcttgatttatcaaaaagaaaaggacacgctttacggcgcccttaccgaactcgtgctagaactagagtaatgggtgaagcagaggaggtgcaagagaagatgaaggccgaaatggaggccatgaaagagcaaatggccacaatgatggaggccatgatgagcatgaagaagataatggaagccaatgcggttatagttgccgctactagcgttgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacacccatactcattaagagccaacaacctcaatctgatcatgcacatgtctctcgacccatggaggagacacatggaatgccccaccacgatctagccgacttcgagccttgcctcggatatgccactgaaagggcaagcagttggtggtatacccctgcaaaacactttggagggccctcagtgtcatccacaaccacaaccctcacgttccacagcggttaa

SEQ ID NO: 33271 - DNA, 237 bp, Glycine max
  Peptide Sequence Number=SeqID_124956
atgaccaaagagaacaaagagccatttctagggaatttgggcaagattgatggggacccggtgttgagaggcaaggatatgggctacgtgggagtacgtgagctcagaatggaggtgggcaacaggggatggtgggtttatgcgcgctttgtggatgtggaaaacttgttgtgcaccatcgcccaaccgccacctagtaccacatgtgatgggtaccccataatcctacaagcttga

SEQ ID NO: 33272 - DNA, 345 bp, Glycine max
  Peptide Sequence Number=SeqID_124957
atgtggctaccaccaaagccttggaatgagaaaccaagagggcttgtagggaagaacatggccggaacaaattccgaggggctctgtggggtttgctcaaggtccaaaagaaacctgtctcagcggttatgcgagacagagaccaacatgttagctatcgtcaacaaataccaagaagagctaaatctagccacggcccacgagcataaagtggcagacgagtatgcccgagtgtacgcggaaaaggaggctagaggaagggtgatcgactcgttacatcaagaggcaacaatgtggatggaccgatttgctcttaccttgaacgggagtcaagaacttccctga

SEQ ID NO: 33273 - DNA, 842 bp, Glycine max
  Peptide Sequence Number=SeqID_124958
atgctagctatcatcgccaagtaccaagaagagttaggtctagccacgacccacgagcataggatcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcaatggcggacacctactccgcccccgaagaaattcatgggcttctcgactattacacaggaacagatgaaagccgacatgtcggctctgaaagaacagatggcttccatgatggagccatgttaggaatgaggcagctcatggagaaaaacgcggccaccgctgccgctgtcagttcagctgccgaagcagacccaactctcttggtagggcggggaaggaacacactggggcatgacggcaaccctcatctgggatacaaccaagcggcttacccttatggattgccgcccaactactcaccacctgtcctgcaagacgatgcgggccatattgtttctcccgtccttgaaagagagcctccccaacagcccgatgaagtccacgaagaccctcaagactatgctcgcagggatgtcgagttctatcccctgatccccgaagggcctgcacccagcacgaccacccccggtgtcgcaacctacccttcggtgggagggcgacgcgagactcgcgggatgcgtgttccacgaaaggaatacgcgcggagtcgccaccaacgtttatttgaggaaaacgtcggaaaaaccggaaaagacgcgatctatgaacttttaagtaaaag

SEQ ID NO: 33274 - DNA, 438 bp, Glycine max
  Peptide Sequence Number=SeqID_124959
atgagtcttcattcttcatctagtgttaatggtgagggttctactcctaaggaccccttgtataagatattagatgagttaagatcccttaagttgtggaaagaaaaacaagagagaaaagaaaaaggaaggcataggtcacatcttagacctcactcccataggagagaaaatgaaagaaagcctcaagaggctaacattaacctctcatacttccatgggaaggacaatgtagaggctaacttagattgggaaataaggaagaggacacattatttctcaatgccccaccaagaaatccatgattatgagaagcccaagacatttacagtagccaagatgaggctactacttcaccttcctctagtgaaagtgaagaagcaaaataggaagaatctagtgaagaaatctacccccaagaagaaggacaacctttaa

SEQ ID NO: 33275 - DNA, 369 bp, Glycine max
  Peptide Sequence Number=SeqID_124960
atgagtgagctaactcgcattcattgcggtgcgctcactgcccgctttccaatccggaaacctgtcatgccatctgcattaatgaatcggccaacgcatggggagaggcggtttgcgtattgggcgctagcggagtgtatactggcttactatgttggtgttgatgagggtgtcagtgaagtgcttcatgtggcaggagaaaaaaggctgctcctgtgcgtcagcagaatatgtgatacaggatatattccgcttcctcgctcactgactcgctacgctcggtcgatcgactgcggcgagcgtcaatggcttacgagcggggcggagatttcctgtaagatgccaggaagatacttaacagggaagtga

SEQ ID NO: 33276 - DNA, 237 bp, Glycine max
  Peptide Sequence Number=SeqID_124961
atggcacatcacgcccatggacatcaggatgtactgactactgccattgggccaccagaacatcttggtcgtgtgcatgctgctggagccgctatcacgatcaagcaatactttggatcggctccaacgacctcccgcacgtcttcgtccatgggtctcgaagacctggaccagatgcagtcccagtttcagtcgcacatgcaatcacatggactcgcactgcctcctgagcctgag

SEQ ID NO: 33277 - DNA, 366 bp, Glycine max
  Peptide Sequence Number=SeqID_124962
atggcaatgatggtgacccggatgatgttggggtacgactacgagcccgaaatgggtttaggcaagaacaacggcggcagaaccagcctggtaagcaccagtggaaaccgtgggaagtttgggttaggctataaaccaatgcaagctgacataaggaaaaatatcttagaaaggaagaacaaaggccaaggcctgcggttgggacagcaagccgaagaggccccaccctaccacatcagtagaagctttataagtgcgggtttaagacgcgaaggccaagtcaacacgatatgcgaggatgactccccgaggagatcggatttggtatggccatgtcctcccaatttccgactaggaaattggtga

SEQ ID NO: 33278 - DNA, 468 bp, Glycine max
  Peptide Sequence Number=SeqID_124963
cgcccaatacgcaaaccgcctctccccgcgcgttggccgatcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33279 - DNA, 419 bp, Glycine max
  Peptide Sequence Number=SeqID_124964
gaattcgatccagtgaaaggatcgaagtggatctgaaaagaggcaaatttaatcatcctgcttggacgaatgagaaaactggggcaaataaagagggtgaggatgagggagaaacccatgctgtgactgccatccctgtacggccaagtttcccacaaacccaacaacgttattactcagtcaataacaaaccacctccttacccaccacccaccctggggcattccattgagcactgtatgaccctcaggcgtaaggtgcaaggtctaattgatgcgggctggctgaaatttgaggagaatcgcgtgattttcaagtgcaagccattggtcagtttgctcaagcgacctgctcctgagtttggacttccaagaccgttcaatcagagattactcgtcttgcacgttggtggggttgcc

SEQ ID NO: 33280 - DNA, 123 bp, Glycine max
  Peptide Sequence Number=SeqID_124965
atgacgataacaaaagatgatgacaaaggtgatgacaaaaagctcaaaggaatcaagattcacggatcaagcttcaagaatcaagatcaagattcaagattcaagaatcaagagaaggcttaa

SEQ ID NO: 33281 - DNA, 234 bp, Glycine max
  Peptide Sequence Number=SeqID_124966
atgactcactataatccttaccctcggaagcaaaaacggaaagaaggaaaatttccaatcaaagagaaagcaaaaagaaaagaaaggaaattcccaatcaaagagtgggagaaagcaaaaagaaaagaaaggaaattcccaatcaaagagtgggagaaagcaaaaagaaaagaaagaaaattcccaaccaaagaatgggagaaagtaaaaaagggaaggaaagaaagttcttga

SEQ ID NO: 33282 - DNA, 442 bp, Glycine max
  Peptide Sequence Number=SeqID_124967
gaccctaggatttcccgccttgatcccaggactctgccagtcgttcggcgtccccgtcgcacctagcaagggtgatgcaccacaggccgcggacgcgccgccacctcatcaggttggtccagccggatcatttgatacggagcagtatttgcgacatttggttcgccagcaggcggccaaccaccgggcacatgtacagacccatgattgtctttatcagatgagtctcagcctgcagagccagggttttacttcttttccgtgccctactatggaccagttcagggcagaggtcacatggcctggagattggcctgaggcccgggcaggagaggcgccagcaaaagtaccagcagaggcccccgacgaggcagatgaggcccgcgaggaggaggagatgaccgatttacttgatttcttaggagggagcggagccacataa

SEQ ID NO: 33283 - DNA, 245 bp, Glycine max
  Peptide Sequence Number=SeqID_124968
atgtatcttagtctgcttgacgcattgcggtaccttttggtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 33284 - DNA, 699 bp, Glycine max
  Peptide Sequence Number=SeqID_124969
atgcccgcggatgtgcagccaaagtttaaaaacggcgccgagctgctggcgtggaatcaggagcagggccggctgcgctcagaagcgattgtgcgcgaaaaccgcgccatgaagatgcagcgcattatgggccgctccggcatccgtgagttgcacatgaactgctcgttcgacaactaccgcgtcgaaaatgacggccagcgcaaggcgctcagtctggcgcgtgaatacgccgccggctttgagaacagcatcgccagcttcgtgttttctggtcgtcctggcaccggtaaaaaccatctggcggcggcgattggtaacgatctgattctgcgcggtaaaagcgtgctgattgtcacggtggccgatctgatgtcgagcatgaaaggcaccttcagcggcggcagcgacctgaccgaagagcggctgctgcaggatctcagccatgtcgatctgctggtgatcgatgagatcggcatgcagagcgaatcgcgctacgagaaagtgatcatcaatcagattgttgatcgccgttcgtcgtcaaagcggccgaccggcatgctctccaacctcgatccggccggcatgaatacgctgcttggcgaacgggtgatggatcgcatgcgcctcggtaatagcctgtgggtgcgttttgactgggaaagttaccgcagccgcgtgcgcggcgacgagtactga

SEQ ID NO: 33285 - DNA, 753 bp, Glycine max
  Peptide Sequence Number=SeqID_124970
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttccctctcggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacg

SEQ ID NO: 33286 - DNA, 174 bp, Glycine max
  Peptide Sequence Number=SeqID_124971
atgacgggacccgagaaaactgtctccttcttagatacaacgtctaggggtagcaaagtgccccaatgggacaagcagaacccatgtgagattcttgcgccgctcttttcacatccccggtcgaacgtgtcatacatggccaaaatggcgacgaccgggctttccttgccatga

SEQ ID NO: 33287 - DNA, 186 bp, Glycine max
  Peptide Sequence Number=SeqID_124972
atgaacctcttcggtggcacagagagatttgaacaattaaagttgtccctacttgttgatggattttcaaaggttagtgtggacaagtggatggatataacagacatgggatatgtgattgcttcacggtataacgtaatccttgtatcggtgtcccaacaacaaagcatgacattttccctctaa

SEQ ID NO: 33288 - DNA, 221 bp, Glycine max
  Peptide Sequence Number=SeqID_124973
atggggcgcgtagcaattctgaaaccaataatgttttggggaattgctaggggcacccagcaagattgctggtgcacccaacaattttttagaattcccaaaataccccttaacgtttccgtggaagaaccttcttccgcagtcaatgttacaactgtggaagaaccttcttccgtgccatctcacggaagaacttcttccggaggaagccacagaagaag

SEQ ID NO: 33289 - DNA, 420 bp, Glycine max
  Peptide Sequence Number=SeqID_124974
atggctgactttccaagaggatcggccaatgtgagaaccaacccgctcaccaatcatggagggggagcggttaacgtcgttgagtccgataggccgcgcaggtctaaacctttaaaggatgtggcaacccctaggaggtttatctttgaggccctacaaaagggaggaattgttacagcggatgatagatcaaggtcgactggaagttggcagtggaggaagagaagagcagcatatatgcatgtagtccacggatgggagcagtgttgcgaagcccaaacccttgccaccgatgtcagctcgttgtcagctaaggtaacaaatatcacgggactgagtggtgtgacccgtagcggtcgtgtgtttgcgcctccggacctaccagtccaacccgcgaacgtcaaggggaaaggaaaagtg

SEQ ID NO: 33290 - DNA, 600 bp, Glycine max
  Peptide Sequence Number=SeqID_124975
atgattatgaggggccaagacatttatagtagccaagatgaggctactacttcaccttcctctagtgaaagtgaagaagcaaaatgggaagaatctagtgaagaaatctacccccaagaagatggacaaccattagtggttaaagagaagtgtaaggaggtaagtgtctcctccaagaggttagctaagaaggaaactcattttacaataaagacaaacattaaagaaacttttcctcttagacaacctccaaattttctcttttgtaaaaagacacttgctagcattgccacacctcttgggcttgggtttattcctcaagtaaagaagttgttggatgagggtttggttcgcaagagcttaaatccttgtgcttttttggtgcccaaaataggtattattaggcaccaagtccctaaaataggtggtatgatgaatgttttgagtggtgcaaccctcttatgtaaaatcactcgtacactacatgttcatggtgttgagagaaggagcctagagtatgaagaacctcaggatttgaggtcaaatcctttccaaggtggagggaatgatgcaatcctaccccgcaagggcattggatag

SEQ ID NO: 33291 - DNA, 93 bp, Glycine max
  Peptide Sequence Number=SeqID_124976
atggagtcgtttgatgctcatgcacggtgccccttattgccccagtgtaaggctttgaggtaccaatcgttgcctttcgtcatgaccttgtag

SEQ ID NO: 33292 - DNA, 280 bp, Glycine max
  Peptide Sequence Number=SeqID_124977
cccgcatcaattagaccttgcaccttacgcttcagggccctacaatgctcaatggaatgccccggggcttctccatgacaagcacacgttgcgttcgagtcgtattctcggagaaatggaggttgatgaaccttggctggggctttctcgctgcaaaattcatttcttggttggtgttttcgggatggcctttggggacaactgggcggtgggtaaggagaaggtttgttattggctgagtaatgacattgttgggttggtgggaaacttggctgtatag

SEQ ID NO: 33293 - DNA, 351 bp, Glycine max
  Peptide Sequence Number=SeqID_124978
atggtggtgacgggtaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctag

SEQ ID NO: 33294 - DNA, 69 bp, Glycine max
  Peptide Sequence Number=SeqID_124979
atggagctaagcaagcttcatgatgatgatccaagcaattttgatgatgccaaaagcccaagtgattga

SEQ ID NO: 33295 - DNA, 696 bp, Glycine max
  Peptide Sequence Number=SeqID_124980
atgagtcgtattcaaacgccctattcccacatcatcgatgaatataataagatgatttcaaagaatataaaggcgatagactcattaagtcatagcagtaatatacgccagattgccgatgatacgtctttcaccctgagtacaggcgagattattattgttcttgagggcgttattgccgttgagatgcaggagcacaactttattctcgccccaggaaaagcgaaaacccaggcgaaaaagttgtttcaggtcggcaaaggcatcaaaggaatgttttttggtattgtcgaaagttatggcccgggtattcagctgcactataccgccaaaaaaaatgtcaaagtgttcagctgtaatctcgaatactttgagaaacattttactcagcccgataaattcaccttcctgatgaacatgatggccatcacgctggcgtttttgctcgatgcgcatgacgaaagagctattgacacccgctattttgtcattcgctccatgatttatcgctatctcaagcagaaaaatgagggtgtattacacgacccgagcctggcgaactttatcctgcgacgcacaaaaatgtcgcgtagctatctgtttcaggtactttccgatctgaaaaacggcggctatatcacgatgaaaaacggcgagctcgtcgatattgtcaacgagctgccggaaaaatattaa

SEQ ID NO: 33296 - DNA, 745 bp, Glycine max
  Peptide Sequence Number=SeqID_124981
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcagtcttgacaagatttcgcttggactggatattagggatcaccggatcgaagtcacattgaaaaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggggaa

SEQ ID NO: 33297 - DNA, 192 bp, Glycine max
  Peptide Sequence Number=SeqID_124982
atggctcaggatttaggagcaattgctgaggatttggagcgggtcatcaacctcaggatggtcactgagggcactgacttatatgacatcatgactcgttgtctgaggagagctagagggacaacccatcccttgtgttcagatgctttacaacaagagacttacagtctcttaaccaatctcattgaataa

SEQ ID NO: 33298 - DNA, 159 bp, Glycine max
  Peptide Sequence Number=SeqID_124983
atgtcgatcggcgtcatccggcgatgctcctttttaatcctcgatcgcttactttcgggccgacgtcggctagcattttttcgatcagtatcggtgaatcaaggaaatgttcgatcggcgtcgtccggtgatgcttcttctttaaacctcgatcggtga

SEQ ID NO: 33299 - DNA, 414 bp, Glycine max
  Peptide Sequence Number=SeqID_124984
atggcatcagaggataaaaggacaaccttcatcactctatggggaaccttctacaacaaggtgatgtcatttgggttgaagaatgttggggcaatataccagcgggccatggtggctgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33300 - DNA, 483 bp, Glycine max
  Peptide Sequence Number=SeqID_124985
atggtggaagaatttgaagagatcctaggatgccctctaggggggaggaaaccatacctcttcacagggttctatccctcattagctagaatttccaagataatccaaatcttggcgcgggaattagaccacaggaagcaagtcgaaaatggggtggccggaataccgagaaaatatttggaggcaaaagcaagaatcttggcagtttcgcacctttttcgccaagaggtgaggcatgcttccccgttagaaagctaccgttcatgcacagagaaaggaggggcgaattgggaccaactcttagcaagcaaagaaggagcatctgtcaactggttccctcaatggaaggaaggaagaaccgaagttcttatttcatgtggaggatttccaaatgttcccttgatggggacgaggggttgcatcagctacaatctcgttcttgctataagacaacttggctatcctatgagagggcaccactag

SEQ ID NO: 33301 - DNA, 276 bp, Glycine max
  Peptide Sequence Number=SeqID_124986
atgggaatggaggatgcaatggaggagaaattgatgctgagattgatgctgtccagatttgcccaaccagtatggactcccttatttggaagaaacagattgcctactaaggctaacttgagaaagagacacatcactttgccttcgtataggtgcccgttatgtgatagtgaagaggaagatattggccacatcatgttctcatgcagaatgactaggaatttatggtgggaggctttgagatgggtcaatagagtgggccctttcccccattga

SEQ ID NO: 33302 - DNA, 448 bp, Glycine max
  Peptide Sequence Number=SeqID_124987
atgcggttgcaatttgccgctaccagcgttgttgctaaggtgaacccgacgtccccatctagcctcaaccaaatgaatcatccgaccttagatatggtaggcaaagatttgggaagtagggacggcctccatgatccaaacaagcacgccttcccgccacaaggcctgcctcccaactatacaccacccaatgtggcgtacactctcaatgaggatgtcaataactccattcctatacccattgagagccgacaaccccaaactgttcatgcacatgtctctcaacccatgggtgagatacatgaaattccccatcataatctagccgacttcgagccttggctcggatatgccactgaagggcaagcagttggtggtataccccttgaaaacacatcggaaggccctcagtatcacccacaactacacctcttgcattccacgacaa

SEQ ID NO: 33303 - DNA, 621 bp, Glycine max
  Peptide Sequence Number=SeqID_124988
atggcaaggtttaggccgtatctaatttttcacaacccaaccccgatttccaagcctttgattgtgatgaataaatcgttcattcggctggctgctttactggtcagcgtgctgctatgtcaatgcaaaagtgtcgccgcgcccagcgatgataaacgctggcaaaacgcgtatagctattcgcaagaacaggtcatggaaaatcagtcaggcgttgccggtagctggtctgaaaaagtagaagaaatcatgatcagcgcactaagcctgaccggtgtggactataaatacggtggccgcagccccgaaaccggttttgattgcagtggttttgtccagtacgtattcaaacacgccgcccagatttccctgccaccttcagcgcggactatcagtgaaatgggggatgccgtcaaacgcgaggatttgcaacccggtgatctggtgttctttaataccttgcgatctgcattttcacatgttggcatttacgtcggcaacaaccaattcatacacgcgcccagagctggcgcaaaagtccgtgttgagagcatggacgaacgctactggcgcacgcgctacaatggtgccaaacgcctcgaagtagaagcgtctaaataa

SEQ ID NO: 33304 - DNA, 189 bp, Glycine max
  Peptide Sequence Number=SeqID_124989
tccgtcagccttgtgccggggacaggcgggatacttgaggtgcgctgtgatggccgcgtgattttttcacgtaaagagatgggacggtttcctgaggcgaaggagttgaaacagttaatccgtgatctggttgatccggagcgatcactggggcacagtgatagcgctgttaaagggggcggcgaataa

SEQ ID NO: 33305 - DNA, 177 bp, Glycine max
  Peptide Sequence Number=SeqID_124990
atggtgcctttcattgccctagtgcaaggctttgaggcacaatcgttgtctttcgccatgaccttgcagcaaggaacctattgggtgagaacttctaatctgcccctaggatcaagtgcttctaagttttattcaggacaagaatccaagaaagtcaagatatatgatcaagtttga

SEQ ID NO: 33306 - DNA, 693 bp, Glycine max
  Peptide Sequence Number=SeqID_124991
atgactcaagagctggtagcccgcggagacaccttagggttatccgcacctcgtcattcagtgaccccaagtgtgattcacgagcagagaccaatatggtcatctgcgccctttccggagatgtcagcattttccgatggagacttttcaagtctcacaagcggcgggcccgatgatacgcggagatacccttacggttatcccgcacccttttgtcatccagaggcggcaggccccgatgacaagcagagaccaagtttgggtcattctgcaccccttgtatcatccagaggccggcgggccccgatgatacgcggagataccttacggttatccgcacccttttgtcatccagaggcggcgggcccgatgacaagcagagacccaagtttggtcattttgcaccccttgtatcatccagaggcggcgggcccgatgatacgcggagataccttacggttatccgcacccttttgtcatccagaggcggcgggcccgatgacaagcagagacaaaatttggtcattctgcacccttgtatcatccagaggcggcgggcccgatgatacgcggagataccttacggttatccgcacccttttgtcatccagaggcggcgggcccgatgacaagcagagacaaaatttggtcattctgcacccttgtatcatccagaggcggcgggcccgatga

SEQ ID NO: 33307 - DNA, 201 bp, Glycine max
  misc_feature (10)..(10): n is a, c, g, or t
  Peptide Sequence Number=SeqID_124992
atggttgtgnttgtgggtgaaactgagggccctccaaagtgttttcaaagggtataccaccaactgattgcccttcagtggcatatccgagccaaggctcgaagtcagctagattgtgatggggaatttcatgtgtctcccccacgatttaagagacatgtgcatgatcagttcggggttgttggctctcaatgggtatag

SEQ ID NO: 33308 - DNA, 348 bp, Glycine max
  Peptide Sequence Number=SeqID_124993
atggatctttcaaagaacacgcccaaaaggtggagggatctggcggcccaggtggtacccccaatgatggaaagggagacgatgatcgtgatggtagacacattatcgatactctactatgaaagatggtgggctacacaccctcaaagctttgcggatttggtcttcgccagtgaaaggatcgatgtgggtccgaaaagaggcaaatttgatcatcctactaggacgactgagaaaactggggcaaataaagagggtgaggatgagggagaaacccatgctttgactgccattcctatacggccaagtttcccaccaaacccaacaatgtcattactcagtcaataa

SEQ ID NO: 33309 - DNA, 540 bp, Glycine max
  Peptide Sequence Number=SeqID_124994
atgacactcttcatggatatggatgatgatgctattagcacattctgcccagcgaccacaatgccaatctctcttgcagatagaatcagcgcccacaagacacccgtggacccgaaagaagtccaacagggccctggggtttccagctctggttacgggcctctgtcagtcctacagggtgcccattcccccagcaaggaatcgcacccacaaagacacccagtggacccggagaagtccaacagggccctggggtttctagctctggaatcgcacccacaaagacacctagtggacccggagaagtccaacagggccctggggtttctagctctggttacgggcctccgtagtcctacagggtgcccgttcccccccgcaaggtcacgtcatcctgacatagggatcacgcccgtaagacacccagtggacccgaagaagtccaatagggtcttggagttgccaagctctaattatgggcctctgtcagttctacggagtgcctgtcgcccccagcaaggtcatcaggccccctactaa

SEQ ID NO: 33310 - DNA, 279 bp, Glycine max
  Peptide Sequence Number=SeqID_124995
atggaggagggattttctaaaggatcagtccccattgtcgcaacctacccttcggcggaagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgatcctacgtattcctcaatttgcgatgaggaaatcagacctacgtag

SEQ ID NO: 33311 - DNA, 234 bp, Glycine max
  Peptide Sequence Number=SeqID_124996
gtaggctgggtaggctggcaggctggagacccaggagagagctaatgttccagttcaagtccaaaggtgcttccactgtgcagccaatgtggagagccactgatctgtcatttcacgtactcgtcactgtctccaacctcttcagaaccagaatccacctaaccattaacaaattgcccaggatagagatagacatcaagcttatcgataccgtcgacctcgagggggggcccg

SEQ ID NO: 33312 - DNA, 258 bp, Glycine max
  Peptide Sequence Number=SeqID_124997
atgagagggaaccctttaggtgcaacttgctttatcaagatccttggtagttcatcgagggtacatccgataggaatttcaaatttctttggattttttcctgtgaacgcacatcctacaaatgtgttctgggtggatgtcccatctcccgttgtaatacatgagcgcgtcatgagtaggggcgtagatgcgttcaagcttgcaaaatcacagctgtttggtactcgaatgggcaccgaagtggaattttggaagtaa

SEQ ID NO: 33313 - DNA, 546 bp, Glycine max
  Peptide Sequence Number=SeqID_124998
atgattttgggtggtttagtcggttttgctgttctatctactgctggaatttttaagtggcaagatgcagatgatgtctttgtacaaggcatgcggatgatggctctagtgggtttcattatgatttccgctgcgggcttcgcatcagtgatgacccatacgggagatattaatcagctagtgaacggtgtagtcgatattatcggagataaccgagcacttgctgctttcttaatgctatgcattggtttatttgtcacaattggtattggttcatctttctcaagtgtacctgtacttgcggtcatttatgtacctttatgcgtacagtttggattttcaccattagcgacaattgcccttattgggacagccgcagcattaggtgatgcgggttcaccggcttctgattcaaccttagggccaacagctggtttaggtgtagatgggcaacatgatcatatttgggatacggttgtacctacatttattcattttaatattccgctattaatttttggctggattgctgcaatggttttataa

SEQ ID NO: 33314 - DNA, 273 bp, Glycine max
  Peptide Sequence Number=SeqID_124999
atgggagcaatcgttcctcttttagacccgacatgcgatcctttaggtagcggcaactataaccgcaagttggtggtaccattcatcttcttcatagagaaactcgatcatggcctccatcattgtggccattatcgctcctttcatggcctccatgggtcagccttcatcttgggctctgcacctcctctgcttcacccttactctagctctagcacgagttcggttaaagggcgccgtaaagcgtgtcctttctttttgataacaaattaa

SEQ ID NO: 33315 - DNA, 705 bp, Glycine max
  Peptide Sequence Number=SeqID_125000
atgaaaacacggtgcccggatgggctattcttatatcctgagaattctgctcatggtcaactcccaagaacagtggatgtaattgcagaagacgaccttgttgattcttgcaagcctggagatcgagtggcaattgtggggatatataaggctcttgcaaggaaaaggactgttctcatagccaacaatgtttctcttctcaacaaagaggataatgcaccaatctacagtgttgaagatgtcaaaaacattaaagagatagctacaagagatgatgcatttgatctgctaagtgattcacttgcaccttctatatatgggcattcttggataaagaaagcagtggttttgttgatgcttagcggggtggagaagaatttaaagaatggcactcacttgcgagggttagagttttctcttgatctcctttctttactcaatcccacaaaatttttagggaacattgtggttgaacatgattatgctgagtgcactggatctgctattcaagctttagttttgtttaagaagctatatccaaggcatagggagacagagataaagaattccattgccaatgcagttcatgcggcgagtaaaacttacactaattgtgctgccattcgcaaaaccattaaatttctactttcaacactgaaagaggatggtaggtggggagaaagctatctttcatgcccaaaacag

SEQ ID NO: 33316 - DNA, 606 bp, Glycine max
  Peptide Sequence Number=SeqID_125001
atgcctttcgcaccactggttaccgctggcatcgaaacggttcttaatacttttctctggcgcgaccgcgcgcttaaaccggcgcgtcagcgcctgctggggaaagtgctgcgcgtagagctcaaagagctgtcggcgcctgtcgtgctggcctatagcgagcagcaaatcgacgtgctcggcgcgtgggaaggcgaagctgactgtaccgtgataacccgcctgagcgtgctgccgcagctgcgtaaccgccaacaactgaccgcgctgatccgcagcggcgatctggaagtacagggcgacctgcaggttgtgcagaacatggtcgcactttgcgatctggcggagttcgacccggcagagttattggcgccgtataccggcgatatcgtcgctgaaggggttggcaaggtgcttcgcggcggcgcgcgcttcctgctgcagggcgcgaaaagccagcagcgctacgtcgctgaagcgattaccgaagagtggcgactggcgccggggccgttggaaatggcctggtttgctgaagagtccgccgctgtagaacgcgcgctggccgcactggaaaaacggctggaaacgctggagggcaaatga

SEQ ID NO: 33317 - DNA, 1994 bp, Glycine max
  misc_feature (19)..(19): n is a, c, g, or t
  misc_feature (138)..(138): n is a, c, g, or t
  Peptide Sequence Number=SeqID_125002
ggcagtacgtccatcaggncgatgtgttgtttgagctggatgccagaagtgccgatgaagctgtgtccaaagctgaagtcgcggtggaattcgcccagaaaggcttcgagcgcaaagaggcactgtatgccaacaatnacacttcgctcaagttgtacaaagatgcagagcagcaacttgaaacggcgaaaaaagacttgtcgaatgcacgtacgcaacgtgaaatcctgcgtatcaaggcgccactcagtggcactatttcaaccatacattacaaaatcggcgaatcgatcagtgtcaatactgtcatggccgacttgatggatttaaagcgcctggatgttgcactcaaagtgccgacaactgaagtagcggccatccacaccgggcagcaggtggaggtatttgccgacgatagctcaagcgccaagccttataccggtaaggtggatccgacgacagatacggtccttgtgcgtgcttcattcgccagtgatgaccggattcggcctgggcagtttgtcagtgcgcgcattcagaccgtgcgcttgccggaccaacttgccgtgcctcaagccagtgtgcttcacggtgatagcggtgactatgtgatgttggtttccgggcaaatcgccaaacaatacccggtgaaaattggcatcaaggatcatggttgggttggcctggcaggtgcaaccttaaaacctggcatgcaagtggtcaccgaaggcttatatgctgcgctacaaatgccgtcatccatctttccgcaaaccaatttcccgcgggttgtcatcctgctggataatggcgtgatgccaagtaatgaaatgatggcgacaatcacacgcccggtggaagagtccatgaaggacatcccgggtgtggagaatgtgcgttcaaaaactgggcgcggcactgctgaggtgaatgtcttttttaactggcataccgatatgacacaggcggagttgtatgtgcgtggcaaaatggcgatggtgcaaaaaacattgccaccgaccgcaaactactctgtgtcgcggttaaccttttcagcatttccggtcatgggcttgagtttaaccagtgacaaacatgatgtgacccagctttgggaaactgcacgctatacgatacaacccaaaatactgcgtctcaaaaatgtggctaaagtgggcatcgtcggggggagagtgccggaatatcatatcgtggtcgatccacttaagctgcaagcattgcattttggtatttctcaggtagccgaccttgtcgcgcgcagcaacgtcatcgccccggctggcatgctggaagaggactataaactttatctgacggtcaccgatggccgtatacatggtacagaagaattagagaatctcgttattgctgcgcctaatccggcatcggcgccaggcagcctcggcggcaatccagctgccacaggcatcgccgaccatcctgtccgcattaaggattttgcccgtgtggagcgcaataaagagcctgctttctacgaggtgaccgccgacggcaagaatgcagtgttgatcaatgtctatagccagccggatggcagcacgctggatattgcacaagcagtcaaagctgaactgatctcgattaataaaagtttgccacccggcatgaaggtacagtttttctatgaccagtctgagctggtagcagactccatgcaaagtgtatgggaagcgatactggttgggctagtattgtctatggcgattttgtatttgtttctgcaaaactgggggacgactttggttgcctccatcgtcattcctgtcacggtttgttttgccatgctgggcctgaaagtcgccggcttgggatttaacttaatgactttgggcgggattgctgcagccatcggcctggtcattgatgacgcgattgtggtggtagagattattcatgcaaaaatgcagcatggccagcaacgactcgctgccatcactgaaggactctctgag

SEQ ID NO: 33318 - DNA, 423 bp, Glycine max
  Peptide Sequence Number=SeqID_125003
atggctccgaaaaagctttccgcgaagagatctaggagggacgtcgcagctgaagggaccaatgccgcccccgagtttaatagccaccgtttcaggagcgtcgagcaccagcagcgcttcgaggccatcaaaggatggtcgttccacagagagagacgcatccagctcaaggacgatgagaacgcgaattttcaggaagagatatttcaccgacgttggacgtcgctagtcactcccatggctaagtttgacccagatatagtgctggagttttatgctaatgcttggtccacagaagagggagtgcgggacatgcggtcatgggtgaggggtcagtggattccctttgacgcagatgccctcagccagttcctgggtgacccgctagtgttagaggaaggccaggagtgcgagtttagttag

SEQ ID NO: 33319 - DNA, 375 bp, Glycine max
  Peptide Sequence Number=SeqID_125004
atgagggtttggtattgtgaggcaccaaatccctatgataggtggtatgatgaatatgttgagtggtgcaaccatctcttttgtaaaatcacccatgcatccaacgtcttcatgattcacatacatagggactcattaggtagtgatcaaggggttcccacggaccctaagaaaataaaggtcattcctgagtggctcactccaccaacaccacccattgagttggtgtggaaccatgttccctcatgggaagatgcccaggaaagaggtgtcgagggaagaagcccagagtttcaagaacctctggatttgaggtcaaatccttttcaagggggaggggatgatgcaatcctaacccccaagggcattggatag

SEQ ID NO: 33320 - DNA, 128 bp, Glycine max
  Peptide Sequence Number=SeqID_125005
atggatgattttagtgagcctaaggataaagagtcgtttcatcacaataatgaccaaagcgatgatcaaagcaatgatgagggtgttgtcataccaacattacctccattgcaatatcaccaacctag

SEQ ID NO: 33321 - DNA, 896 bp, Glycine max
  Peptide Sequence Number=SeqID_125006
atggtggctctgagcttccagggtgggcgggcaagtcctgcccaaccccaacacccatcattgtgtagtggaagagccgctggagtcatcaggattcggtgtgggatagctgagccatctggtgaacctgctcctttaggacaaaagacgcggtaccatgacggcatttttgagaaggccttcatgactctctttgcacgtaagatggagaaattttcagatccaccagcaggaaaagctagagagaataagggttggtgggattggggttatgactatgagagtttcgtggatgtgtcaaggagggtaatgcagcgtaggtctcgtatccagcaacaacaagtggttcgagaggttctcctgtctatgcttcctccaggtgcgcctgcccagttccggaaattgtttccgccaacaaaatgggctgcagagtttaatgctgcattgacagtgcctttcttcgactggttagttgggccatctgagggaattcaagattctcgtctgaatacaaagatcaagctgtgggagtcttgtttctggttctttcgctgcttctttgtgatcaagaacattcaagaaatcatgtcaaacacaatcaggattgagaaattcaatggaaagaatagcttcaatctatggcgcatcaagatgcgtgctttgttgaaggaacaacgtgtttgggctgttgttgcttctgcatctgtgaagaaagaagtgacttctgaatcaaaagaaaaggcgactatttcaaagactgaagaacttgcagaacaagaagaaaaggctcactcactaatcttgctttccttatctgatgaagttttatatgaagttgcaaatgaagaaactgcaagtggcttatggctcaagttggaaaagttgtatatgactaa

SEQ ID NO: 33322 - DNA, 449 bp, Glycine max
  Peptide Sequence Number=SeqID_125007
atgggggtttttccctttctgctttgtaatctttctgcaatgccaggtgccaacttgttggcaatgggttcctcatcagattctacttcttctaggtcaatgagagaggacttcagcatttggggtggagatgttggaacatctttatcagcatcagggacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcgg

SEQ ID NO: 33323 - DNA, 261 bp, Glycine max
  Peptide Sequence Number=SeqID_125008
atgacaaagatgatgacaaaaagcccaaagaatgatttcaagattgagtcaacaagttcaagatcaagtttaatttcaagagaagaaatcaagaagattcaagaatcaagagaagttgatttcaagattcaagagaagatgaattcaagattcaagaaaagaaatcaagaagacttcacaagggaagtttttctaaaggttataactcttccaatggttttcttgaccagacttgaagagtttataaaagcaagaccttga

SEQ ID NO: 33324 - DNA, 1772 bp, Glycine max
  Peptide Sequence Number=SeqID_125009
ttcttagtccggctcgccaagcaacggcgcgcgatcagccgcacagcccgaaaatcggttcaaacccgacaccgcgatcaagcctcgcagattcaaccaacgcgatcctcaaccgcattccccaccagcaactcaatcattgcccgcgccgcggccgactgccgccgatgcggcgcatagatcaccgagaacggccgcgaccgcccccgcagctgcggcagcacttctaccagctgcccgcgctgcaaccgctcgcgcacgatgaactcatagctctggcagatgccgatgccctgttcggccagcgacaccacgcccagcacatcgtcggaggtctcgatggacgaacgcggcagccagtccacgtcgcgtccaccgtcgcggaagatccacggggccagccgcccggtgcgcggcatcacaaacggcaggcacaggtgctgctgcaggtcgtccagcgtctgcggcgtaccccggcgctgcagatagtccggcgcggccaccagcaacagcggcgcatcctcaagcttccgccccaccagcccgctgtccggcagctggcccaggcggatggccaggtcgaagccttcggccaccaggtccacgttgcggttggtgatgttcagttccacctgcacctgcgggtactgctgcgcaaagcgcgccagcacgggcggcagccggtagtggccataggtggtgggcacgctcaggcgcacgcggccggccagcgcaccgtcctgggccagtacgtcgcgctcggcgtcgtccagcaggccgaaggcggtgcgcacctgttccagatagagccgcccggcgtcggtcaggcccacgcggcgggtggtccgctgcagcagctgccggcccagccgcgcttccaggcgggtgaccgcgcggctcagcaccgagggcgtggtggacagcgccaccgcgccggcagtgaacgagccgtgctcgaccaccgccaggagcacctccacatcgcccaggtagtcgaacttgcggctcatttggctctccggggaacagatgttttgcgatggggccaatttatcgccgctggggcgatgaataaagccgccaacgtgctggtggtgctgtccgacgaaagccacctggacctgaaggacggcaaggtgctgtccaccggcttctatctcaatgagctgatgcagccggtcaagctgctgctggacgccggccacgaggtgaccttcgccacgccgcaggggcgggcgccgacggtggatgcgtcctcggtaacggccgcctacttcggcaacgatgccgcacagctgacgctgcacaaggagctgctggagaaactggcgctgacctcgccgacggcctcgccggtggtcagcctggcgcgcatcgagcagcagggctacgcgcgtttcgatgcggtctacattcccggtggccacgcgccgatgcaggacctgctgaatagcccggcgctgggccggctgctggccgacttccaccagcgcaacaagaccactgcgctggtctgccacgggccgatcgcgctgctgtccacgctgccggatgcggtgggttccgtggcgaagctggatgccggtgcgatgccggccacgccgaagtggatctacagcggctaccagatgacggtgatcagcaaccaggaagaagcgcaggccaagccgctgctgggcggccgtgagatgaagttctacccgcagaccgtgttgcagcgggcgggtgcggagttcagcagcgacaccacgccgtggaccggggctgtggtg

SEQ ID NO: 33325 - DNA, 756 bp, Glycine max
  Peptide Sequence Number=SeqID_125010
gctcctgcgcaggagcccgttgcgactcagacccactctctggccccgtcaatccaggccgaagtggctgacgccgtcccggctactgctcgtctccacgaagccgaagcaacaccagcgccagtccaacttgagccagacgttccagcccccctcgcagcagccgaggccgctgcgcccagggtctcagagcacgagcctccttacgcgccaccacccgtggaagcactggcggtaccaccctcaagcgcaacggcccagcaagagcccgaagcgccgcccgcccccctgctgcctacccagcctgagcatcccgatcacgccctctaccagcaggtgcgcacaggcgtagccacattagatgcaaagcacggtcgcacgttcgacgaatccagcgagcgcatgactgccagcttgctggtgctcgccaaggacaacgacctggatcgcgtggaccacgtactgctgagcaacgccaccgcggacaaacccgccggtcatactctcccgccctcttggtccctctgcttgccaatcggcgctattgatatcgccgcacaatcagaagaacagactcgctcgctcaacggtcgcgagcggattggccttccgcaccgcctccagaaaaagcagaaagtcgcggttgaacagcgaaaggttgttggtgaacgtcacgcactttttacccgatgctctgctgaagcatacctgccagacatagcgcgcatagatgacgtcggacgttcgggtgactga

SEQ ID NO: 33326 - DNA, 522 bp, Glycine max
  Peptide Sequence Number=SeqID_125011
atggacctcatcaaggctgctggactgctgaagacagtcaccaaattgggagactgttatgaaggactagtcagggaattcattgtcaacattccctctgacatatcaaacagaaaaagtgatgattatcaaagagtgtttgtcagaggaaagtgtaaagatgttccaacatcttccgctccaaatgctgaagcactcccttcacccagtgaagagggatcaactgaggaagatgatcaagccgcagaggagactcctgcaccaagggcaccagaacctgctccaggtaacctcattgaccttgaagaagtagaatctgatgaagaacccattgccaacaggttggcaccgggcattgcagaaaggttacaaagcagaaagggaaaaactccccttaagaggtctggacgaatcaagactatggcccagaagaagagtactccaatcactcctgccacatccagaagaagcaggttgctatcccctccaagaagaggaaagaaatttcctcatccgatctga

SEQ ID NO: 33327 - DNA, 564 bp, Glycine max
  Peptide Sequence Number=SeqID_125012
atgtgtcacaaatttagttatgaggcacttgacaaaagcttaaaagacatcatgtacaacgacagaccttttgggggaaaggttattgtttttggtggtgattttcgacaaatactacctgttgttccaagagacataggtgatggcaaacttggccaacctaacgatggacattgcgaaatcgccatcccaaatgagtttcttataatggattttgaggatcctatccaagcaattgttgatgcaacatatccagatttattacaaaactacaacaacgcagatttcttgcaaaagagatctatcctagcctcttcaaaagatgttgttgacaaaataaatgactatgtcttgtctttgattcccggtgacaagaaagagtattgtagtgctgatagtgttgacaaatctgatgagctactcaatcttgcttttggattactaacacctaattttcttaacaccttgaaaacatcagggatacctaaatcacaagctaagaatcaagattggtactcccatcatactatgaaatttagaccagatagatggtttatgcaatga

SEQ ID NO: 33328 - DNA, 198 bp, Glycine max
  Peptide Sequence Number=SeqID_125013
cgagctttcgctaagcgtgacactcagtggctaagtacgaggaagaatccagaagaagatgagctgtcaggttcgctgagcgcaccgctccaggtcatcaagcgcaccgcttcagcttatccgctgagtgagagaagcgcgctaagccacaatccacttatgcgcactaagcgatccagatttgcgctaagcgcatga

SEQ ID NO: 33329 - DNA, 477 bp, Glycine max
  Peptide Sequence Number=SeqID_125014
atggataagagcttgaaggtaggagaagtgagtggaagcatatttattcaaatcatgatggccacaaaatggtctgcaatgaaaatgctgactggtcatcaaattgagtggactcatcttgtccgctaccgtatgcataaggcattacaagcaaatgcacctctttcatacccccaacttgtcactctctttttccaacattttaacgtccctctagatgatgaaccctttgttaaggttaaacgttattttgctattggagctgctgttgttgcatcctatggctatcggaaggatatggatggtcagtgggtatggacacaagaccttccacctactgttccttatgaacatacaccctcaccaccaccacaaagggattcctcatcttcactgctgcatgagagtctaagtgaactttgggatcttcgtgtcattgtagaagtgatcattttgatgctatggattcccgtataa

SEQ ID NO: 33330 - DNA, 204 bp, Glycine max
  Peptide Sequence Number=SeqID_125015
atgagtcctgtgaagcaactagtaaatcaagttgaggaaggggaagatgaggattgggggctttccccagagctaaaaagaatggtcaaacaggaagacagggaagtgaagccacaccaagaagaaaagaagattgtaaacttaggtgttggcaaagaaagaaaagaggtcaaggttggcacgtgcatgtccacgaatgtctga

SEQ ID NO: 33331 - DNA, 537 bp, Glycine max
  Peptide Sequence Number=SeqID_125016
atggtcaccagtcccagaccgtcgggaaaatcgaccggcacatctttcatggaatgcaccgccatatcggcacggttttccagcatagccagctcaagctctttgacaaacagtcctttgccacccactttcgccagcggcgtatcaaggatgacatcacctttggtgaccatcggcgccagctcaacctgcaagccgggatgcgcagccatcaggcgctgttggacatattgtgcctgccacaaggcaagcgggctttgcctggggaatgctgtcagtttcaacggattgaccaggctgcaatctcagaccggagcccgctttttacggcgtcagattctgaggctggagtccgaaaatgcagggctacgtttggaacgtgctaaactgtcaggtagcgcaactttctttacggtcaatcttccagctgcgtgtagatcgcgcactagctgccatgggacctgctttccagcacgtctacagtctgctgccaacattactgcattatcatcatccgctgatgccgggttaccttga

SEQ ID NO: 33332 - DNA, 407 bp, Glycine max
  Peptide Sequence Number=SeqID_125017
atgaaagaaattaaaagagaaaaacatgcctccgatagtagtcatgactcttgcaagagtttaagtgaagaacatagcgactattatagagggcaccatagttcacatactaaacatcactcccaaagaaaagaaaaggaaagaaagcctcaagaggctaacattaacctctcatacctccatgggaaggacaatgtagagcctaacttagattgggaaataagggtagagcaacaacttaaaaggaagtctacttcaaaatcttatggctctcactcttatccaaataaagaccaagctctaggcatcttaggggcagcaccttctaagcccaaagatgataaggggaagacaatagaaaagaagccccctaaggctagtaggcaagaaaagactagctctataaa

SEQ ID NO: 33333 - DNA, 318 bp, Glycine max
  Peptide Sequence Number=SeqID_125018
atgcttccatttgatttccggtgtgtcacgaaaacttacggattgtgcatcaatatttttttggtttttcggcatgtcctggaatttcacaaattgcctaatgatgggtgccaagcacctcacaaggaccaaagaaaggtcgcatgtcatcaagcaaaggaatcgcacgaagacagtacatatggaggcttcaatcccttctccgtctctctgacgtttaggaactctatcagagcagtcagaggaaaaattggacaaatctcaggaaactgcaagagatgccgctatcgcagtcggaagacacgtgagtctgcttag

SEQ ID NO: 33334 - DNA, 719 bp, Glycine max
  Peptide Sequence Number=SeqID_125019
tggcgtcactcctacacgtccccatcactggcgcgctgcataagttcgagccgctggttacttcagacccgattggtctactgacggagcttcttgaggtcagtcatgaggaggctacatttgagactcgacaggctggtaggcctcatgtccggttggggtggcttcaggacttgtatgagagccagtgcagggccagacgatgggttgtagcagcccgaacgtatctgctccacttggtgggttgtactcttttcgccaacaagagttcaacccatgtacatgtcatgcacctagaggctttcagggacctggcccaagtagggggattctcctggggagcggctgcattagttcacatgtacgagcatctgaatgacgcgtcgcaggcctctacacggcagttgggcagttatattatacttctccagtgctggatatacgagcactttcctatagtgcatacatgcgtcgttcatgatgcttatgatgaggggagcccacgggtctgcaggtggcttacgggtaaggctcatatgacggggatcaagggagccccgtatcggagacgtctggatgccctgactgtgactgacgtgtgttggatgccctatgctgagcaccggggagtcaggggctttgacttgatatcgtcgtacaccggccagctcagatggggtcagattgtggtgtacgttcgacctgagcgggttctttga

SEQ ID NO: 33335 - DNA, 588 bp, Glycine max
  Peptide Sequence Number=SeqID_125020
atgtttgcatttagtgagaaacaacgagactttttcaagtctcacaagtatccagaactacgtaggtctgagttcctcattggaggatacgtaggagcaagagcctcgcttttgtcgaccacaccgccttttgttgccatgactcaagagctggtagcccgcggagacaccttacggttatccgcacctcatcattcagtgaccccaagtgtgattcacgagcagagaccaatatggtcatctgcgccctttccggagatgtcagcatttccgatggagacttttcaagtctcacaagttatcaagaactacgtagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 33336 - DNA, 231 bp, Glycine max
  Peptide Sequence Number=SeqID_125021
atgatgacaaaggtgatgacaaaaagctcaaagaatcaagaacacttcaagactcaagaggaaagttatagaacacttcaagattcaagaggaaagttgaattcaagaatcaagaatcaagattcaaggatcaagcttccaagaatcaagatcaagcttcagactcaagattcaagaatcaagaaagagcttaatcaagatagtatgaaaggttttttcaaaactgagtag

SEQ ID NO: 33337 - DNA, 368 bp, Glycine max
  Peptide Sequence Number=SeqID_125022
gacacccagtggacccggagaagtccaacagggccctggggtttccagctctggttacgggtctctgtcagtcctacagggtgcccgtccccccggcaaggtcacgtcatcatgacatagggatcgcgcccacaaaggcacccagtggacccggagaagtccaacaaggtcttgaattctatggagtgcctgtcaccttcagcaagggcatcaggccccctactaatcgagctttcatcaagaagtattgcgtccccaggcaggcgcagggcgaaacacaacagcagcctggggatggccggcagcgggcaatagacgcaccgccatcacctctagagttcacctcagctcatccacaaaaaggttag

SEQ ID NO: 33338 - DNA, 388 bp, Glycine max
  Peptide Sequence Number=SeqID_125023
gatagctggagcccgcgggcgagtctatcggccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgctgcaaaacccagggcgcgagcccgggcggagcggtcgtcggtgcagatctggtggtagtagcgaaagtattccgggaaatgagaaagctttgaaaagagagggtcaaagagttccatgtgaacggcattgcacatcgggagtcggctaa

SEQ ID NO: 33339 - DNA, 126 bp, Glycine max
  Peptide Sequence Number=SeqID_125024
atggattcgaagcacttctacggactatttgtgggagtaacccaaggactcaatgtatggaagaaaagacaggatcaaaaggaaaagggggggaaatactcaatcaaaatgggacaaaaggattga

SEQ ID NO: 33340 - DNA, 255 bp, Glycine max
  Peptide Sequence Number=SeqID_125025
atgcgactttcaagagctaatgaaccgacaagcagccttccggtcatatccacttggttggtgcagaccaaccggcaggcatcatgcacagaaaaatcacacttccaatcatcatccagtgcaccttcaaatgggtcaatgatagaacgagaggagaagaggttagtgtaccgtgtatgttgttcttccgatgagaacaatgaggaggaggaaatggagtatcctgagcctcggagtgccgttggcttctactag

SEQ ID NO: 33341 - DNA, 521 bp, Glycine max
  Peptide Sequence Number=SeqID_125026
atgggttctgtcttgatccctactgtaaacaaccaacggagaggttctaccaagtcaaagtcaaaagtcatcagcaaagagaattttgaagcaccggaagaggacgcagaagtccaagctctcaaaagcgagttaggaaaggcaaaactcgccaaggagaagttcaagttggctgctacacacgttcggaaggagtgtgccgggttacgggaagagaatacaattaccgcaagagcccttgaacaagagaccaagagggctcgcaaggaagagtatggccggaacaaatttcgcgaagctctatggggtagcaatagtgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcgcggatga

SEQ ID NO: 33342 - DNA, 117 bp, Glycine max
  Peptide Sequence Number=SeqID_125027
atggaggttgatgaaccttggttggggttatggctaccattgaattgcataggacaccggaattcgggtggtgttcgtcattggaagtgcggtagacaggctttgtggttgatttag

SEQ ID NO: 33343 - DNA, 521 bp, Glycine max
  Peptide Sequence Number=SeqID_125028
atgtgccgccccagccaaactccccacctgacaatgtcttccgcccggatcgaccggccgaagccgaccttgggtccaaaaagaggggcagtgccccgcttccgattcacggaataaaggccccgaaagggcccgttcccaatccgtccccccgacccggcacgcgacgacccgctctcgccgcggaagcagctcgagcagtccaccgacagccgacgggttcgggactgggacccccgtgccccagccctcagagcccaatcccttttcccgaggtttacggatccattttgccgacttcccttgcctacattgttccatcgaccagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 33344 - DNA, 249 bp, Glycine max
  Peptide Sequence Number=SeqID_125029
atgggggtgcaaatagcacccaggcccatttgggccctccagaagattcctccagaaggcgaaaatctaagccgaggcgcttccgaacgtttccgtaacgttttccgtgaggaatctcgcaaaggtttcaaccgttcttcgacgttcttcattcgttcttcatcgttcttcgatcttcaacgggtaagtacctcgaaccaagcttttcgattcattctatgcacccatagaggtccacattgtgtttag

SEQ ID NO: 33345 - DNA, 653 bp, Glycine max
  Peptide Sequence Number=SeqID_125030
gctcacttcactactccgtcgagcatgcactgcctcctaatgagctttccaagatgccagccatggatgtggccagtaaaggcagaaacttcaggaccatcgacccaaatgaatatgcgttttcgccaacggcaaagaaaccagtagagaacatgccgtttgaaataagaagtgatgaacctttgaaaagcatgtcattgtcatcatcaagcaatgcctacaacgttccatgggtagaaaagtatcatcccatcaaggtcgccgacgctgtcgtcaatgaggacgccgtctccaggctccaagtcatcgctcgcaacaacaacatgcacaatctcattttatctggtcctccaagaactatcaaaaccactagcattctcgctctcatgcacaagcttcttggaggaccaaattgcaaggaagctattctcgaactaaatgcttcagatgaaagcgatgtttatgaagaggaaagacatgcattggcagtttggaatggcgattttaagttttgctctatctctgttcctgatcagggagagggggagctggcgcaattttgctctggaaattgcttctgggatatcaaagatgtttgctcagaagaatgtcacgctgagcccggggaggcacaagatagtgatactggatga

SEQ ID NO: 33346 - DNA, 522 bp, Glycine max
  Peptide Sequence Number=SeqID_125031
atggaaagggagacgataatcgtgatggtagacacattatcgatactctactatgaaaagatggtgggttacacaccttcaagttttacagatttggtcttcgccagcaaaaagatcgaagtggatccgaaaagaggcaaatttgatcatcctactaggacgactgagaaaactggggcaaatgaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaaccataaccctatccaaggttcatcaacctccatttctccgagaatacgactcgaacgcaacgtgtgcttgtcacggagaagccccggggcgttccattgagcatggtagggctctgaagcgtaaggtgcaaggtctaattgatgcgggctggctgaaatttgaggagaattgcgtgtaa

SEQ ID NO: 33347 - DNA, 399 bp, Glycine max
  Peptide Sequence Number=SeqID_125032
atgaagcacttcactgacaccctcatcagtgccaacataggaacaaaagctggtaccgggccccccctcgaggtcgacggtatcgataagcttgataataaatctgttattgctggacttggtgttgcagcagctgcaactgcgactgctgcagcggcagctgttggtatgggagctaaacccgaagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33348 - DNA, 860 bp, Glycine max
  Peptide Sequence Number=SeqID_125033
ggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcacgctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgatggactaaagtgtcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 33349 - DNA, 258 bp, Glycine max
  Peptide Sequence Number=SeqID_125034
atgaccattttaatttctcgagagcttccgttgttcaattttgagcgtctcgatatattatgtgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 33350 - DNA, 342 bp, Glycine max
  Peptide Sequence Number=SeqID_125035
atgtggagacacccgacggtaacccacaaacactcttttgctatccgtccagactcagagtctgctaggggcaagcagcccgttcgacacgcagagactaacgtcgtcttttgcacctttgtcatccagagacgccggaagtcagtgacatgcggagaaacccaagtcggcagagatacccaagtggttatgggtataaacactctttcgttatctgccagactcagagtcggattacatgcagagactaatgtcgtcttctgcaccctttgtcaatcaggagcaagcaaacccgttgacacgcggagacttatctcgtcttctgcacctttgtcatcctga

SEQ ID NO: 33351 - DNA, 294 bp, Glycine max
  Peptide Sequence Number=SeqID_125036
atggcagcggaatggagaaggaagagagagaggagatgccacttcaaggagaagatgagtctagaagaagctcaccaccataggaggccatggataagagcttggaggaagaaggagatgaatgaagggagagagaggaagatcctaagccgaaatgcctcacgccctacctcaattacaagttgctccactaagtgtgttgtcatgaggcatgaaaagctaaggacatgcacaaagtgtgagctatatgatgggcaatgggggtgtaagcaaatgctcacactccctagctaa

SEQ ID NO: 33352 - DNA, 654 bp, Glycine max
  Peptide Sequence Number=SeqID_125037
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 33353 - DNA, 300 bp, Glycine max
  Peptide Sequence Number=SeqID_125038
atgcatattcatggagaagatcgcaaaggcaaaggagatgaaaataatgaagattttcatagtgatgaaataaaaacagatgctgatcttccaagagagtggagagtttctagatatcatcctcttgacaacattattggtgatatatcaaaagggtacttggcaccctttgttgcacaatatgtgaagtcccgagacgcgccggaaatcaaaaggaagctggttacgccatccgttaaattctgtaatgtgacggaaaccaaaaagaagtattgttacgcaatccgtgagtttccgtaa

SEQ ID NO: 33354 - DNA, 261 bp, Glycine max
  Peptide Sequence Number=SeqID_125039
atgaaaagatcaacaaagacagaaacaaatccactatctgttttacgtcaagcaatacgtggagtaactcccgatatagcagtaaaagcaagacgcgtaggcggatcaactcatcaagttcccgttgaaataggatccacacaaggaaaagcacttgccattcgttggtttggtcctcatcatggattctgtaaaatattccaggattccaaaaagcaggaaaaaattgcgggatttttggagattggatgcagttactaa

SEQ ID NO: 33355 - DNA, 354 bp, Glycine max
  Peptide Sequence Number=SeqID_125040
gagcaaagggaaacacccttgtcgaccacaaaaaggaaaaatataaaaggatataaggacataaaagggaacgtaaaaatcaaagtcacgtttgcacattcgattaaaggctgcccgtcccttgggacggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacaatacttcagcatgaacgtttag

SEQ ID NO: 33356 - DNA, 396 bp, Glycine max
  Peptide Sequence Number=SeqID_125041
atgttgctaagtagcaacgtcatctatatctatgtaagagttgtcatgttggtgcgcatgatccacactcgtctctttgcagcggcacgggtgaaatcttgccccagtatgcatagtagttgtgtgatagcctccctctctggttgtgctcgcacagttggccctcctccaatatcagggggtggcccaggaatcgtgtggatgtggagcacactgaaaatgaggacgcgtagccctctaaaggtgagggcgtgcaatcctctgagggtgaggacgtgcagtcctctgagggtgaggacgtgcagtcctctgaaggtaaggacgtgcagtcctctgaagtcctctgatggcgagggcgtgaagccctctgaagtgagggcgtgtagccctacgaag

SEQ ID NO: 33357 - DNA, 174 bp, Glycine max
  Peptide Sequence Number=SeqID_125042
atgacgactttcaggaaggtcgacgggttgagcacattcaatgtactgggagcaaaactcaattcactcttcagcaacatacctttcgacaatcaaagcttcgggaccaataagcctactggtaatcgattacaggatgttgtaatcgattacaggctgcctgttcatgtgtaa

SEQ ID NO: 33358 - DNA, 267 bp, Glycine max
  Peptide Sequence Number=SeqID_125043
ggctttccccggtatcaaacaaggggacacccaggattttattttatttttggcgaaagtgatccttccggtcacagctgtcccttcctgttcagctactgacgggggtggtggggtaacggcaaaaagcacccgcccggacatcagcgctggcaagtgtagcggtcccgctgcgcgtaaccaccacacccccccgcgcttaatgcgccgctacagggcgcgtcccattcgccattcaggctgcgcaactgttgggaagggcgatcg

SEQ ID NO: 33359 - DNA, 723 bp, Glycine max
  Peptide Sequence Number=SeqID_125044
atgatacgcggagataccttacggttatccgcacccttttgtcatccagaggcggcgggcccgatgatacgcagagataccttacggttatccgcacccttttgtcatccagaggcggcgggcccgatgacaagtagagacaaaatttggtcattctgcacccttgtgtcatccagaggcggcaggcccgatgatacgcggagataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttttgtcatctagaggcggcgggcccgatgacaagcagagacaaaatttggtcattctgcacccttgtgtcatccagaggcgggcgggcccgatgatacgcggagataccttatggttatccgcacccttgtgtcatccagaggcggcgggcccgatgatacgtggagataccttacggttatccgcacccttgtgtcatccagaggcggcgggcccgatgatacgcggagataccttacggttatcccgcacccttgtgtcatccagaggcggcgggcccgatgatacgcggaaatacccgagtggttatccgtataaacattcttttgctatctgtaagacagaacgcttgatagcatgcagaggctga

SEQ ID NO: 33360 - DNA, 519 bp, Glycine max
  Peptide Sequence Number=SeqID_125045
atgaggacgcgtagccctctaaaggtgagggcgtgcagccctctgcaggagaggatgtgcagtcctctgatggcgaggacatatagtcctctaaaggtgataggtactagtacccaagggtccacctttatgagaaagcaagagatcgactcatcgagagggccggtcatccacaagattggacatgaaatattgactgtccttttgaaaaaggtgataattcatgcaaccctatcctatcttttgcaaatctctccgggaactccctcaaagtgtgatgcaagctccattggagcttgtaggcctaggatcttcttcatcaatggattcctttgcttcttggaagatgaatggcagcagaatggagaaagggagagagagaggagacgccacttcaaggagaagatgagtctagaagaagctcaccaccataggaggccatggataagagcttgtaggaagaaggagatgaatgaagggaaagggagagaagagcacgaaattttgtgctctaaatga

SEQ ID NO: 33361 - DNA, 246 bp, Glycine max
  Peptide Sequence Number=SeqID_125046
ggcgcgtcccattcgccattcaggctgcgcaactgttgggaagggcgatcggtgcgggcctcttcgctattcgccagctggcgaaagggggatgtgctgcaaaggcgattaagttgggtaaacgccaggtcgggaaacctgtcgtgccagctgcattaatgaatcggccaacgcgcgggagaggcgggtttgcgtattgggcgctagcggagtgtatactggcttactatgttggcactgatgagg

SEQ ID NO: 33362 - DNA, 259 bp, Glycine max
  Peptide Sequence Number=SeqID_125047
atggaaaccaaacttaaagcaagcgaagcaattaccaagaccgaagtcaaagcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaaggctgcaccgg

SEQ ID NO: 33363 - DNA, 489 bp, Glycine max
  Peptide Sequence Number=SeqID_125048
atggtgggttacacaccttcaagttttacagatttggtcttcgccagcaaaaagatcgaagtggatccgaaaagaggcaaatttgatcgtcctactaggacgactgagaaaattggggcaaatgaagagggtgagaaagagggagaaacccatgctgtgactgccattcctatacggccaagtttcccaccaacccaacaatgtcattactcagccaataacaaacctcctccttacccacaacccagttatccacaaaggccatccctaaatcaaccacaaagtctgtctaccgcacttccaatgacgaagaccacttttagcacaaacaaaaaaaaaacaccaacaaaaaggaattttgcagcaaaaagcctccataaccctagccaaggttcatcaactccatttctccgagaatacgactcgaacgcaacgtgtgctgtcacggagaagccccggggcgttccattgagcattgtagggctctga

SEQ ID NO: 33364 - DNA, 540 bp, Glycine max
  Peptide Sequence Number=SeqID_125049
atgaccatgattacgccaagctcgaaattaaccctcactaaagggaacaaaagctggtaccgggccccccctcgagcccaggctggcgtgcagtggcgccatctcggctcactgcaacctacgcctcccgggttcaagcgattctcctgcctcagcctcccgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33365 - DNA, 724 bp, Glycine max
  Peptide Sequence Number=SeqID_125050
ctctagtgaagtgaaaagcaaaaggggaaagaatcttagtgaagaaatctacccccaagaagaaggacaaccattagtggttaaagagaagtgtaaggaggtaagtgtctcctccaagagtttagctaagaaggaaactcattttacaataaagacaaacattaaagaaactttccctcttagacaacctccacattttctcttttgtaaaaaggcacttgcaagcattgccacacctcttgggcttgagtttattcctcaagtaaagaagttgttggatgagggtttggttcgcaagagcttaaatccttgtgctttgttggtgcccaaaataggtattattaggtaccaagtccctaaaataggtggtatgatgaatgttttgagtggtgcaaccctcttttgtaaaatcactcgtacacctaacatcttcatggtgtgtgtacatagagacccattaggtaggggttcccatgaacctaagagaataaaggtcattcctgagtggcccattccaccaagtataagaaaaatttggggcttccatgacttacaaacttttacaaaaggtgttgaggaaaaaagcccagagtttcaagaacctcgggatttgaggtcaaatccttttcaagggggagggaatgatgcaatcctaccccacaagggcattggacaaaagacgactccaagtagattgggccagagatgcaagaaaaggccctag

SEQ ID NO: 33366 - DNA, 162 bp, Glycine max
  Peptide Sequence Number=SeqID_125051
atgtcggacaaagagtcctggacatccggcccaagatactggacacagaagatttttcaggagaatgatagatctcatccagcgcaagttgttgcagcccagatacgcacactgctatataaacatgaaggctgcacgagttttctaccagtccgggattga

SEQ ID NO: 33367 - DNA, 240 bp, Glycine max
  misc_feature (205)..(205): n is a, c, g, or t
  Peptide Sequence Number=SeqID_125052
ggcctctcggctccgttcagcttcctgctctcataagcaagcaactggatggccctcaacagccacaaaacaagggagagggatatggaaaggatgaagtaatgaaagacgaagtcattgctagtagtaaggacttgtcacgatccattggttcatataaaatccatgtcctaggagatagttgcccatcatacggctcaccaanttcacttgcctctatgggagactcgctccgggcag

SEQ ID NO: 33368 - DNA, 305 bp, Glycine max
  Peptide Sequence Number=SeqID_125053
atgttggtgcgcatgatccgcactcgtctttttgcagtggcacgggtgaaatcttgcctcggtatgcatagtagatgcgtgatagcctccctctctggatgtgctcgcacagttggtcgccctccaatatcagggggagccgtctactatgatgaagagtctccactattcgccgtccctccagggctgctctcctccgtagagtctgtctcagatgctgacatgacatcctctggagaatccacatcagggagtggtcctcatcatcctctggaaagtcaagagcatccacagcaggctcagga

SEQ ID NO: 33369 - DNA, 695 bp, Glycine max
  Peptide Sequence Number=SeqID_125054
atgggatcaagtcaaatgccttttcttaaaaagaggttctatcaagtcaaggtcaagagcctagggatcaccagtctaaaagagttagggcagttgatgggtcagctccagtggcaagcttttcgcaaagcttacgataaaatctgggacctagccacggtagaagtctccacagaggccattgtctccctcgcccagtattatgatcagccgttgaggtgcttcacctttgaggacttccagctatcacccatggtggaagaatttgaagagatcctaggatgccctctaacgaggaggaaaccatacctcttcacagggttctatccctcattagctagaatttccaagatagtccaaatcttggcacaggaattagaccataggaagcaagtcgaaaatggggtggtcggaataccgagaaaatatttggaggcaaaagcaagaatcttggcaggtaaaggcgagtgggtcccgttcatagatattctcgcactgttgattttcaggggagtcctctttccgaatgtggatgggttggtggacctggcagtgatcgacgcttttctcgcctatcataaccacaaggaaagcccggttgtcgctatgctagccgacctatatgacaccttcgaccgaagatgtgaaaagagtaatacaagaattgtttgctatacttcagctctttatgtatg

SEQ ID NO: 33370 - DNA, 288 bp, Glycine max
  Peptide Sequence Number=SeqID_125055
atgactcatcaggattttcaagtgcaagccattggtcagtttgctcaagcaacctgtgctcctgagtttggacttccaagaccgttcaatcatagattactcgtcttgcacgttggtgggggtgccgtaaaacaacgaggacaacccttcccttgtgttcaagaatcccctacaacaacagacccacggtctcttaatcccttttcagaaataagaagaagagaagaagaaatctctcttaaagagatggattgtaaaatgaggatcatcaaattccttattgaataa

SEQ ID NO: 33371 - DNA, 102 bp, Glycine max
  Peptide Sequence Number=SeqID_125056
atggggacaactaaatcaagtactgctctaggagagaacttgttccttgatgatggaagagttgaggcaaaggccaaacaaccaaaaatcctcaaggcatga

SEQ ID NO: 33372 - DNA, 377 bp, Glycine max
  Peptide Sequence Number=SeqID_125057
atatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaaaatactttatgaaatggctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctg

SEQ ID NO: 33373 - DNA, 321 bp, Glycine max
  Peptide Sequence Number=SeqID_125058
atggcgctttccctgagaacgcgacaactggcaatggtgtcgccattcacgatggcgtgttgcaggggttggactcgccagtcaaactggcgagttgagggtgcagatttcgttgcagtctgcaacgctgcaggaagcgccatcttcaatggcgttttgcttggccaaaggcgccagcaccagcagcgattcgcgttgcctgagctgcttaaatcccccctcttcgtagaccatttcacacgagaaaaagaaaagaaaagagaagatcggtgctgtgtgtttgaggaagaacgaaggagtgttgctgtgctttgtatttga

SEQ ID NO: 33374 - DNA, 816 bp, Glycine max
  Peptide Sequence Number=SeqID_125059
atgaggggagcaccgatggaagaaagcatgtctcctttccttgtgagcgatttcggcgcacaaaatttcaaggctatacaaagaatccgtaaggcatgggaaaccccgttaaggaaagatcaagaacctaggggcattcgtaatggcatcattggtggttaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggccgctacacacatccggaaggagtgtgccggattacgggaagagaatgcaactaccgcaaaagcccttgaacaagaggccaagagggctcacaaggaagagtatggccgtaacaaatttcgcggagctctgtccaaaaggagcttgtctcagcgtttatgcgagacgaagacctacatgctagctatcatcgccaagtaccaagaagagttaggtctagccacggcccacgagcatagggttgcggaagagtatgcccaagtatacgcggaaaaagaggctagaggaagggtgatcgactctttacaccaagaggcaaccatgtggatggatcggtttgctcttaccttgaacgggagtcaagagcttccccgattgttagccaaggccaaggcaatggcggacacctactccgccaccgaagaaattcatgtgcttctcggctattgtcagcatatgatagacttaatggcccacataattagaaatcgctag

SEQ ID NO: 33375 - DNA, 492 bp, Glycine max
  Peptide Sequence Number=SeqID_125060
atgataaaattaagagcgatgctaagcattatatttgggatgacccctatttgtggaagttgtgcagtgaccaggttattaagagatgcattccagaccatgagattgactcggtcctacaattctttcattcttccacaccaggtggccatcttggcatacagagaacaacgcacaaggtgtttgactgcggtttctattggcccaccatcttcaaggatgcgtggagaatatgtagcacttgtgagccttgtcagagagcaggcggctcaccttcatggagacaacaaatgcctcaactacccatattttatggggcctttcccagtctcttttggttttatttatattctccttgctgttgattatgtttcaaaatgggtggaagcctgtagaagcaagcttcatgatgatgaatcaagattgattcaaggagttttgatgataacaaagatgatgacaaaaagctcaagagtcaagatcacttcatga

SEQ ID NO: 33376 - DNA, 213 bp, Glycine max
  Peptide Sequence Number=SeqID_125061
aaggctgttgcttctggaggaagcaacctggctcgcctgggcgagctgggcggcaaccacctcccctattttgctataaatagggaggaagtgaagaagaaaggggcgcttccgaaacgttttcgtaacgttttccgtgaggaatttcgcaaaggtttcaaccgttcttcgacgttcttcattcgttcttcatcgttcttcgatcttcaacgg

SEQ ID NO: 33377 - DNA, 408 bp, Glycine max
  Peptide Sequence Number=SeqID_125062
atgagggtgtgtgtgtgtgtgtgtgtctttgtgtgtgatgaggattatggaaatctatccactattgctttaagtgtgaaggaccctaaaatgagcttagatgactcatctatcagcttgggattggagaggatcagggagtgcagtggggcaatctcaaatgcttgcattttgcatactgatgaagtagtatctgagaagttgattctctctggaggcaaagcaggatctaaagaaaaaatctctttggatgaattcacagggtgtccccaagatgaagcagaagcaaacattcaaggaaaagagcatgagttgtcttatacagctcacgagcatagacccaaagaaggtgtttcacaagaagaatttcaggattttcatatcagtaaaagaaagaggataaactag

SEQ ID NO: 33378 - DNA, 189 bp, Glycine max
  Peptide Sequence Number=SeqID_125063
atgagggacggcaagaggtcttcgtacgtcattggggagtggggtgaattcttgaaatggcctcagagggaagttccttgttgcgttggaattattggccgggcgagttgtgttcagagttggaacttgggagcttccctctgggtgggtgccttaggctgcacaggtgctgaactagaggcgttcctg

SEQ ID NO: 33379 - DNA, 338 bp, Glycine max
  Peptide Sequence Number=SeqID_125064
ggatcgcacccacaagagacacccagtggaacctgaagaagtccaaacagggccctggggtttccagctctggtttacgggcctctgtcggccctatagggcgcccgttccccccagcaagttcatgttatcgtggcatagggatcgtgcccgcaagacacctagtggacccgaagaaggccaacagggtcttggagttgccagctctaaatacgggtctctatcagttcaagggagtgcctgttgcccccaacagggtcatcaggccccctaccaatcgagctttcatcaagaagtgctgcgcccccagacgggcgcagggcgagacaccacaatag

SEQ ID NO: 33380 - DNA, 447 bp, Glycine max
  Peptide Sequence Number=SeqID_125065
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccgacctcaagcaaatgaatcatccaacctcaaatatggtaggcaaagatttaggaagtacggacgaccccatgatgtgcaaattcaaaacgagcacgccttcccatcatatggcttgcctcccaactatacaccacccaacgtggcgtacactctcaatgaaaatctcaataactccactccgatactcattgagaaccaataacctcaatctgatcaggcacatatctctcaaaccatgggggagacacatgaaattccccaccacaatctag

SEQ ID NO: 33381 - DNA, 522 bp, Glycine max
  Peptide Sequence Number=SeqID_125066
atgactagaggaaatccatatgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctacgaaagcttgtgcatccaataccctgatgaggatgtcccatatgttcttaagactagactgattcatttacttccaaagtttcatggccttgcaggtgaagaccctcacaaacatttgaaagaatttcacattgtctgctccaccatgaaacccccagatgtccaagaggatcacatatttctgaaggcttttccctcattctttagagggagtggcaaggactggctatattaa

SEQ ID NO: 33382 - DNA, 231 bp, Glycine max
  Peptide Sequence Number=SeqID_125067
atgaaaatcctgaaactggccaaatataggctaaaggcccaagtggagaaggacaaaggcccaagtggagcaggacaaagcccccgaacttatcaaggtaatccttgtggcgtctaccctgacatatcttccttcactggaagtggcctcatccaaatctccgtagcctgtatcaagcgatccgctcctagtcaggatcacatcatctggtatcagagcttcggctcttga

SEQ ID NO: 33383 - DNA, 327 bp, Glycine max
  Peptide Sequence Number=SeqID_125068
atggtgaaagttggaacctcttacgtgccgatcaacgtctcattttcgccaaaagttggcccagggcttcccggtatcaacagggacaccaggatttatttattctgcgaagtgatcttccgtcacaggcttctgtttctatcagctgtccctcctgttcagctactgacggggttgtgcgtaacggcaaaagccccccggacatcagcgctggcaagtgtagcggtccccctgcgcgtaaccaccacaccccccgcgcttaatgcgccgctacagggcgcgtcccattcgccattcaggctgcgcaactgttgggaagggcgatcg

SEQ ID NO: 33384 - DNA, 469 bp, Glycine max
  Peptide Sequence Number=SeqID_125069
atggagcttatggaggtcaaggataaggaagaagtagtagaggcagaggggaaatttgagagggaaatgcaagagttattaaatgaagctactatcctacaatgcatttggaaggacgatggagtagaagtcacatttattaatgtctattcaccatgtgatatggatgcaaaaagaaggctttggggagatttaattccgcataaggagaataaatcatggtctaatgtgggcattataggggacattaatagtgtgagaagaattggggagagggaagaggtcaaccctagaggagtcaaatatgagaaaatctctttggaggataataatatgttgatagggagatttgaggaagaagaagtgagggaggcaatttgggagtgtgtcaattctaaaagtttggggcttgatgggggtgctaatgcttcttttgttgctctaactccaaaggtcgaggatccaaaag

SEQ ID NO: 33385 - DNA, 195 bp, Glycine max
  Peptide Sequence Number=SeqID_125070
atgacggtaacgctgaacaactacaaaggtggctgcaacgtggaaatcagcatattggatatcatgaaacgacatgagtttctgtgggagccttacacagcaactgttatgtcagtgttacctccaatttgtttggttggaagcgtagcgtggtgcgcagtggtgccactcatttgtttccatgttgttgagtaa

SEQ ID NO: 33386 - DNA, 96 bp, Glycine max
  Peptide Sequence Number=SeqID_125071
atggaggctggatctttgagcttcaatgaggtagcttccttgagaagctttcttgagaaaacttccttgaaaagcttatttgagaaacttccttga

SEQ ID NO: 33387 - DNA, 1302 bp, Glycine max
  Peptide Sequence Number=SeqID_125072
atggccaacaatcaaggtcaccaaactaccccactcgacgtgcctttcctcgacatagcgcagctgatcaatgttgcagtgaaggaccaggcttctaagtacttaactatttttatgaagatgaaggaaatcgcagaggggtatcctgaaaccaccataaggaatgtggttgtccctgtgcctgtttacttcaacgacccacaacgtcaaaccaccaaggatgttagtgtcaattctgggctcaatgtgatgcgaactatccacctgtctaccatggctgccattgtttatgggcttgacaagaaggccattagttatgttgagaagaactttttcatttttgatcctggtggtgggattcatggtttgacatccttttttgctctgtgtagcagaaatttagatgctggtgtaactgctggatcaaatttgaaagacggttatacagtacttgatttgggatgcggttggggatcgctggttttgtacattgccaagaattacactaactgtagggttattggaagcagctattcgacaactcaaaagacttatattgaggagaagtgccgagatcttcagctgcaaaatttgaatattatagttgctgatattggcacatttgaaatggaggcttcttacgacataatattttccatagaaatgtttgagcatatgaagaactataaagatcttctcaagaagatatccaaatggatgaaagaggatagccttttatttatcgataccgtcgcagagaatttccataggctcaccggagaactctccatccttctcgacatgttccctctccaagacctcaacctaaacgacgatgttagggaactcgttctcctcaacgagatcgtccctgaccaagcgcatctcgcttcaatcttcgagaaattggagattcgcgacgcgttgagctgcaaagtggagattgggagcctcgaggaagagattcacaaccgttgcgaagagcaaccgaaaacatatctcatcgcattaatcggcctcgtctgtttcacaaagtgcgttctctatggtgcatcaacgccgtcgcagaaaaccgtcactctacggacaaacatacgatcgtgtatcaatcaagctctggacggattctggacacaacacgtgttcaaaaacgggtcaaacgttatcacacaacgacctaatccccaatcgcgtccttcggaacatgataacaacaacgaagagaagggcatggcggagaaggggcatgacaacgacagcgagagaaatttccaaattcactcccttgaagatagaatttga

SEQ ID NO: 33388 - DNA, 363 bp, Glycine max
  Peptide Sequence Number=SeqID_125073
atgtatagtaagactgaaagtgacaaacaatttccatcacttcagcaacatgcttttgtcaagtggtggaatcaatttgacacatccaaagctgaaccagaccaggttaaactttggttcaaatcccattcggagttattgaaagcagctgatctagagacttcgttgtttctcaaccggaagtcccaattagctgccttcttggctggctccagttccaaagaacacctgaccaaaaacttgaaagaagttttgcaattgcttcagaaagacgaagaagaggttacagttcaattttatgtctataaaaagagtcctcaattccattgtgagacaccctttcagatagcaagagtcggatag

SEQ ID NO: 33389 - DNA, 93 bp, Glycine max
  Peptide Sequence Number=SeqID_125074
atgccgatccgcactcgtctctttgcagcggcacaggtgaaatcttgccccgttggtcgctcctccaggatcagagggtggcccgggaactga

SEQ ID NO: 33390 - DNA, 453 bp, Glycine max
  Peptide Sequence Number=SeqID_125075
aatttacatggtgatgaagatgatgatgatgattatcttgtgtctaactcatacgtggaaaagtctttagacaaagatgatagtattgacgatatatctgatacagacgatgaagtcaccgacatgattcaaccagtaagaattgttcacccagcacaaggtgtacaaggaattcaaaatcaattttggaatgatgctttgcattataataatatcaactggagtaatcctgatgaggaggacatttgtggtttggagatgccatcgagttttaatgttggccaagaattatatgttggcatgaattttgatagtaaagatgctgtcaagaatgcagtcaaacaatatgttatgaaggtgcaccaaagtttcaaagtggttgaaagcaaattgaacaagcatgatcagggaagatcaatctataaaattttttttgattcaagagaggattaa

SEQ ID NO: 33391 - DNA, 594 bp, Glycine max
  Peptide Sequence Number=SeqID_125076
atggctactccacctgcctcgcctcctcctcctcctttagacacatcagcgtctccatctacgttgaagcggacacgcaaagcgacacggctacgatcattggtcactataccacttggggcagaaagacatgtggtcaacgtcgatcctgctaccggcaaggccgacggtccccacaagaagaaattaagaacatatttggggattgtcgctcgtgataaggtcgacgtgacatatgacacctggaaggaagtccctactgctcagaaggatttgatatgggaggatattcaggcggaatttgaaatccctgaagcttctgacagtaggacaaagaagaaaattcttcagattgtcgacgagcgctggaggcagtttaaatctgacttgactaggaaatgggcacttgcagcagacaaggacggtgtagacgacattgtctgtgaaaaatatgacattagcaaggagaaatgtacccagttttgtcagacccgcagagacccctcatgggaggatgtgcgaaaaaaggcacaggcctcccagaagcaaaacactgcccccacatattgtctcgtgggagttatgaatatttag

SEQ ID NO: 33392 - DNA, 288 bp, Glycine max
  Peptide Sequence Number=SeqID_125077
atggcacaagtgagaaacaagcaagtacttctaaaggactatgtcacaggttttcccaaagaatccgacatgaacattgtcgaaaataccataacattgaagctcccagaaggttccaatgaagtcttgctaaaaaatttgtactggtcctgtgatccatttatgaggaatctcatgaacaagcccgaaggccctcccaatagtcttgcccacactcctggttctgtaaaggttgcggttacgggcaatgtggctgctgtgatgcagatcgcggctgttgcagcgtga

SEQ ID NO: 33393 - DNA, 536 bp, Glycine max
  Peptide Sequence Number=SeqID_125078
atggctgtctctggacctgttttctccttctccgggactccgaccatcactacaactaagttgaactggaagaattatcccccgttgtctgcttccgtggaactttggtttctcggtcaaggacatcatgaccacttggagaaagcttccgattccgttccaaatgacaagagacctgaatgggagaagcttgactaccaactctgcgctgtattatggcacctgtttgacgcaaccatgaaggtcacagccctcaagcaaattggtcatgacattatcgctcatgtgggtaagacttgggctgccgtggaagagctgagaaagtttcttgtagctgattcattggaagaagtgaacaggaaacttgataagttctacatggtgcttattctgaggagcttacattcagattttgatcatgttcgtgatcaagtacttgctagggaccaagttccatctatggattctcttatcactagacttctccgcgtgcctcattcattgaaggatgagaatcttgctgatggtgtggagac

SEQ ID NO: 33394 - DNA, 123 bp, Glycine max
  Peptide Sequence Number=SeqID_125079
atgacatctatgttaaaggcgccaacgagatcagaggtattgttctatggcccggttcaggacttcggtttgcctattcgactgggggtgatacacggagctcattcgaagcttggtgcctga

SEQ ID NO: 33395 - DNA, 231 bp, Glycine max
  Peptide Sequence Number=SeqID_125080
atggcagattctcttccagattcttccaactcgctaagtgagctgagtgcctcacttagcggatgttactcgctaagcgcatatgcctcacttaacacaatggacaaggttgttcttttcaaaaaggctaacttctataagggaaaggaattgctaataaaggaagatgaagatcctccaccaaccatatacatcaccttcaagaacacatgttcaacatttggaggttga

SEQ ID NO: 33396 - DNA, 369 bp, Glycine max
  Peptide Sequence Number=SeqID_125081
atggtttgtcggcaagtggtggtggttggtgtggctgttaaaggtggaggcaagatggatgaagatcaatggatgtataacaacataatgtctgaagaagttgatatgaatgaagaaaatgaagaggaacctgttagacatccatatgttggtcgactgactaaggatgagaagattattgttggtgatatgacaaaattgaaggatgaagatgttgcatgcgatatattttggagtgatcctgatgcagtcaaattatccaatgcctgtaatttggtatttctcatagatagtacctacaaagcaaacaggagaattataagcaattgggcttggatccggaattgggctgaactggcttggacttga

SEQ ID NO: 33397 - DNA, 1236 bp, Glycine max
  Peptide Sequence Number=SeqID_125082
atggaagttcatatgtcagatcttgatggattcaaactaaaacaaatcatcgatgaagaatttgcaataccagtcataatgatttcagttgacaaaagtgaagaaacccaagaaaaagctttaatgtctggtgtaatgcgctatatctttaaaccaataaaagcagaagatttcataggtatttggcaatttgcagtagttgtaatgaaaggtaagatgccaactatgacaaaagtagttggagatatcattgaagatcacaaagaattgtgttgtgcatcattttcaaaagaagataatagggatgagaaaaacaatgatggcaaggaacatttatcgatgaatactgtgaacgaggatgaacctactacctctaagaataccaaatttgtttggacaaaagaccttcgatatcgatttgaggaagccattaatattcttggcccaaagaatgtaattccaacaaaaattgttcaagtcatgaatgttgaagggttaaaaaggagaaatgtggcaagtcatctgcaggatttccagattttccataaatataagcattatttaaggcaggttgaaagaatatttgttgcgataataaagaaagcaaatgaagacaatgatatctcttttactaagaaggcatcaatacactggtcactagtgtttaaccacattagacattatttggaaaaaacaataaagcatagtaaacgtaaaagtttgagacatttagagtccgatgaaatatatatatctcacttaaaatccaaactatccattttgttgagtaaccttgacaagtacaacaataacaaactaaatgctaatgctaatgatgcattaagttcttcaaatttagtgcaatgcaatgagccatcacaaaatctcctatgtagcccttctgaaatacttagatcaggccaagcatcaagttccaatgttgtagggttgttggaaccaagttctttagggtctattgttggtgaggtttatagcagagatcaaactttgccaacatcaatggaagacattaacaatgttgaaaatattatgggaggaaacttatttcaaccccggcaacaccaccagatttataatcaaggatatcatcaaacttttgcaactatggacaataattttgcttctcaaggaacatttgatgggttccatttcaaagaaattgatgatcctttctcaatggaagacattcttaacaacttccacatgcagttttag

SEQ ID NO: 33398 - DNA, 216 bp, Glycine max
  Peptide Sequence Number=SeqID_125083
atgaaggaccatactggaacagatagtcataaggttaagatgaagtctggtaaactgaaagaaacttacagcaatagaggtatatacggagagcgttgtgtcccgacgtccttcagcacatggttccttaaagcaattcacgtagtcatctgctcccccgaacacaaagttcaagatcatcacaagatccaaacacaaacaacacacggggagtga

SEQ ID NO: 33399 - DNA, 606 bp, Glycine max
  Peptide Sequence Number=SeqID_125084
atggagcaagattcactccacgttccagtgatggaaaaggttgcatatataggcgaagaatttgacgtttgggaggatatatctgcagattgcatgaacacatttatcctatatgatctgatgaaagctttagatccaattttagaacaagtcccacaaatgttgtacttggaatgtcatccaattccagaagttgttgagaatgaggatgatttagatgatgtacctgttgctggccatgaggaagatgttggtggtagagagaaaggtattaatgtggacgctggtgctgatgttggtgctggtgagcagaagttggaattagggatggagtttggtactctggttgaatttaaatcttccttgagggagtatagcatattcatgggcagggagttcaagtggaagaagaatgataaacatagggctagagcaaaacgcaagaaggcattttttcgaatagctgcacgtcttccatggtggcattgtcgaatggttctaccagaaaatgcacaagaactatcacttgctgacatggagaaatcaagtgaacaagaaaaagcaaagggtagaacctttacagatgagagaagaagaagcaagtga

SEQ ID NO: 33400 - DNA, 369 bp, Glycine max
  Peptide Sequence Number=SeqID_125085
atggaacacaaaggtggattatatgataggaaagaagtgtaccagttccatcaacgctctggtggtaatgaggttgccattgctaatgagggtggtctttcatgcagatcagagcttaaagaggttgacaaagtaaaactaaagcaagacagtgatatgttgtttgtgggggatggttcagatggtgctctcagggatattttttggaggcaagatgttattcaccttatccatgaccagaccttctatctgactgtggagcataaaaggaagcttaaggaggagtatggaattgagccttggacttttattcagaaggtaggggatgttgaaggtatgatgcatccttgtttgcgtagaaatgtataa

SEQ ID NO: 33401 - DNA, 567 bp, Glycine max
  Peptide Sequence Number=SeqID_125086
atgtgcaccactacaaggtttgtgtttggtgttgaatcgatcaacagtctaaaagctgaagaaaaagacagggattatgatgaaagctcaaagcctcttactagatataaagcattggcagcattcatttggaaacacatgacacctgcatgcaagatgaaatctaataacacaagaccagcagttgttatccatattctggacaggagaaggaggattggtgaacctttctctagatacacaattaacaacattttgtggccagtgatggtagacaaatttggaaatctttcaagggaattgtttttaagagtcaaaagtgatcctaatatcctagggagcactcagtgtatggacttgactcaagggggcctagattttggttttgggaagcctttgtgggttggtgttacaagaggggataaggaaactctccccaatgaagttattatcatggaaataaatgaagccattcaagcttggttgacaatggaaatgcaacatattgctaacttggaaagagacattgagtttctaagattagctttgcctaatcctagtgtttga

SEQ ID NO: 33402 - DNA, 1389 bp, Glycine max
  Peptide Sequence Number=SeqID_125087
atggctgcggagttagggcaacagacagtggagctatccactctcgtcacaggcgtcgctcatgataacttatcatggttcttcccaatctgttgtgttgtgttatatgtcagacccgacaaggacagtgtggacattgtggatgacactactcacagagacccctcgtgggaggatgtgcggaaaaaggcacaggccatccagaagaaaaacaccgccccccacgtgttgtctcgtgggggttatgaatatttagaacagaagttgatgattgagaagacaaagaaaaaactggaggaagctgctcaatccggaagcattgaggccgcagcaaaggaaattgctacaaagattgcgtcacagggttcctttgtcccccatggacgtcaggatctcctgactactgccattgggcgaccagaacaccttggctgtgtgcgtgctactgaagtcggtgtgaccggaccagctggaggagtcgattacataaaaagtgactcggcaactgatgttatccttcatccagatgcaatcctagggagttgtgttgatccctcagtgaccgatctagacacgggtgactcagacaaatgcgggttgtacatcaaagaaaatccttcccgcctggttacccttggaagagtttatgagggatccactgccgttcacaacatccctttgttgcatggccaagtgaaggttggtgttgaggaggttgaagatgtagatgctcccgttcctgtacccactgacgagattaacttagtgggacagacacttaacaccttccttgcttggtcgacgcatctcggggctgtaggacccgcaaaacctgtagataggccggatcataaggttatgtgggatgctatcgtgttcggggtgtttaatcaagacttccccttgcacataaagcatgaagatctatctaaaatagcacacggtggtcaatgtctcaatatctttgttatacagttgtggatactgcatctgattgagacaagtatgcgagcagggaattctaatgtgtatggattcctcgaaccacatgctttgaaagaacttgatgatactccacaacctaaatccaaggctggtgctaggtggattgttgttgaatattttaatgatgttagaccattggaagcaaagagattgaaggcgcttcgcatccagtgggcacaatattatctcaaaggttacatggttggaaatggtgtcacagatgaacaaattgatggcaatgctcttgttccatttgtacatgggatgagacttatcccagacgaactatttgaggaggttaaccgtgagtgcaacgggaatttttatgatccaacaagtgataattgttctagcgagctttcaaaagttgatgagcttaagtga

SEQ ID NO: 33403 - DNA, 660 bp, Glycine max
  Peptide Sequence Number=SeqID_125088
atggaaatcatcaccattcacacagacaatgagtcatccatccatactattgcccccaaggttttgggagtgaaggtagtattgttttgcaacactattgctaaggaaataggatgtctacatgagggtagtacttaccaagaaggttgggagaagaactatgaatcccatgtcactagaacactctacaaagaaaatgctgataaggctggttccaaaataaccctctcagatctccataagtttgtgttgtttcacttgatggagaaccttctgttttaccttccacacataatttacatcaacatgttgaagaacctcaagggctttggtggtcaggacgagatctactatgcaagcttcatcaacaagctcttgtgggatcaaggagtatatcatgtgttcaacaagatggacaaggaatctaagcacaccctgatagttaagggttcagtggttgctaaacaaaatttttttagcaagactaaccttaaagctatgaatgtggctttagaacaaagtttaaaggaggctccaaaagtggacgtggacaccatcaacaagaaaaaacagaaaaggcttgacaaggccctccctgatgaagacctaggagttggatcaagtggcctcagaataattaagaagggggggttgaattaa

SEQ ID NO: 33404 - DNA, 192 bp, Glycine max
  Peptide Sequence Number=SeqID_125089
atggctactccaatgagtactgcttgctacttggataaagatgaaaccggtcagtcaatagacattaagaaatatcgagatttcatgcaaatcccaagatcacatcttagtgcagttaaaagaattatgagatatctattaggcactattaatataggattatggtatcctaaaattccacttgcaatctaa

SEQ ID NO: 33405 - DNA, 156 bp, Glycine max
  Peptide Sequence Number=SeqID_125090
atggtgacctacaaggttccactgaggcttcttggtgatccaatcaatgagaacaagctacacgacatccctcatgagatatcctgtagaaacacatgggtcgatcttggtggtggtggttcaaagggtgatctaggtttgggtgatatgatgtag

SEQ ID NO: 33406 - DNA, 303 bp, Glycine max
  Peptide Sequence Number=SeqID_125091
atggggggtctttgttcaaagtctatgaaaggcgacaaggtgtttgctaaatcagatggacattctgataaccataaatctaatggtaagaaccacaagtccaccaacatgcctagtgatttgacaagtgtaggggatcatggagtggacaagaaaaaaaaagaagttgttgctgctgcagggaatggttctgatgatttctatgatggaatcccatggtttaatgattcttttccccacaagtctaggtcagtaaaatcaaggcatgttgtggcaaaggtgttgttggcaatgagaatttaa

SEQ ID NO: 33407 - DNA, 522 bp, Glycine max
  Peptide Sequence Number=SeqID_125092
atgaaagataagaggaatgagaaagaaaaattagaaaaacaaaagaaaaagaaggatggtaaggccttgtcttcaaaggccaaggggaaggaaaaggaggaaaaggattcctccaagaagattgttaagaaggaaaatcattttgcatcaaaatgtgatatcaaaagagcactccttcttaagcaatccttctaccttctcctatcaagggaatcataccttagcactaccataccttgtgagcttgaggttattcctcaagtaaaggagtttttggatgagggtttggttcgtattatgaggcatcaaattcctgtgagaggtgatatgatgaatgtgttgagtggtgcaaccttcttttgtaaaatcactcatgcatccaacatcttcatgattcacatacatagagactcattagcacaactcattgagttggtgaggaaccatgttccctcatgggaagatgcacaagaaaaggggttttcagaccttatcttactccaacatgccaaacaccactaa

SEQ ID NO: 33408 - DNA, 348 bp, Glycine max
  Peptide Sequence Number=SeqID_125093
atgatcgtcattgtcaatgcggaagcttgtggttacgtgagcatgaactactaccaatatatagatgttgtttatacaaacgagcacatcttaaaagcttactccgcacaatggtggcctcttgggaatgaagcggctattcctccttctgatgacgcatggacacttatccctgacccaaccacaattcgtgcgaaaggtcggccaaaatcaacaaggataagaaatgagatggattgggtcgaaccatctgagcaccgaacaaaatgcagtagatgtggagccgaagggcataacaggcgtcgctgtccaatgcaatctgagcgtgggagttgttcaaatccttga

SEQ ID NO: 33409 - DNA, 923 bp, Glycine max
  Peptide Sequence Number=SeqID_125094
atggagatggatacaatacaagtgtggaaagggtgttacttggtgcacccaacatttttgttggagcatccaatacttgtggtgaaatggcaaaaattcgcttcttcctctttctctcaccatttacttcttcctctttctgtcaccgttggtgttggtgtttgttcctcttccgctcatccttcgtctttctctgtgttagtggttgttgctgttggtggttgttggtccttcgtcttcttcagttcttcttcttgttcgttgaaaaatcttcttcgagagcgtgtggtcaaggaccctgctacggccgcagaggaattgaatgaagagcagccagaagcacctgttgaagaagttgttactgatgttgagggtttttcaagcggatcccatgacacatcaattctcagagattttgaaaatcacattgctttcagagtctggaatggagagatggctaagttcgggaggcctgctccagagattaaaggccttgcggcggtcaatggactaagtcctttgatcgtctattccctagatacgggcgattggagactaatatatgcttttatggaacactggcataaggaaactaacaatttccatttgcccatcggagaggtgattatcaccttggatgacttcatgtcgttattacatctgcttgctgtaggggtgttccacagcttcgagctacttcatgtcgatgatgttatcgatacgttggtggaattactcaaggtcagcactgtagaggcgagagctgagacgattcagttgcgagcgtatttgttgcatcctcttggatgcacactctttgctaacaagagtgccacacacgtgcatgttgtattcttggatgcactacgtgacttgacacagagtgagggttacacttggggcgctgctgcacttgtgcacat

SEQ ID NO: 33410 - DNA, 216 bp, Glycine max
  Peptide Sequence Number=SeqID_125095
atggaaaccatatcgaaacgctttgagcatcttgatgtttgtggtaaagtacatttgaattcaaagctgcaagaaattgcttatcatgatatgaactccatgtgtcctcctccagaaaaggattttattgaaaacattattgatgtcaaagcggatggtaattgtgattatctggcaatagttgcgttattgggtatgggtgaagaatcgtggtaa

SEQ ID NO: 33411 - DNA, 231 bp, Glycine max
  Peptide Sequence Number=SeqID_125096
atggcagcggaatggagaaggaagagggagaggaaacgccacttcaaggagaagatgagtctagaagaagctcaccaccataggaggccatggataagagcttggaggaagaaggagatgaatgaagggagaggaagagaagagcacgaaattttgtgctctaaaagagctctgaaatctgaacccactaattcaagatcaattccaagattctccactaagtgtgcttag

SEQ ID NO: 33412 - DNA, 1584 bp, Glycine max
  Peptide Sequence Number=SeqID_125097
atggcttcaaattccagcaccaacaacgctggctaccccatcaaaaccatcgtcgttttggttcaagaaaaccgttcctttgaccacatgctcggttggatgaagtccctcgatccgaaaatcaacggtatcaccggttcagagtctaacccgatttccacatccaatcccaactcgaatctggttcaattctcggaccagtcggtctatgttgacccggacccaggtcactcgatccaagacatttacgagcaaatcttcggagagccttggagcgaagcctcaacggcaaagaaattgccaccgaccatgcaaggctttgcccaaaatgccgggaggcaagcagtgccaaagaatgcgacggcgacgatgatggagacggtaatgaatgggttcaaaccggatttaattccggtttataaagagttagttaaggaatatgcggtttgtgactgttggttcgcttcggttcccgcttcgacccaaccgaaccggctctatgtgcattctgccacgtcacatgggttgacaagtaatgacaccaataagcttattgggggtttgcctcaaaagacgatatttgattctttggatgaaaatgggttcagttttgggatctattatcagtctccacccgccacccttttctataggaatcttaggaaactgaaatacgtagataacttccgtccattcgatttgttcaaaaagcattgcaaagaagggaaattaccaaactacgtggtgattgagcaaagattttttgacttgttatcaataccagggaacgatgatcacccatctcatgatgtttcggagggtcaaaagtttgtgaaagaagtgtatgaggcactaagaggtagcccacaatggaatgaaacattgtttgtgattgtatacgatgagcatggagggttttatgatcacgtgccaacccctgtggaaggagtgcctagtccagatgatattgtgggccctgaaccattcaagtttcagtttgatagacttggtgtgaggattccagccatcattgtttctccatggattgagccaggcacagtgttacacggaccttcgggaccatccccaacatcacaatacgagcattcttctataccagcaactgtgaagaaaatattcaatttacctgaatttctaacaaaaagagatgcatgggctggaacatttgaaggtcttttaactagaagcagcccaagaactgattgtccagttaaagagagagtgaaattgcctgaacctgtaaaactacgagaagctcctgctcaagaaaaggccaagttgagtgaatttcaagaagaattggtacaaatggcagcaactctgaatggggatcatagaaagagtatataccccgacaagttaactgagaacatgagtgttccggacgcagttaaatatgttgaagatgcattcaatacattcttgaatgagtgtgagaaggcaaagcaaaatggtgctgatgagtctgaaattgtcgattgtgctgatggatgtagtagtgcaccacccgattccaaaaatttcttttacaatgtgctgtcttgtataacatgtaatcgataa

SEQ ID NO: 33413 - DNA, 84 bp, Glycine max
  Peptide Sequence Number=SeqID_125098
atgggagggctttttctgctggtggtgataatgcagctgtttgctcatgatggaagtaaagattactcagttattaggaattag

SEQ ID NO: 33414 - DNA, 372 bp, Glycine max
  Peptide Sequence Number=SeqID_125099
atggttgagaagacaaagaaagaactggaggaagctgctcaatccagaagcactaaggtcgtgattgaccctccatctcccatcagacaacacgtgatgtggaagatggctcgcaccaagaaaactggccagatgacgtctgaggcagcaaaggaaattgctgagaagattgattccttcgaggagcaggcaccacagggttcctttgtccctcatggacgtcaagatgtcctgactgatgctattgggcgactagaacaccctggccgtgtgcgtgctactggagccggtgtgacaattaagcaatactttggaccggctccacggacatctcgcacttcttcctccatggctcccgaagaactagagtag

SEQ ID NO: 33415 - DNA, 633 bp, Glycine max
  Peptide Sequence Number=SeqID_125100
atggtccatgtcgatcctacgatcgggaaggtcgacggtccccacaagaagaaattaagaacatatttggggattgttgctcatgataaggaatttgatatgcctgaagcttctgatggtaggacaaagaagaaagtacttcagactgtcggtgagtggtggagacaatttaaatatgatttgacgaggaaatggacacttgcagtcgacaaggacagtgtggacggcactgtttctaaaaaatatgacattagcaaggagaaatgggtccagttttgtcagacccgcagagacccctcgtggaaggacgtgcggaaaaaggcacaggccatccagaagcaaaacaccgccccccacgtgttgtctcgtgggggttatgaatatttagaacaaaagctgatggttgagaagactaagaaaaaactggaggaagctgctcagtccggaagcactgagggcatcattgaccctccatttcccatcagacgacaagtgaagtggaagatgactcgcaccaagaaaactgggcagatgacgtctgaggcaacaaaggaaattgctgagaagattattctttggaggagcaggcgtcacagggttcatttgtcccccatggacgttaggatgtcctga

SEQ ID NO: 33416 - DNA, 816 bp, Glycine max
  Peptide Sequence Number=SeqID_125101
atggctcctgaagaacttgagcagctggctcaacaaatcagggaccagctggaggagtcgatcacagaaaaaatacaatcacagggacttgcactgcctccggagcctgtggttggtccctcagctgcttgtgtcagcacaaaggagagttatgttgatccctcagggaacgatccagagacaggtgactcagacaaatgcgggttgtacatcaaagaaaacccttctcgcttggttgccctaggaagagtttatgagggatccacaacggttggtattgaggaggttaatgatgcagaggctcccattcctgtacccactaacgaggttagtttagtggagcagacacttaacaccttccttgcttggccaacacatctcataaagcgtttatcagaacatcctctacatgttatgtgggatgctaccgtgttcgtggtgtttaatgaacgctttccattgtacataaagcacttagatctgtctaaaattgcacacgatggtcaatgttttagcatatctgttatacagttgtggattcttgcacactggaaaatggttgtcattttgcctaaggaaaatctagttgtctggtttagttccttgcataacaggctagacaactaccttaaaggaataattaacaatgctttgaaaggacttgatgatactccacaacctaaatcgaaggctgctactgctaggtggattgttgttaagtatttcaatgatgttagaccattggaagcagagagattgaaggcactttgcatccagtgggcacaatattatctcaaagttaaaaatcaaacttag

SEQ ID NO: 33417 - DNA, 1413 bp, Glycine max
  Peptide Sequence Number=SeqID_125102
atggggcctcaaggttcaaatcgtgagccgctgaactcgaagagctcgactgaccatgctatcattcatccgacgaggtctggctttctgagtacttgcttgagcaggagtgtcgagcttattgtggagtctgaaatggataaatatagcaacaaattggctccaaacgtggcccgagtaaggatgggcgaagtggctgcgtatggcaatgactgctttgcatttgtctgggttggcattgatccccttgcaacccaagtatacgtcaaggaaactcagaattcggtatctacaggtgttgttgacaagttgatcgatgctaggaagcaggtatatatcctttgggcaagccttgttgaggtcggtgtagtcaacgcacatcctctatttcttgttggatttcttgatcatcacgacattggacaaccatgtcgacttttgtcaccgttgtgccacgggtttggctttgggaaaaatggagattttgtggcatatgaaattggggtatatgtcgagcatgttaggggtgctccatgcgaagagatcagcattatgtgtcagcacgtcctcgatccgtctctgaaggtgttcatcaagtctttccccaatcttggtgcgttggcttttggcataacatttacgggcttcaacttggttggctttgacaatgactatgtcgccactttggttggggaacttcattgcgaggtgtcagtgtcaatgagaacatactacacgagtaacgttcttgataactctcctcttccaaaggtggttgctagatctactacaccatggagtatgtcagttgagctttctctgtctatcaggactttcctgacatcccaattagcgatgccaactataatcaccattgggtcgtcttgctcgggatcgactcctatgaagtcgacatcagtgaacattattgatgggattgatctccttgagctcactgtggaaatttggttcacacttttgatggcgagtaagtgcctcttccgagccgtcttggtgctacctccgccagcgaagttgcctgcaatggtgttgatgacttcacttcttacccttcatcggctgctaaggatcagaggtaccatcatacctttcaatgttcaacggtttccaagttatagaggattagaggctgctcatagtggttataggaggaaagttgaatgtgactttcttaggtgtgtgtctcggcatgggagggtggaggggatggggagcgaggtgaagatggtggtggtaggggtggcagaggtggctggtggatttgttgaggttaggggaggtatctgcaaaagggactccaacgagcaaatcaatggtgctctgagcatcatggccaagttcatgggtggtaatggaagactgttgcgatctgagcatgtaggggtctcatga

SEQ ID NO: 33418 - DNA, 708 bp, Glycine max
  Peptide Sequence Number=SeqID_125103
atggaatttctgatctctggtgttgagatgggagaaggtacctacaaaagggattccaatgagttggccaagccgaggacatcgtcgttggtgttctatgccaagtgtggtggtactcggatgttcatacgtcaagtagtcgtgactgctgaggtggctattgggaatgaagcgttcggaccgcgggtcattaggggtcctcctattcgcggtagatccctcgtgggtagggaggttaggggtataggggagtttgatttcttggtgtcgtctccctcctcactcccgaattctaagaaaggggacaaggtcgtcgttggtggcaaaaaagttaggaattatagggagggcaagttttacctagttactattcctaggtatgagtgggtttctatcgaggtggaaaagaccaattttggtgaagggcctaccgaggaaacgagaatagagaaaggcgcggagatagagattgtgtcaaaagccgttgagaagacaaaggcaatgactttgcagttgaaggccatgaaggctgaggctggtaaatctaagcaacttggcctggaattgactaagagtaggggaacggtgaaaaagttgcaagaggaccttgacaaacatgtcgcctatctatctagtaaggccaaagaaaacaatgcattgagtaatcgagttgttgacctagagcagcaagtgaaggacataggctag

SEQ ID NO: 33419 - DNA, 309 bp, Glycine max
  Peptide Sequence Number=SeqID_125104
atgatacaacatgaagaacttataagaatccttaatgattttgcaagcgtttgcccaaaggtttttttgagagaggataggacaatgaatgtgtcgcaacctactcttcagcgggagggcgacacgagactcacaggtgcgtcttccatgaaaggaaaatacgcggagtcgcaaacaacgtttattcgaggaaaacgtcagaaaaaccagaaaaaggtgtggtctacgaaaagcgtgaaaaggttcgggagttgtttttacgcatggggaagggtgtttcccttgctcctacgtattcctcaattgtga

SEQ ID NO: 33420 - DNA, 492 bp, Glycine max
  Peptide Sequence Number=SeqID_125105
atgtacaaagataattggacccaaccttggcccatgggctcagaaatctaccctgaggttcatgagaaccctagggccttctttagcatctctagcccaatcctcttggagcctcttgctcatggctctagtgactggttccttcctagggaggattgcatcatgttatcactcaagtaccttaagggatccgacagaaggcaagacgtgtccattatgcgtgctagggctagcatgctgacggctagggtcacgaatatttccggtatgagtggcatgatgcgtagtgggcgtatttttgctcttcccgaactaccggcaaagtcaaatgacaaagggaaggcaagggaggatgtggttgaaagggagaaagtaggccttatgatgaataacaaggcccctgtcaaaaagcccacagaggaagaggagagttttggcaagaaagagatatctgccaaggaagcaacaaattttctgagaatcattcagtag

SEQ ID NO: 33421 - DNA, 273 bp, Glycine max
  Peptide Sequence Number=SeqID_125106
atggaaaattattgtccagtgttaagagtggtaaaattgacaggtgtgagaattggagggtatatttctttcgataatactgatggaggcacttctcgcctccgcagtagggcacaaccttttgctacttccccgatcggggaacctgtccaggtcactatgattctcccccccccccccccaacttctgtttctgagggagtaaggagaagtggtggtggggattttagggcgtcaccctgtgtgtggctattagtcgatgaatacgactaa

SEQ ID NO: 33422 - DNA, 477 bp, Glycine max
  Peptide Sequence Number=SeqID_125107
atggcaattgtcgcaacgtgctcttttgcgggcgagcgaaggcgaggctcacgggtgccctttccaaaggaggaaagatgcgcggagtcaccaccaacgtttatttgtgggaaacgtcgggaaaaccgaaggaaaccggtcaaaatgaaaattctaagttcgggagttgtatttacgcttgaggaaggtattagcacctctcacgtcgacaaaagcggggctcttgctcctacgtaccctccatcgaagaggaaatcagacctacgtagttctttcttatgcgtgaatcaaaacggtcgagaatcttcgcgtaattactcacggaaacgttacggaagcgcctcggcttggattttcttcacggaaataattttcctcagcaatttcgagagaataagaagtgccaagaaggcgagccaggttgcttcctccagaagcaacagccttctggaggaagaatctggaaggcccaagtgg

SEQ ID NO: 33423 - DNA, 495 bp, Glycine max
  Peptide Sequence Number=SeqID_125108
atgcaccacctctccaagcaccccaacgtcattcgcatccacgacacctacgaggacaccgcctccgtggaggcttgccactggcttggggtcatgcatagggtcctcaagcctgagaactttctctttgatactgttgaggagggtgctaaggtcaaaactactgattttgggctctccgtgttttatacgccaagtttggttgctctctcgttagatttggtttttgtggaggatgccgagggagagggcttggttgtagattttggtggaggtggggattccgatgatgtctttgagttttccttggcggaggagctcgctgatgtagtcgacggcgtgcttggcaatggagtcggtgccgaggccaaagaccatgccggacttgacatactcgacgaccttgtaggcggcaattttcttgaggtcgtcttgggtgaggatgacgaaggagggggggaggggtgttggatcaagtggcctcggaataattaa

SEQ ID NO: 33424 - DNA, 450 bp, Glycine max
  Peptide Sequence Number=SeqID_125109
atggctaatggattcattcatctaaagaaacattacatgctaaagatgttggtgatgatgtgtggaatgagttatattggagatcattttttcaagatattgtcacagatgaatttggaaaagttacaagtttcaagatgcatgatcatgcacaacttgtttcaaaagaggtttgttgcattgcaaattgggtgccttgacggatccgccgtgagcgacaaggtgaatcttgagcttgacagtgaggggaggggcactgtggcggacgtagtgatggaggccactgcggacggcgacatgggcgaccttctcggtgctgatgttggctgcacggagggcggagagctggccaggatcaagatcggtgttgatgttgtgcatccactcatgatggccgtgcgctttgtactcgcccttgccctctgcgaagagttgcgagtgacaacgtga

SEQ ID NO: 33425 - DNA, 405 bp, Glycine max
  Peptide Sequence Number=SeqID_125110
atgactactccacttgtctcgcctcctcctcctcctccttcagacgcatcaatgtctccgtctaccgtgaagcggacacgcaaaacgacacagctacgatcgttggccactagattacctggtgcagagagaccagtggtcaacgttgatccagctatcggcaaggtcgacggtccccacaagaagaaattaagaacatatttggggattgtcgcccgtgataaggcagaatttcaaatccttgaagcttttgacagtaggacaaagaagagaattcttcagattgtcggcgagaggtggaggcagtttaaatcagacttgaccaagaaatgggcccttgtagccgaccaggacggtgtcgatgacactgtctgtgaaaaatacggcattagcaaggagaaatga

SEQ ID NO: 33426 - DNA, 87 bp, Glycine max
  Peptide Sequence Number=SeqID_125111
atgtcctcttgccatgtcatcattctcttggttggacttcctagacgtaatcttgcagatattgaggagtcaaaattcaatgattaa

SEQ ID NO: 33427 - DNA, 270 bp, Glycine max
  Peptide Sequence Number=SeqID_125112
atggaagacatagagaggatgaggcatcataggtcaccttattcttctcaaggaagtgatgatggctatgaagaaggtagaaggcatagacatataaggaatagggatggaatggatgatgtcaagttggctagcttagaatttgaaggacatgcattagtgtggtggaatcaagtccaagtggataaagaaagatcaagaagacatagagtggacacttggatggtaatgaagagaatcacgagggagagatttgtcccacctcactat

SEQ ID NO: 33428 - DNA, 672 bp, Glycine max
  Peptide Sequence Number=SeqID_125113
atgatgttggagtacaagtgtgagatgaagtcccacatcggtgtggtgtcaggtctccttatgtgctggcttgtggtccacaggcataggtcacatcttagacctcactcccataggagagaaaatgaaagaaagtctcaagaggctaacattaacctctcatacttccatgggaaggacaatgtagaggcttacttagattgtgaaataagggtagagcaaaaacttaaaagaaagtatactttaaaatcttatggctctcattcttatccaaagaaagaccaaggtctaggcatcttaggggcaacaccttctaaccccaaaaatgataaggggaaaggtcccattacttctcaatgccccgccaagaaaaccatgattatgaggagccaagacatttatagtagccaagatgaggctactacttcaccttcttctagtgaaagtgaagaagcaaaaaaggaagaatctgtggaagcaatgccttccaagattattttgatgatgccaaagaatcaagagttaagcaagttccaaagaatcaggagtcaaaaagctttaacaatcaagtttcaagattcaagaaccaagaacaatcaagtttcaagaacaatcaagatcaagattcaagactcaagattcaagaatcaagagaagactcaatcaagataa

SEQ ID NO: 33429 - DNA, 411 bp, Glycine max
  Peptide Sequence Number=SeqID_125114
atgacaaacaaacagtacctgcaacaaaggaaagaagctggaaaacaaacaagttacaaaagagagaccacgtcaaatgaggtcagaatggccccagactgcagtggtaggtgtgcgaggaagggacgtcgccaaaggtggaagcatgctggcaaaggcaccgtcaggcaccttcacgcgtccgagaatagtgatgcgaacgatagttggacagcagcggctgtggccgaaaaattccccggaaaagaaggaaaatctgtcgggaatgatattgcgaggataaaggtccaccggaaaccggaaaagtcacaacagctgatggtggctggaaatgtcgtcggaaaaggagaaatggatcgtcggaaaaggagaaatggatcgtcgaaaagcgaaaccaggttgctggaataa

SEQ ID NO: 33430 - DNA, 294 bp, Glycine max
  Peptide Sequence Number=SeqID_125115
atgttattaaccgatcaaaactttaatacaaccttttctgatcccgcaggagggggagaccccatcttataccagcatctctttcggttcttcggtcatccagaggtgtatattcccattctgcctggatccggtaagcgtcctgtaggaggagtagttataaaccccgtagaccatccgcatgggggtggtgaagggagggccccaattggtagaaaaaccctgcaactccttggggttttcctgcacttggaagaagaagtagaaaaaggaagaaatatagtgataatttga

SEQ ID NO: 33431 - DNA, 579 bp, Glycine max
  Peptide Sequence Number=SeqID_125116
atggtttcacttgcaattgatacatggacatcaatccaaaatgtgaattacatgtgtgtgacaagtcattacattgatgaagcatttaggtcttctccaagtagattggctacttttaagaggcgtgcagaggaagttagtgtaaattcggaggcaatgctaacacttgatgtgccaacttggtggaactccacctatttgatgttagatgttgttgaaaattttgagcaaactttcaatcattttgagtatgttgaagctgcatatgtgctcactcttctaactagtgaagaaggatgtcctaaagagatggattggaaacttgctcgtgtgtttgaactttattcacgagcaagggagcaagaagaggagatcctctccctccgtgaacagattggcattgcctgtatgaaggaactgcagctgttgaatgagaaatgcaaactagagaggcaattctctgaactaagaatggcagttgatgagaagcaaaatgaagccatctcatccgcttctaatgatttggttcaaagaaaaggttatcttgaagaaaatttaaaacttgctcatgatttgaaa

SEQ ID NO: 33432 - DNA, 594 bp, Glycine max
  Peptide Sequence Number=SeqID_125117
atggccttttactccaccaagaacaagatggcacatgagactaacgtttccttttcgcatgaggcagacatggacattgcgattccttcaaaggaaatattagtgactgatggtgatcccacaatggatatatccaagaagctcagcgccactcagggggcatttggattcttacgtccagacaggatctcacatgcgatctcattgactctatggcatatgctattaccatttctacctagaaacccaattctcagtggttctgtaaagttgtatatgccccctattcctattgctcgctcagtcttttgggaatatctcattcaatcggagtccaccgttcagggccggtggttgatgttgggtgactttaatgacattattctctctttagaggtgtctgaagacatggaaactattggtggttgcttcacttggcgcaagaatattcatcaggatggtcatgtgaggaaaaaactcgatagatgtttagctaatcccacatggcagtgtcagatggaaaacattccacttttaagtagcatggaagacccacccagagtttcaggatcttgtgtcacaaacgtggtctaa

SEQ ID NO: 33433 - DNA, 767 bp, Glycine max
  Peptide Sequence Number=SeqID_125118
atgcaaatcgccattggcaatggcgcattcgctgcggattggacacgtggaaagcaaatcgctagccatgctggtgacttcgctgaacgtggcatctcgccacttccactggcgacacagccagtggttgtgaaactgctgttgccactagcgttggcgagttacgctaaaggggactcgccagtagctttggcaattagggaaaaggtatatgaagagaatgatagtataatatttgaaggcagtaaaatagtgattcagattaaacatggaattagtttcaatgctttgaagaaaaaaattggagataagatgttgaaaccatgcttgaaacaacaagatcaaatgtcagttctggaattgtacatagaaaaggatgtggctggtgatgatgatgatgattatcttgtgtctaactcatacgtggaaaagtctttagacaaagatgatagtattgacgatatatctgatacagacgatgaagtcaccgacatgattcaaccagtaagaattgttcacccagcacaaggtgtacaaggaattcaaaatcaattttggaatgatgctttgcattataataatatcaactggagtaatcctgatgaggaggacatttgtggtttggagatgccatcgagttttaatgttggccaagaattatatgttggcatgaattttgatagtaaagatgctgtcaagaatgcagtcaaacaatatgttatgaaggtgcaccaaagtttcaaagtggttgaaagcaaattgaacaa

SEQ ID NO: 33434 - DNA, 585 bp, Glycine max
  Peptide Sequence Number=SeqID_125119
atggccctaaatcaaaacggcgacaccgcgacaaacccggtcgcaggtaagggaagagaggtttcgggtgagtcaggggggatcaaagagtggtttatcgtcatcctcggaagcaacaaggagaaaaaacttggcacgaaaatggtggtttgggccgtaacgtggttttgggagaagctggaaaaaggggaaggaggggtgaggaaggtaagggagagggggaagctggggtcagtgtatggggtcgggaacgggaggagcgaggtgcatcgaggattttgtcttcctgaagcctggcaagggccgcagcctgaaccaaagacaaagaccggaaataaagcaactaaggaggaaggaggtagggagccccacaatcttattcaccggggcttcgaactcagcaaggtaagagggcgcctcgggggtcatcgtagagagaaggggcaaagcggagctctaatgcctaaaggaaagatgcccatgatggtagctagtcgttatggtacatccactgaaaccagcttagtacgacaccatcaaggggcgttggtgccgtcgaacttgggaacaagaactctcatttga

SEQ ID NO: 33435 - DNA, 978 bp, Glycine max
  Peptide Sequence Number=SeqID_125120
atggcatcgttcagccaaatgcagtcccagtttcagtcccagatgcaatctcagggacttgcactgcctccggagtatctggttagtccctcaggtcctcgagtaagcacaaaggagagttgttttgatcccttaggaaacgatcctgagatgggtgactcagataggtgcggcttgtacatcgaagtaaatcatgcccacttggttgccctgggcagagtttatgagggatcaactattgttcataacacttctttgttgtctggccaagtaaaggtgggtgtggaggaggttaaagatccagatgttccagttcctgtacccactgatgagccaattgtgtctccggcaaaaccacctcaaaagccgaatccggaggtcgatgatccgctttatctgatgacattgaccatcccagagcttttcttgaggccttaccatgttacatgggatgccaccgtgttcggggtctttaatccagacttcccgctctacataaagcacgaagacctctccaaaatcgcacacggtggtcaatgtctcagcatatcagtgttacggttgtggattatgcatatgactgaaacaagtatgcaagcggggaattctgatatctatggattcctcgagccacagtctattcagaggtttgggcaaacgcagtttcagactgaaagttacataaagagttggatgcagggttcaaaacacgatgtctaccttggagcctacttgaatggcggacacaggcagatggtggtcatcgtgcccaaggaacacctagttttctggttttgttcattacataacagtgctttaaaaggtcttgatgatgctccacaacctaaatcaaaggctcctactaggtggattgtcgtcaagtattttaacaatcctagaccattggagccagagagattaaaggcaatgtggatccaatgggaacagtattatcttcgagttagagttcatagctag

SEQ ID NO: 33436 - DNA, 732 bp, Glycine max
  Peptide Sequence Number=SeqID_125121
atggcttctccacctacctcccctcctcctcctcctcctccttctcctcctcctccttcttccgacacatcggcttcgtcgtctgccgtgaagcggacacgcaaagcctcacgtctacgatccttgtctactagaccacctggtgctgaaagactagtggtccacgttgatcctactatcggcaaggccgacagtccccacaggaagaaattaagaatatatttggggattgtggaacgtgataaggtggacatcacatacaagagctggaaggaggcggaatttgaaatcccagaggcttctgacagtaggatgaaaaggaagatgtgcagaaaaaggcacaggcaatccagaaatagaacactgccccccacattttgtctcgtggggaccaggaagaagttggaggaagatgcacagtcaggaagcgttgatgatgtcatcgaccctccatcccccgtcagacgccacatgaagtcgaagatggtccgcaccaagaaaacaggggagatgacgactgaggctgcaaaggaaatcactgagaagatcggatccttcgtcccccgtggacatcaggatgttctcaccattgctattggacgtccagagcaccctggacgtgtccgtgctactggatctggtgtcaccatcaagaaatactttggatcggttccatggacgtcccacagctcttccttgttgcctcctgaagaattgcagcagctgacctag

SEQ ID NO: 33437 - DNA, 534 bp, Glycine max
  Peptide Sequence Number=SeqID_125122
atgaagaataagaaggttgttgtggctggtgccttgcttagcgaggcatatgtgcttagcgagcaacatctgctaagcaagacatcagcccgcttagcgagtgaggagaatctggaagagaatctaccatgcaagcacgcgctcaacatgccattagcttgcccaacgacttatttgtctcttctggcacccagcgcgcctgactcgctcagccaaaaatcactaacttgcagcggaacaacagtctttaatggtgatgtcattcaaggcgcggtagtcgatgcaaaatcgccaggtgtatggtatggtctgttggtcgagatggtggaagaagcgctggtgtttggaaaagatgagtgtacgtgtcgagaagacgacgtactgaagggggaggaatgggggtgccagaagcaactggtccatgatcctggagttggatgtggaacagggccgctactcactgggtggtcatcaggcgtctcatttggccgtggtgaatctcagctagaccggtgtcaacaccgccttggatag

SEQ ID NO: 33438 - DNA, 201 bp, Glycine max
  Peptide Sequence Number=SeqID_125123
atggaagaatcaaaagaattctcagactgtgtcgctttgaattctttgaaaagggagaagggagacacaaaagaatttaggagactcttcatgtcaggtcaagaaaaccattggaagagttatgacctcgagaaaaacctgaaaaccattggaagagttacatcttttgatttttattcaaaacttgtcactggtaattga

SEQ ID NO: 33439 - DNA, 741 bp, Glycine max
  Peptide Sequence Number=SeqID_125124
aatggatgccatgataactttaatattgcaccatggaggaagatcactccatgtgccagtgatggaaaggttgaatatataggcggagaatttgacgtttgggaggatatatctacagattacatgaacacatttatcctatgtgatctggtgcaagcatgtaagaagtatagcaggataggagattgtttttggttgattgataaggacttagattttaatcatgggttgaggagttgtacaacagatggagatatattatacttagtgaaggatgctttggaaaatgagaatgagataaatgtttattttcatcatgaagtagatccaattccagaagaagtctcactaatgttggacttgaaatgtcatccaattctagaagctagtaatgaggatgatttagatgatatacctattgctggccatgaggaagatgttggtggtggagagaatggtattaatgtggacgttggtggtggtgaagagagagatgttggtggtggtgaagagaaagatgttggtggtgatgaggaggaaaaggttgataatcctgatgatgaagatgacaatgatgaggatgagtggtttacaaacttctcttatatgaggaaggaagttgaagttgaatatgaaatagatggttatcatttagaggagctcaaaaaccccattagtagtgatgatgaagatgaggatgttcgcaaagtttatcctctatataatgaccaagggttatga

SEQ ID NO: 33440 - DNA, 715 bp, Glycine max
  Peptide Sequence Number=SeqID_125125
atggaagcggtggcggaggggctatggggacttgcagagtaccatgggaagagaggggaaatagggaaagcagtgaagtgcctcgaagccatatgccaaagcgacgtgtcatttttccccgaggtgtacagcttgctcagcgagtgttaccatctcgtcggagctattctgccgcagaatcaggtcttgcacaagggacttgagctcactgcatccgtcggagaaagatcgatcgtggcacgtttggcgctgtatgtgttgaagaaaatcaggcttgcgcgacagactaaacaatgcagaagatctgctcatcaagaggcttgggttgagaaggctagagaaagcacactgtttcaattgttatattgcaggttgctatgtttgcattgttactggatacgtgaagatggagacatggctgcattgatgaaaaaatcaatcggggtttactttcctgaggagtgttccaacatctttctaaccaaggatgaagatgttcgcctaggggattttgggcttgctaagacactaaaagcggatgatttggcttcttctatgctgtggaagatcgaagcaccgacgaagataagacacatcctcttcaagttgggtgatgcggggctgaatcatctcgctgaggaggaggagaaggagtacgctcgtcttgtggagggagtgcgtccttcttcagttattgaccatcacgatccttacg

SEQ ID NO: 33441 - DNA, 306 bp, Glycine max
  Peptide Sequence Number=SeqID_125126
atggagaaatctgaaaagaaaaattttaatgaaaagaagatgaagaaggcctacatcacatgggacgacaatgatatggaatcatctgaggattcagaaaatgaagagataaacttgtgtctaatggctaaaagttatgaaagtgatgaagaggtatctttgaagaagaaatggtacatagatagcggatgttcaaaacatatgacgggagatgcatcaaagttcacacatatctctcccaagaaaagtgggcatgtaattatggtgacaacaacaaaggtagaatccttggagttggtaaaatag

SEQ ID NO: 33442 - DNA, 390 bp, Glycine max
  Peptide Sequence Number=SeqID_125127
ggtttcattctaagcgttttgatatatatatattgcctactattgaaaacgggccccgacgggtgcagagaaacgcgaagaactggaaccagagaagaggcacgcaaaccgaggcaggattttagcattcataagattttcagaaagcttttcccttcccacattgcttttctcttcttcttcttcctctccattgaagcctccattaaagctccaaactttgctcatcatttctactccaaattgcaaagggaagccattttcggagtcgtgaagcgcacctctatgttgtgggactttgaatttcaggtagaaaagtgtgagattttgagggttagagaagctaaatttggggaaagcttgggcagagcaaatgagaaaaatgagtga

SEQ ID NO: 33443 - DNA, 1527 bp, Glycine max
  Peptide Sequence Number=SeqID_125128
atggctacggaagttgactgtacgagcattggatcagccacgaccaactgtacagagaaaatttccattctacataccagttggaaagatgtaccagacacgctaaaggagctggtatgggatgacattttggcgaagtttgatatcccagaagcactgaatgcaaagaagaagataaagaaacttgggagcaatttggcgcaagccgcaaaacccctcactggcaggaagaagatgcaagagatccaaaaatacaatgactgcccccatgtactttttagtggggggtatgatttgcttgaaaagaagatgatggatgaaaaaatgaagaaaagacaacatgacacaatgatgactaagaatacaccagactttagggatcctccatctcccattcaaagatatgagaagtgggcctcattggaagaacaaacaagacagggtagctttgtcccccatggtcgtgaagacatacttaacactgccatcaggcaactggatcatggaggccgtgttcgtgcagcggggtctggggtcacaataactcaatactttggcaaggcagcacatggctccagttgctcatcagcctccatcagccaagtacagttggctgaaataataggaagcctacaggaacagtggaaaaatgatatacaagtattgaaacatgagttgaaggaacaaataatacttgagatgttgcaaaggggatcgccgatctcagcacctattcagccagatatacatgtgttaggagcaagagtgagcacaaaagggagcaatgcggagactgctgtcaacccatctccacctaatcatgttgctcctgtcaaacccactatggggttgtatgtccatcgccaagattctactgagttggtggccttgggaaaaacatatgacggaggctcgacgatacacactgtggcttatgcacatgatgtcataagggttagtgttgagaaagttattaacagtgacgctgaagtcccattctcgacatcagagattaagtatgtcaggcaagcccttgacacattcattgcatggccaacaccacttgtaaaactggcctcaaatgagcttaaaggcaccactctaactacagtcactgaagctgttgaaccggtcaatgatgttgctatagatgaccccttgcgcgagttgattaagaccttagttgacatttatgagaagcctgtagagttggtgtgggatgctatactgaatgcaaaggatacacgtggacaatctcaagaatacattgaaaaatggcttaaggaatcgaaccgagatgtctatctaggcgcttatttgaatcaaaagctagatgttcatattaaagttgcaattgacaatgcatttaagacattgaaaatgagttctgatgggaaatttgatcacagtacaccgcagtggattgaagtgaaggtggttatcagagccacaccttgcccgcaagtgatccttatgcagcttggaggttcaccgaaggaacaattggtgtcaatggaagctggttga

SEQ ID NO: 33444 - DNA, 381 bp, Glycine max
  Peptide Sequence Number=SeqID_125129
aggtgcccatggctaagacaggtcaatgtggtggaccatacgtacgcctgcagtggctgcgagacgtataccattgcagatgtcagacgtagaactggacagctgccgctcgcgcttatgttctgcatcttttgggttgcactctttttgctaataagagtgcaacccatgttcatgtcgcacacttacaggccctgcatgacctcactcttgctggggcagtatgcatggggagctgctggcctcgtccatatatacgatcagcttaatgattgttggatatacgaacacttttcgtcagttgcggagtgcaatgctgatccggactacgacgagtgtcaccatgtgcgtgtcggtggattgcgacaaagaagactctga

SEQ ID NO: 33445 - DNA, 405 bp, Glycine max
  Peptide Sequence Number=SeqID_125130
gatctgaagtatctgccttatgggtcgaatgcctctgctgtgggtatcacccactctagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctgcgaatctgttggtgaagaacaaattaatgagacttgtgcaaagagttacagcaattacagttaggcaaataatcgaattagtagctaccttgagcttggacgaattaatccgaaggaagtga

SEQ ID NO: 33446 - DNA, 234 bp, Glycine max
  Peptide Sequence Number=SeqID_125131
atgacgagtcggatgacatgtggagataccttatggttatccgcactgatggaagcttgcttgtggggcttctatggaggctggatctttgatcttcaatggggtcctttaatggtgattttccaccatggagatgcagcggaagacaaaggaaaggaggtagcttccttgagaagctttcttgagaaaacttccttgagaagcttctttgagaaaacttccttgagaagctag

SEQ ID NO: 33447 - DNA, 846 bp, Glycine max
  Peptide Sequence Number=SeqID_125132
atggaaaaacaactcagcgcgttcgccttcacgccgtgcggcagccaggacatggccaagaccggctgggtctccccgatgggctcgcacagcgatgcgctgacgcacgcggtcaacggccaaatcgtcatctgcgcgcgcaaggaagagaaaatcctgccgtcgccggtcatcaagcaagagctgcaggccaaaattgagcgcctggaggcggaacaacatcgcaaactgaagaaaaccgagaaagacgcgctgaaggacgaagtgctgcacagcctgctgccgcgcgccttcagccgcttcaaccaaaccttcatgtggatcgataccgtcaacgatctgatcatggtcgatgccgccagcgccaaacgcgccgaagatacgctggcgctgctgcgcaaaagcctcggctcgctgccggtggtgccgctgaccatggaaagcccgatcgaactgacgctgaccgaatgggtgcgttccggcgagatgccggctggtttcgccattcaggatgaagcggaactgaaagcgattctggaagaaggcggcgtgatccgctgcaagaaacagaatctgatcagcgacgaaatcgcggtgcatatcgaagccggcaagctggtgaccaagctggcggtggattggcaggagcgcattcagctgatgctgtcggacgacggctcgctcaagcgcctgaagttcgccgacacgctgcgcgagcagaacgacgatatcgatcgcgacgacttcgcccagcgctttgacgccgactttatcctgatgaccagcgagctggcggcgttgatcaaaaacaccatcgaagcgctcggcggcgaagcccagcgttaa

SEQ ID NO: 33448 - DNA, 547 bp, Glycine max
  Peptide Sequence Number=SeqID_125133
atggcattaagatttccaaggtttagtcaaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggagggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaa

SEQ ID NO: 33449 - DNA, 66 bp, Glycine max
  Peptide Sequence Number=SeqID_125134
atggttcctcatccaactccaatgagtggtgctacaagtgtagaaaataatgggataaaccttcct

SEQ ID NO: 33450 - DNA, 150 bp, Glycine max
  Peptide Sequence Number=SeqID_125135
atggaacaagtgtccaagtggaatttgcttcaagagcttggatttcctcatgcattgctcgacgccattcaggataaagaacaacttgatgatagaactaagcctgagattgtgatattacataatcagacaagtataagggatgcttag

SEQ ID NO: 33451 - DNA, 527 bp, Glycine max
  Peptide Sequence Number=SeqID_125136
cctaagtgaagaacttcgtgactattatgaaggaaggcataggtcacatcttagacctcactcccataggagagaaaatgaaagaaagcctcaagaggttaacattaaactcccatacttccatgggaaggacaatgtagaggccaatttagattgggaaataagggtagagcaacaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctaatctatccccaagaaggaagggacaacctttaatggttaaggaggagtgtaagggag

SEQ ID NO: 33452 - DNA, 594 bp, Glycine max
  Peptide Sequence Number=SeqID_125137
atggacaagaaaatccgcagtattgtgagtagcattttgaaagacgcctctgttcctgatgctgagaaagatgttccaacatcctccaccccagatgttgctgtccctgaagctgatgaagatgtcccaacatcttccaccccgaatgtttctgtgcctgatgttgagaaagatgttccaacatcttccggcccaaatgctgaagtactctcttcccccagcaaagagagatcaacagaggaagatgatcaagccacagaggagacccctgcaccacgggcaccagaacctgctccaggtgacctcattgacctagaagaggtagaatctgatgaggaacccattgccaacaaattggcacctggcattgcggaaagactacaaagcagaaaagggaaaacccccattaagaggtctggacgaatcaagactatggcccagaagaagagcactccaatcactcctacctcatccagaaggagcaaagttgcaatcccctccaagaagaggaaagaaatttcctcatctgattctgatgatgatgtcgaactagatgtctcgacatcaaagaaggccaagaaatctgggagaaag

SEQ ID NO: 33453 - DNA, 168 bp, Glycine max
  Peptide Sequence Number=SeqID_125138
atgtggaccactacgggggaggtggttgccgcccagctcgcccaggcgagctcagctcgcccaggcgagcagggttgcttcctccagaagcaaccgccttctggaggaatcttctgggagggcccaaatggggcctggggtgctatttgcaccccccatttttactaa

SEQ ID NO: 33454 - DNA, 561 bp, Glycine max
  Peptide Sequence Number=SeqID_125139
atggaaaaacggctttgccgcggccctctcacttccctgttaagtatcttcctggcatcttccaggaaatctccgccccgttcctggcacgacaggtttcccgactggaaagcgggcagtgagcgcaacgcaattaatggaacaaaagctggtaccgggccccccctcgaggtcgacggtatcgataagcttgagtttagggaaaatcaagtcgcagcatttccccggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33455 - DNA, 944 bp, Glycine max
  Peptide Sequence Number=SeqID_125140
atggggacaaatccaaccggcaagaggttttaccaagtcaaggttaaaggcctagataccaccagaatcaaggaattaggacggttgatggaacctctccaaatgcaagccttccgcaagacttacggaaagatcttagatttgaccatagcagagatatccatagaggccattgtgtcactcacccaatactacgaccagcctttgagatgcttcacgttcggagacttccaattggtaccgaccattgaagaatttgaggagattctaggatgtcctctcgggggaagaaaaccatatcttttctccgggtgtctcccctctttgagcagaattgcaactgtggtcaaagattcagcaagaggtttggaccgtgtaaaacaaactcgaaacggcatagcgggcctaccacggaagtacctagaagacaaggcgagggatatggcaaatcaagaagagtgggtcccgtttatggatgtgttagcattgctaatctttggggtcgtcctctttcctaacgtagatggtttggtggacctagccgccatcgacgctttccttgcataccaccatagcaaggaaagcccggtggtagctgtcttggcagatttatttgacacatttgaccgaaggtgcgagaagagtagcgcacggatcatctgttgcttgcccgctctctgtgtttggttggtttcacacctgttcccgctagacacgagacacccgtgtccgcttcaaagttatcgctcatgcaccgaaaaaggaagagtcgattgggatcaacatttggctgggatagggggcagcgcgatcaattggtttcctcgttggaaagaaggcaaggaaggagttcttttctcgtgtggggactaccctaatattccattgatagggactagggggtgtattaattataatcccgcactcgccataagacaactagg

SEQ ID NO: 33456 - DNA, 159 bp, Glycine max
  Peptide Sequence Number=SeqID_125141
atggaagaaaagaaaattgaaaatgaacgagatgagaacacttaccggttgaagaacgaggaacggacgaagaatggtgaagaacggaggaaaatcttcacagatttgctctcggaagcgttacggaagcacttcgactcgatttttcttcacgaaaac

SEQ ID NO: 33457 - DNA, 537 bp, Glycine max
  Peptide Sequence Number=SeqID_125142
atggctgaaccttcgaagaagcaaaagggcactttgagtcggagtcaacggcatttcgggtcacaggaaacgccaattccttcctccattccctttggatcattgttttcatcagaggaacaacgtatacggtacacaaacctcttttcttctcgttccattatagacccaaaattcatagatatggatttcttctcaaatgacagttttgaatgctttcaagcatttgaaaactccaatcttattccattcatgtctctgaaattacttgtttattctgaactagtcaaagctttttattctaatttagaaatccatgaaggtaccctaatgtctgaagtttatgggattaagatggtcattgaccagtccctattctatgatttaacccaattgccaagcgaaggtgtaccatttgaaggtgcactgattgacgattggaagtttgatttctctgtacatggatgcccgccggttggtttgtaccaaccaagcggatatgaccggaaggcttcttgcgggttcattggcttttga

SEQ ID NO: 33458 - DNA, 561 bp, Glycine max
  Peptide Sequence Number=SeqID_125143
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatctggcctcaagcaaatgaatcatccaacctcaaatatggtaggcaaagatttaggaagtacgggcggcccccatgatgtgcaaattcaaaatgagcacgccttcccgtcatatggcttgcctctcaactatacgccacccaatgtggcgtacactcccaataagaatacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaacccttatgactatggcagggatgggaaagttggatcatctagaggaaaggctcagggccattga

SEQ ID NO: 33459 - DNA, 363 bp, Glycine max
  Peptide Sequence Number=SeqID_125144
atggtccattgccatatccacaccttgtcactctctttcttcgccattttcaaattcttcttcattctgaaccttatgttccaatcaagagatccttttttaattggtgctgctgtgattgcctcctttggttaccgcaaagagcatgatggctcttgggtcaaaatgggtgctcaacccgctgatgatgaaggcaacctaccagttgaagataattcctctattcttcgaaggcttttggacaagttcgatgtcgacatgcggttcgatgccatggattcaaggatcaccaaggttgaagaagatgtctccttcatccatacttgctttgatccaccaccaccgcctccatcatcatcttag

SEQ ID NO: 33460 - DNA, 233 bp, Glycine max
  Peptide Sequence Number=SeqID_125145
atgagaattgcactagccaacacttgcgtggctacagacttccttgatggaggatggatgaacgacaatccaattcatggggctccgaataaaagtggagaatggagaattgcacttggcaatcacttcgcgtggctccagactcattggtggaggatgcatgaacgacaatcaattcatggtgctccgaatgaaagtggagaatggagaattgcactaggcaatcacttcgc

SEQ ID NO: 33461 - DNA, 178 bp, Glycine max
  Peptide Sequence Number=SeqID_125146
tgaaagtgaaagaggagtgaaaaagaggaagattgggctttacgggacgtggtttggtgaagaattgagtgagaatcgaaggtttggctgcgcagcagctctgatttcgcccaataagccttctggtaatcgattacaggatgttgtaatcgattacaggctgcctgttcatgtgtaa

SEQ ID NO: 33462 - DNA, 234 bp, Glycine max
  Peptide Sequence Number=SeqID_125147
atggccatcaaaggtctatttatatgtgacttggaacacaaatttgctgagagtttttcagaacaaaaaggattaagagatcgagggtctcttgttgtaaagcaatatgaacacaaaggaagggttgtccttgtgtggttcagaacttgtaaagggcttttgcaagatagtggaactctaaagcaggttgcttggggactagacataggcacaagggtgaggccgaaccagtaa

SEQ ID NO: 33463 - DNA, 234 bp, Glycine max
  Peptide Sequence Number=SeqID_125148
atgtttgcacattcgattaaaggctgtcgtcccttgggacgggcgtgttggggtgctaatacctttccccatcccgtctttttccggtttttctgccgttttcctcaaataaacgttggtggcgactccgcgcgtattcctttcgtggaacccgcatcccgcgagtcacgcgtcgccctcccgccgaagggtaggttgcgacagttggcgactccactggggactgttttttag

SEQ ID NO: 33464 - DNA, 812 bp, Glycine max
  Peptide Sequence Number=SeqID_125149
atgaccggccctctcaatgagtcaatctcatgctttctcataagggtggacccttgggtactagaacctattgcctttagaggactacacgtcctagcctttagagggctacacgccctcaccatcagaggactacacgtcctcgccttcagagggctacgtgtcctcgccatcggaggactacacatcctcgccatcagagggctgcatgccctcaccttcagaggactacacgtcctcgccttcagagggctgcatgccctcaccttcagaggattacacgtcctcacctttcaggactacacgtcctccccatcagaggactcacaggtccactcacctttagaggactacaagtctcaccttcagagggactacacgccctcggccttcagagggttgcacgccctcaccttcagagggtgcacgccctcacctttagagactacacgtcctcgtcttcgaagggctactcgccctcgccttcagaggactacacgtcctcacctttcagaggactacatgtcttctccatcagagggctgcacgccttcaccttcaaaggactacatgtccctcgccttcagaggactacacgtcctcaccttcagaggactcacacgtcctcaccttcagagggctgcacgccctcaccttcagaggactgcagtcctcgtcttcgaagggctgctcgccctcaccattcataggactacacatcctcatcagagggctgcacgccctcactttcagaggactacacgtcctcgccttttacaggattgcacgtcctcaccttcagaggactgcac

SEQ ID NO: 33465 - DNA, 222 bp, Glycine max
  Peptide Sequence Number=SeqID_125150
atggcggaaatgggaaagttggatcatctagaggaaaggctcagggccattgaaggaggtaaagattatgcctttggtaacctagaagagttgctcctagtacccaatatcatcacccctcccaagttcaaggtgccggactttgacaagtacaaggggactacttgccccaagaaccatctaaagacgtgttgtcatatgcaaaagatgaggaactgttga

SEQ ID NO: 33466 - DNA, 714 bp, Glycine max
  Peptide Sequence Number=SeqID_125151
atgcgtcatctctataaatactcacgaaatcagagctgctgcgcagccaaagcatcctccacattttcctccatacctagaacttcaagccttcgattctcactcaattcttcaccaaatcacgtcttcctctttttcactcctctttcacttccaccgatcaaaatccagaaaaacttcatcaaatggcagagccatcaaagaagagaaagggatcatcctccaccgctaccgctgctgcccatcgccgtcacggcccatccggagcacccacaacacctattcctccttctttgtcatctccaagatcatcaacactgttttcatccgatgatcaacgtctacgtgtttcaaaattctggtcttgttgatttcatgtcattaaaattgccatattatcctgaacttgtaaaggtcttctactacaatttaaaaattcaggatggtattattatgtctgaggtgcatggtacttctatggtcattgatcagtcacttttcttttctttgactcatttacctagtcaaggtgcaccttttgagggcaccattgttgatgactggaaattcgattatttgagtcatgatgctcgtcgcatggtctgcaatgatcaagctgaaatgaccggtagattgttggccgggtcattaacttttgataatcgcatcatgcattatatcattgttagaattttgcttcctcggtctttgtaa

SEQ ID NO: 33467 - DNA, 126 bp, Glycine max
  Peptide Sequence Number=SeqID_125152
atgaaaatacaaaaaaaaggtgttgagggaagaagcccagagtttcaagaacctctggatttaaggtcaaatcctattcaagggggaggagatgatgcaatcctaccccccaagggcattggatag

SEQ ID NO: 33468 - DNA, 279 bp, Glycine max
  Peptide Sequence Number=SeqID_125153
atggacgctcatccgtgtcaggatggcatacaccagctgactcttcggcagagggaggtcggaattatgatcgttgggcaggatgttgctgagcagcaacgtcattcatgtctgggtcaaggtagtcttgttggtgcacatgatccgcacccgtctcccggcagcggtccggctgagcaatggcctcctcgtcaaatccatcggctcagttccttctctgaccgtattcacactcctggccctcctccaatactagcgggtatcccaggaactgactga

SEQ ID NO: 33469 - DNA, 138 bp, Glycine max
  Peptide Sequence Number=SeqID_125154
atgggtttgtcaggcttaaaggagcactcaaacccggtgacccccaaggcctacactccgaagagtccgtcagggcctctccctcctgattcaggtccaacccctaaaatcattttagcacacagacactgttcgtga

SEQ ID NO: 33470 - DNA, 621 bp, Glycine max
  Peptide Sequence Number=SeqID_125155
atggcttctccacctgcctcgcctcttcctcttccttctcctccttcagacgcatcaacttcgtcgtttgcagtgaagcggacatgcaaagcctcacatcaacgatccttgtctactagaccacctggtgctgagagaccagtggtccacgttgatcctgctatcggcaagactgatggtccccacaggaagaaattaagaacatatttggggattatggcgcgtgataagatggacgtcacatatgagaactggaaggaggtccctactactcaaaaagacttgatttgggaggatcaggcagaatttgatatcccagaggcttctgacagtaggacgaaaaggaagttactgcagaccctggggagagatggaggcagtttaaatcagacctcacaaggaaatgggcccttgcagccgatcaggacggtgtcgaggacactgtctgatgtgcgcaagaaggaacatgccatccagaagcagaatactgccccccacgttttgtctcgtgggggttatgattatttggagcagaagctcctggctgagaagatgaagaagaagcttgaggaagctgcacaatcaggaagcgttgatggcatcatcgaccctccatccccg

SEQ ID NO: 33471 - DNA, 296 bp, Glycine max
  Peptide Sequence Number=SeqID_125156
ggctttttccggaggagccctggtgcttaccaacatggatggcgaagagctaccttcacccggatttcctgtctgttgtatctctcgttacaatctttcaaagaaatgaatgtggattcgaggcttttagtcctcacgatcaccttgggctaccttctggagtggagacaaaacatgaacggcataaaccaatcaaggtacttaaggatgaacgcaagcggggatggggtcacgaccgaccgatcgttgcccttctctgtgcgaaacaagcagggaatgtcgctgcaggcagcccc

SEQ ID NO: 33472 - DNA, 150 bp, Glycine max
  Peptide Sequence Number=SeqID_125157
atgttgtcatctggttttgacgatactccacaaagtaaatccaaggctactgctaggtggattgttgttaaaacaaaaaggaagtactgcgtgcgggtattacgtcgtgctttggatgtcaactataatcttaggaagtttcaagaataa

SEQ ID NO: 33473 - DNA, 210 bp, Glycine max
  Peptide Sequence Number=SeqID_125158
tcgagagggaaacagcccagatcgtacgctaaggtccctaagcaatcacttagtggaaaaggaagtgatcgagcgatgacaaccaggagggctcaagtgattcaccgaagcgacgagaccttgaaagttgctttttcaagtgtcagtagcgggacgttctgtcaatcggggaaggtttttggtgacaacacctggagatatcagaagtga

SEQ ID NO: 33474 - DNA, 294 bp, Glycine max
  Peptide Sequence Number=SeqID_125159
atgtttgcacattcgattaaaaggctgccgtcccttgtggcggacgtgtggggtgctaataccttccccgtgcgtaaatacaactcccgaacctttcacttaaaaattcgtagatcgcgtcttttccggtttttccgatgttttcctcaaataaacgttggtggcgactccgcgcgtattcctttcgtggaacacgcatcccgcgagtcacgcgtcgccctcccgttgaaggggaggttcatagaaccaccaagcagtccccttttgaggttgtctatgggttcaatcccctaa

SEQ ID NO: 33475 - DNA, 201 bp, Glycine max
  Peptide Sequence Number=SeqID_125160
atggataagtggcaaaggcgatctccacaaacacgatctccacaatgtggttgcagtcacggaagcgcaggccagtttgacacaaagacgatctcaggcagaaggagaaaggagaagaacgatagggttcaagataggattcaaggacttcacaacccaaactctcaaagtataagttttgtgctgcttgatctccgatag

SEQ ID NO: 33476 - DNA, 219 bp, Glycine max
  Peptide Sequence Number=SeqID_125161
atgattggtacctcaaagccttacactggggcaatgaggggcatcgtgcatgaacctcaagtgaacgtaggggcagattcaaagttctcacccaataggttccctgctacacgattagaagttctcacccaacaggttccctactacaaggtcatgatgaaagacaacgattggcacctcaaagccttacactggggcaatgaggggcaccgtgcatga

SEQ ID NO: 33477 - DNA, 282 bp, Glycine max
  Peptide Sequence Number=SeqID_125162
atgggatcatcggcggctatcatagtggttgagagtccgaacacaaggactggattggctcccaatctaaagactgtgagagacgatgaggttaaagcttcgaagaaagtgatgagccttggaacgagaaaccaagaaggcccgaaaggaagaacacgaccaaagcaaagttttgaggggctttatagggcagcaatagtgagctcaagctccgaagaggtgaaaggaatcatcacgggtcaaaggcatgatcttgaaggacgagctaaaggcttgccttag

SEQ ID NO: 33478 - DNA, 231 bp, Glycine max
  Peptide Sequence Number=SeqID_125163
atggtagtgagcttcttcttgactatcttctccttgaagtggcgtctccaatcatctttcttccttctccattctgcttccattcatcttcaagaagcaaaagactccattgatgaagaagatccaaggcctacaagctccacatggagctacatcatctggttccataatttaatagggtaccctagaaatgtggattttgttagccttgattttaggcacctagactag

SEQ ID NO: 33479 - DNA, 414 bp, Glycine max
  Peptide Sequence Number=SeqID_125164
atgtgggatgctaccatattcggggtgtttaatcaaaacttcccgttgtatataaagcacgaagatctctctgaaattgcacatggtggtcaatgtctcagcatatctgttatacagttgtggattctgccagacaactaccttaagggaataattaacagtgctttgaaagtacttgatgatactccacaccgaaatccaaggctgctgctaggtggattgttgttaagacaaaaaggaatcactgaatgtggctactacgtgatgcactggatgtccacgataatcttaggatctttcaggaataattgggagacgtattttaatgaagttagaccattggaagcagagagatttaaggcacttcgcatacagtgggcacaatattatctaaaagttagaaatcaaacatag

SEQ ID NO: 33480 - DNA, 546 bp, Glycine max
  Peptide Sequence Number=SeqID_125165
atgactgatccaggttcacttctcctgaggcctaggaaagaggacaaatcaccaaagcaggtaagggtcagaggtcatttgataaaatttgatgaagacaccctcaacacattcctgaagacccctgtgatcattgaggagggggagacattaccagcttactctagatttgcactcttgaggcctaatcctcaagagttggctgctaagctttgcatcccagggaggggattcgagcttaatgctgatggtcaacctctgaagatcctcaggaagaatatgaccacactcgctcatacatggagtgttttttcttactccaacttgatccccacctcccacacttctaacatcacattggatctggccaagttgatttatggcattattatgaagatggacatgaatctaggctacctcgtctcttaccagatttctatcattgcccaacatgactcctccaggcttggatttccagccttaatcacagctttgtgtaaagctagagaggtcacatcagatttccagccatcagattctagatga

SEQ ID NO: 33481 - DNA, 105 bp, Glycine max
  Peptide Sequence Number=SeqID_125166
atggattgcgacatcttcgggagtgatgacagacggaatgaagacaatgaggctgaaaaatcagtttggagcaagggtgaagctaggaaacaacattctttagag

SEQ ID NO: 33482 - DNA, 621 bp, Glycine max
  Peptide Sequence Number=SeqID_125167
atggcagaaccatcgaagaagagaaagggatcatcctccaccgccgctgctgctgcccatcgccgccacggaccatccgaagcacccacagcacctattcatccctctttatcatctccaagatcatccacattgttttcatccgatgatcaacgtctacggtacctttctcaattttcttctaggatcatcttagaccctaagtacctagacgtagatttctttaatgatgaaacgtttgattgctatcaagtgtttcaaaattctggcctggttgatttcatgtccttaaaattgccacattatcctgaacttgtaaaggtcttctattgcaatttaaaaattcaggatggcattatttcttctgaggtgcatggtattcctatgatcattgatcagtcattgttcttttctttaactcatttacccagtcaaggtgcaccttttgagggcaccattgttgatgactggatatttgattattctagtcatgatgctcgccgtatggtctgcaatgaccaggctgaaatgaccgtcgtcagatcgactgggctcacttggttcggtaccgaatgcataaggcattacgggccaatgcacctctcccttaccctcaattga

SEQ ID NO: 33483 - DNA, 207 bp, Glycine max
  Peptide Sequence Number=SeqID_125168
atgtggaccactacgggtacatcgaatgaatcgaaaagcttggttcgaggggaggtggttgccgcccagctcgcccaggcgagcagggttgcttcctccagaagcaaccgccttctggaggaatcttctggagggcccaagtgggcctgggtgctatttgcacccccatttttactaagtacacctccctctgctgttttttggtga

SEQ ID NO: 33484 - DNA, 290 bp, Glycine max
  Peptide Sequence Number=SeqID_125169
atggctcaggagcagacatggatgccttgtgtcttgttggaacaagtgcgaaaccaaccaaacacagagggcgggcaagcaacagatgatccgtgcgctactcttttcgcaccttcgtctgttttatgcgggtccaaacctcttgctgaatccttgaccacagttgcgattctgctcaaagaggggagacacccggaggaaagcatctcaaaggctggtcgtagtattggggtgattgatgcaatggcttctatggatacctctgctaaggtcaactctaagatctttcc

SEQ ID NO: 33485 - DNA, 252 bp, Glycine max
  Peptide Sequence Number=SeqID_125170
atggcacaacctccacctcgtgagaggactctaagggaaatggctgcacctgatttcacctatgaaagcttgtgcatccaataccctgatgaggatgtcccatatgttcttaaaactggattgattcatttgcttccaaagtttcatggccttgcaggtgaagagccgcacaaacaacaacaacaacaacaacaacaacaacgccttatcccactaggtggggtcggctacatggatcaacttccgccataa

SEQ ID NO: 33486 - DNA, 435 bp, Glycine max
  Peptide Sequence Number=SeqID_125171
atggctaagtttgacccagatatagtactagagttctacgctaatgcttggcccacggaggagggcatgcgggacatgcggtcatgggagggctatgagtgcgagtttagtcagagaaggaaccaggccgatggatttgacgaggaggccattgcccagctgttatgtataccaggtcaggattttgcccggaccgctgccgggaggcgggtgcagatcatgtgcaccagcatgaccaccttgacccagatgtggatgacgttgctgctcagcaacgtcctgcccagcgatcataactccgacctccctctgccgaagtgtatgccacctaccaggcaccctctagacccagataagtctaacagggccctagggtttccagcgttgatcacgggtctctgccagtcatttggggttcctgtcacacctagtaag

SEQ ID NO: 33487 - DNA, 664 bp, Glycine max
  Peptide Sequence Number=SeqID_125172
tgcgagttcagccagaggagggaacagggctgacgggatcgacgaggaggccattgcccagctattatgcacaccggggcaggattttgcctggaccgctacagggaggcaggtgcgaattatgtgcaccaacaagaccaccttgacccagacgtggatgacattgctactcaacaatgtcttgcctagcaatcataactctgatctccctctgccgaagtgtcagttggtgtatgccatcctgacacggatgagcgtccacgtggcccaggcaccctctagaccagataagtctaacagggccctgggatttttggcattgatcacgggcctctgccagtcgttcggggttcccgtcacccccaacaaagtgatccgaccaccgatcacccgagccttcattgagaagtactgcacgcctaggcaagcacagggtgacgcacctcagggcgcggacgcaccgccaccacctcggcaggctgatccggcggagccactgggcatggagcggtatctacaacatttggttcgccagcaagcggccaaccaccgcggacaggcaggggaggagcctgcaggatacccctataggatggatgagccccgcatggacgaggatatgactgacctgttcgatttcttgggagggagcgaagccacatga

SEQ ID NO: 33488 - DNA, 174 bp, Glycine max
  Peptide Sequence Number=SeqID_125173
atgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgttaatgacattaagttattttaa

SEQ ID NO: 33489 - DNA, 306 bp, Glycine max
  Peptide Sequence Number=SeqID_125174
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaaccacgttagtcgtccatcataacggcttcctgtgggcacacggtggtg

SEQ ID NO: 33490 - DNA, 378 bp, Glycine max
  Peptide Sequence Number=SeqID_125175
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccagggcgtttccccctggggggctccctcggggcgctctcctgttcctgcctttcggttttaccgggtgtcattccgctgttatgggccgcgttttgtctcattccacgcctgacactcagttccggggtaggcaggttcgctccaagctggactgtatgcacgaaaccccccgttcagtccgaccgctgcgccttatccggtaa

SEQ ID NO: 33491 - DNA, 293 bp, Glycine max
  Peptide Sequence Number=SeqID_125176
ctactgacggggtggtgcgtaacggcaaaagcaccgccgggacatcagcgctggcaaggcgatcggtgcgggccctcttcgctattacgccagctggcgaaagggggatgtgctgcaaggcgattaagttgggtaacgccagggttttcccagtcacgacgttgaattcgatactgaagaaagaggaaaccgtggagccagctattaactggtggagcgggaaatgtgaggcaaaatcaaacattgaaacatgcggtgcccccttcggttttgtaccttttgtggctccctag

SEQ ID NO: 33492 - DNA, 555 bp, Glycine max
  Peptide Sequence Number=SeqID_125177
atgaagcacttcactgacaccctcatcagtgccaacataggaacaaaagctggtaccgggccccccctcgaggtcgacggtatcgataagcttgataatcgcgcacgatcacctggtgctcgtcgatccggcgagcctcgcgctcgacgaaggcgacgcggccgccctgctcgcggtcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33493 - DNA, 393 bp, Glycine max
  Peptide Sequence Number=SeqID_125178
atgaccatgattacgccaagctcgaaattaaccctcactaaagggaacaaaagctggtaccgggccccccctcgaggtcgacgagtgacttctggagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 33494 - DNA, 513 bp, Glycine max
  Peptide Sequence Number=SeqID_125179
atggactcgggaaggttccaagttagtgtaccaggtaacagctaccccagtaagactttcttggaagaaatgtattggcaattcctcatctttgcgtatgcccttatcttccgacaatacatctttggatggttcttggggcaagtagtccccttgtacttgtcaaagtccagcaccttgaacttgggaggggtgatgatattgggtactaggaacaactcttctagggttgtggttgtgggtgacactgagggatctcctccaaatttgcaggggtataccaccaactgcttagcccttcagtgggtcatacaaggctcgaatggagattgcggtggggcttccatgtgcaccgtcatgggtcgagagacatcgtgcatgatcagaaaaatggaggttgttaggctcttaatggtatgggaggagttattgactacctcattgggaatgtacgccacattgggtgggtatagtttgagcatagccaattgggggaacggcgtgcttttttga

SEQ ID NO: 33495 - DNA, 267 bp, Glycine max
  Peptide Sequence Number=SeqID_125180
atgaagccggaatcgctagtaatcgccggtcagccatacggcggtgaattcgttcccgggccttgtacacaccgcccgtcacactatgggagctgccatgcccgaagtcgttaccttaaccgcaaggagggggatgccgaaggcagggctagtgactggagtgaagtcgtaacaagccacatggatagtttaatgtgctcatcggcgcctgaccctgagatgtggatcatccaaggcacattagcatggcgtacttctcctgtttga

SEQ ID NO: 33496 - DNA, 615 bp, Glycine max
  Peptide Sequence Number=SeqID_125181
atgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgctgtcagtgtcggcccagcagagtgctttcgccgttggtgttctttccgatctctacgcatttcaccgctccaccggaattccctctgcccctaccgtactccagcttggtagtttccaccgcctgtccagggtgagcctgggatttgacggcgaacttaaaaagccacctacagacgctttacgcccaatcattccggataacgcttgcatcctctgtcttaccgcggctgctggcacagagttagccgatgcttattccccggataccgtcattgcttcttctccgggaaaagaaagtttcatgacccgtaggccttctaccttcacgcggcattgctccgtcaggctttcgcccattgcggaaaattccccactgctgcctcccgtaggagtctgggccgtgtctcagtcccagtgtggctga

SEQ ID NO: 33497 - DNA, 564 bp, Glycine max
  Peptide Sequence Number=SeqID_125182
atggagaggagtatgattgatgctgccaatggtggagcacttggtgttatgactcttgccgaggctaggaatttgattaagaagatggcttccaactcccaacaattcagtgcaagaaatgatgctattgtccttagaggagtccatgaggtggccacagattcatcttcatctactgaaaataaaatgcttaagggaaaacttgatgccttggtcaacctagtaactcagcttgccatgaatcagaaatttgcacctgttgcaagagtctgtggtctatgttcttctgcagatcaccatacagatctttgtccttttttgcagcaatctggagtcaatgagcaacctgaaacttatgctgcaaacatttataatagacctcctcaacagcaaaaccaacaacaacagaataattatgatctttcaagcaacagatacaatccaagtaggaggaatcatccaaatctgagatggacaagtcctccaaaacaacaacagcctgtccctcctttccagaatgttgctggtccaagcaagccatatgttcctcctccaatacagtag

SEQ ID NO: 33498 - DNA, 267 bp, Glycine max
  Peptide Sequence Number=SeqID_125183
atggtacatctcttgtggatcaatttaagtggagggtacatccacttggttgttcaaagagaacaagggagggtacatccacttggttgttcaaagagaacaagggaggtgatgcaagctccattggagcttgtaggcctaggatcttcttcatcaatggattcctttgcttcttggaagataaagggcagcggaatggagaaggaagagagagaggagacaccacttcaaggagaagatgagtctagaagaagctcaccaccatag

SEQ ID NO: 33499 - DNA, 681 bp, Glycine max
  Peptide Sequence Number=SeqID_125184
atggctacctcaccaaaagatacttcatctcctggttcaccctctgtaccatcatctccatcatccaccaaagcaccatcaaaccaggaacaacctgaattccatatccaacccatacaaatgattcctggtcaagcccctgttcctgagaaactggtccccaaaagacaacagggagtgaagatttctgaaaaccctagcattgcaacaagtcctagggaacattttgaaaatgcttctgtccctgatgctgataaagatgttccaacatcttccaccccaaatgctgaagtcctctcttcatccagtaaagagaaatcaacagaggaagaggatcaagccacagaggagacccctgcaccaagggcaccagaacctgctccaggtgacctcattgatctagaagaggtagaatctgatgaggaacccattgtcaaaaagttggcacttggcattgcagaaagattacaaagcagaaagggaaaaacccccattactaggtctggacgaatcaaaactattgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaag

SEQ ID NO: 33500 - DNA, 251 bp, Glycine max
  Peptide Sequence Number=SeqID_125185
gcccacttgggccctctggaatattcctccagaaggcggttgcttctggaggaagcaaccctgctcgcctgggcgagctgggcggcaacctcctcccctattttgctataaataggggaggaaggcaagaaggaagggccgaggcgcttccgaaacgtttccgtaacgttttccgtgaggaatctcgcaaagatttcaaccgttcttcgacgttcttcattcgttcttcatcgttcttcgatcttcaacgg

SEQ ID NO: 33501 - DNA, 303 bp, Glycine max
  Peptide Sequence Number=SeqID_125186
atgaagaaagatgaagaatcttcacgaaatcgcgcacgaaaatgtttcggaagcgcctcggcttggattttcttctcggaaacaatttttctcactaatttcaagagaatcctaaataccataagggctgaacgaaactactctaccctctttcccctatttatagggaaaaagagggaggtggttgccgcccagctcgcccaggcgagctgggttgcttccaccagaaggcaacgccttctattggaacccctggaaggcccaagtgggcctggttgctatttgcacacctttttttactaa

SEQ ID NO: 33502 - DNA, 441 bp, Glycine max
  Peptide Sequence Number=SeqID_125187
atgaccatgattacgaattcgagctcggtacccgaggtgtgtgatgaaatggccccgaggaagcttgcctcaaagaggtccaggaaggacaaggcagcagaaggaactagttccgctccggagtatgatagtcaccgctttaggagcgcggtacaccagcagcgcttcgaagccatcaaggggtggtcgtttctccgggagcgacgcgtccagctcagggacgaggagtatactgatttccaggaggaaatagggcgccggcggtgggcaccactggttactcccatggccaagtttgatccagaaatagtccttgagttttatgccaatgcttggccaacagaggagggcgtgcgtgacatgagatcctgggttaggggtcagtggatcccgttcgatgccgatgctatcggccagctcctgggatatccgttggtgtag

SEQ ID NO: 33503 - DNA, 582 bp, Glycine max
  Peptide Sequence Number=SeqID_125188
atgtcaggatttacacgcgattctcctcaaatttcagccagcccgcatcaattagaccttgcaccttatgcttcagagccctacaatgctcaatggaacgccccggggcttctccgtgacaagtacacgttgcgttcgagtcgtattctcggagacatggaggttgatgaaccttggctagggttatggctaccattgaattatcaagtagatatgggagcaagtggtgttcgtcattggaagtgcggtagacagactttgtggttgatttggggatggcctttatggataactggttggtgggtaaggaggaggaatggcagtcacagcatggttctcctctttctcaccctctcatttgcccagttttctcagtcgtctagtaggatgatcaaatttgcctcttttcgaacccacattgatcctttcactggcgaagaccaaatctgcaaagctttgagggtgcgtagcctaccatcttttcatagtagagtaccgataatgtgtttaccatcacgattatcgtctccctttttgcacatgttctgtagttgcatcctatccggaaccatatcagaatag

SEQ ID NO: 33504 - DNA, 114 bp, Glycine max
  Peptide Sequence Number=SeqID_125189
atggatagtgcgagaagcatgtgcggaagtgcaaaaaaaaaatgctttactcttgccattgaccaaaagcaggaggcaaatccatttgtttttcctttcaacactactcgataa

SEQ ID NO: 33505 - DNA, 351 bp, Glycine max
  Peptide Sequence Number=SeqID_125190
atggcgaaccttcggtttgaagtgcctctagagaatcgagacttaccaagggtagaccttgggttttacaagccttggagaagtaagactcaccaagggtggaccttaggtttgacgagccttcgtagaagaaagactcaccaagggtgggccttgggtttgacgagcctttggagatgtgagactcaccaagggaggactttaggtttgataagcctttggagaaacgagactcaccaagtgctgaccttgggtctggcgagcatttggagaagcgagacttaccaagggaaaaccttgggtctgacgatcctttggagaagcgagactccccaaggaaggacagcgtaa

SEQ ID NO: 33506 - DNA, 243 bp, Glycine max
  Peptide Sequence Number=SeqID_125191
atgcacccatgtggacacttatgcattaagtttaatggtcatgtgacactaggtgtcgacaacatgcccttttgcgggcgagcgaaggacaaaataggggaggtggttgccgcccagctcgcccaggcgagctcagctcgcccaggcgagcagggttcttctccagaagcaaccgccttctggaggaatcttctggagggcccaagtgggcctgggtgctatttgcacccccatttttactaa

SEQ ID NO: 33507 - DNA, 573 bp, Glycine max
  Peptide Sequence Number=SeqID_125192
atgcaatctcagggacttgcaccgcctctcgaccctctggttggtccctccggtcctcgagtaagcacaaaggggagttatgttgatccctcgggaaacgatcctgagacgggtgactctgataggtgcaacttgtacatagaagcagatcatgcccgcctggttgccatggggagagttgttgagggatccactgttgttcataacactcctttgttgcctggcaaagtaaaggtgagtgtggaggaggttacagatgcagatgctccagttcatgtacccactgatgaggtttccttagtggggcaagaacttcacaccttccttgcttggccgacacatctggtagttgtgtctccggcaaaaccacctccaaagcccgatccggaggtcgatgatctgctttatctgatgacattgaccatctcagagcttttcttgaggccttatcaggttagatgggatgccaccgtgttcagggtctttaatccagatttcccgctctacataaagcacgaagacctctccgaaatcgcacacggtggtcaatgtctcagcatatcaatgttatag

SEQ ID NO: 33508 - DNA, 1227 bp, Glycine max
  Peptide Sequence Number=SeqID_125193
taaagaggaatcaacagaggaagaggatcaagccacagaggagacccctgcaccacgggcaccagaacctgctccaggtgacctcattgacctagaagaagtagaatctgatgaggaacccattgccaacaagttggcacctggcattgcagaaagattacaaagcagaaaggggaaaacccccattactaggtctggacgaatcaaaaccatggcacagaagaagagcacaccaatcactcctaccacatccagatggagcaaagttgcaattccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcgttccactccattggcaatgttgaaaggtggaaatttgtatatcaacgcagacttgctgttgaaagagaactgggaagagatgccttggattgcaaggagatcatggacctcatcaaggctgctggactgctgaaaactgtcaccaagttgggggattgctatgaaagtctagtcagggaattcattgtcaacattccctctgacataacaaacagaaagagtgatgattatcagaaagtgtttgtcagaggaaaatcatcaaattgcaaggaaatcactgccaaacaagtccagcattggccaaagaaagggaagctttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctgctctgtccctgcattacaaactgtttgaggggacacatgtcccagacattgtctcgacatcagggaaagctgctgcttcaggtgctgtgaccaaggatgctttgattgctgaactcaaggacacatgcaaggtgctggaagcaaccatcaaagccaccacagagaagaaaatggagctggaacgcctgatcaaaagactctcagacagtggcattgatgatggagaagcagctgaggaagaagaagaagcagctgaggaagaagaagatgcagcagaggatacaga

SEQ ID NO: 33509 - DNA, 186 bp, Glycine max
  Peptide Sequence Number=SeqID_125194
caaacactagtagatggtggtcatcatgcccaaggaacacctagttgtctgcctaaatcaaaggctccggctaggtggattatcgttaagtattttaacaatcctagaccattggtgccagagagattaaaggcactgcgaatccagtgggcacaatattatcttcgagttagagctcagagctag

SEQ ID NO: 33510 - DNA, 336 bp, Glycine max
  Peptide Sequence Number=SeqID_125195
atgcccttttgcgggcgagcgaggcaaggctcacaggtgcgttttccaaaggaggaaaatgcgcggaatcgccaccaacgtttatttgtggaaaaggtcagaaaaaccgaaggaaatcgggcaaaaagaatattccaagttcgggagttgtatttacgtttgaggaaggtcgacaaaagcggggctcttgctcctacgtaccctccatcgaagaggaaatcagacctacgtagttctttttttaagggtgcatcaagcgattctttttacttggaaggtgatcattttaaggcattggaccttaaaatgatccatttacttggtaagaaaacttag

SEQ ID NO: 33511 - DNA, 417 bp, Glycine max
  Peptide Sequence Number=SeqID_125196
atggcttctaggaaaagaaaggtaccctctacacctacccaagccagatttgacagatccatattcaattcccaagaggctggggaaagatacactgatgttattgtgcctaggaagcttttgccagagaggaatgtggtgatctactatacagagtttgatgagttcaaggaggaactcgagagatgccactgggatgaggagttgactgatttcattgacggaaacatcgatgttgccattgtgaaggagttctatgcaaacctatatgaccccgaggacaaatcacctaagcctgatccccaggagttggctgctaagctttgtatcctagggaggggattcgagcttaacgctgatgggcagcctttgaatatattgaggaagaaaatgaccaccctagctcagacatggagt

SEQ ID NO: 33512 - DNA, 261 bp, Glycine max
  Peptide Sequence Number=SeqID_125197
atggtgaaagttggaacctcttacgtgccgatcaacgtctcatttcgccaaaagttggcccagggcttcccggtgctccagtggcttctgtttctatcagctgtccctcctgttcagctactgacgggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 33513 - DNA, 290 bp, Glycine max
  Peptide Sequence Number=SeqID_125198
atggagcttacatcagatggcccctatgacgtctatcccccacatggaaaaaggccaaggggcggacatgacattcagaggatgtggtggagcattgacattgtccacgaatgcttgacatttaaggcatttccttacatgggtgcagcaatcgctttccatggtgagccagtaataccctactgtaaggatcttccgggccatagcatgcccattggcgatgcttccgctcatgaagaaactggccgccaatctcctcaatgcccttttgtcgttgtcgaaagcctcaa

SEQ ID NO: 33514 - DNA, 417 bp, Glycine max
  Peptide Sequence Number=SeqID_125199
atgtcaggatttacatgtgattctcctcaaatttcagccagcccgcatcaattagaccttgcaccttacgcttcagagccccacaatgctcaatggaacgccccggggcttctccatgacgagcacacgttgcgttcgagtcgtatcctcgaaaaaatggagattgatgaaccttggctggggctttttcactgcaaaattcatttcttggttggtgttttggtttatgctaaaggtggtgtttgtcattggaagtgcggtaggaatggtagtcacaacacgggcttctccttcatcctcaccctcttcatttgccccagttttctcattcgtccaagcaggatgactaaatttgccttttttcagacccacatcgatcctttcactggcaaagaccaaatccgcaaagctttgaag

SEQ ID NO: 33515 - DNA, 633 bp, Glycine max
  Peptide Sequence Number=SeqID_125200
gtatgatggtgttttgaggtctccagtggcttctgttctattcagctgtccctcctgttcagctactgacggggtggtgcgtaacggcaaaaagcaccgccggacatcagcgctggcaagtgtagcgggcgcgtcccattccgccattcaggctgcgcaactgttgggaagggcgatcggtgcgggcctcttcgctattacgccagctggcgaaagggggatgtgctgcaaggcgattaagttgggtaacgccagtgttttcccagggattgtgagcttgtgggtgaaagtgaaacacaaagtcaactttatctcaatgcggtttcatctaaatttgaaggacgaagatgttattgatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgttgcaggagaaaaaaggctgcaccg

SEQ ID NO: 33516 - DNA, 272 bp, Glycine max
  Peptide Sequence Number=SeqID_125201
atggatgagtttgatgtgcaggtggcctggccaggagcccagccttctccttctggagggggtggggcctccgcagcccagaagcctgctcctgaggagccaacaacaacagtagagggggaggatgagctcacccctcttgagcccttttattttgatgcagatgcacacatagctcaggaggaggggacttctacagatcagatacatgagccatctcctgcacctgttcctaatgagacccagccatctacactagtcacagagccaaa

SEQ ID NO: 33517 - DNA, 390 bp, Glycine max
  Peptide Sequence Number=SeqID_125202
atgccgcaacacaatgcgtctcataacaactacatgcgagtaaaagggaggcctccacaatcttccagtcccctttctaagcctggtaatcgattacaccccttggtaatcgattaccagaagccctcatggctttctgacctcgttttcaagcctagtaatcgattacaccccttggagctcgcctgtttaggtacatcacaggttctcactgaccgactatgcccgggttgggtcgggattggtcaagcttggttttgggaaatagcaccccacctgacgtctccaaggtctcctaacccccgcgacatatctccgggtaccactctgtggtcaacaataaaagcaggaagtttcacccttcaacacttcctcatctcaagcttgtag

SEQ ID NO: 33518 - DNA, 261 bp, Glycine max
  Peptide Sequence Number=SeqID_125203
atggccaaaatacaaggcctaaaagtaggaaaacctattctaatatttacaaagaaaagtggacccaaccttggcccatgggctcagaaatctatcctaaggttcatgagaaccctaggaccttctttagcaagctctagcccaatcctcttggagtcttttgctcatggctctgtatcggctccacctgaaaaaggaattaaatcagaaatgttaaaagtggtgctgactccatactcttttgggaggtccaacctatag

SEQ ID NO: 33519 - DNA, 429 bp, Glycine max
  Peptide Sequence Number=SeqID_125204
atgattcctggtcaagcccctgctcctgagaaactggctcccagaagacaacagggagtgaagatttctgaaaaccctagccttgcaacaagtcctagggaagtagacacggagatggacaagaaaatccgcagtattgtgagtagcattctgaaagatgcttctgtccctgatgctgatgaagatgttccaacatcttccaccccaaatgtttctgtccctgatgttgatgaagatgttccaacatcttccaccccaaatgtttctgttcctgatgctgataaagatgttccaacatcttccaccccaaatgctgaagtcctctcttcatccagtaaagaggactcaacagaggaagaggatcaagccacagaggagacccctgcaccacgggcaccagaacctgctccagtgacctcattgacctag

SEQ ID NO: 33520 - DNA, 276 bp, Glycine max
  Peptide Sequence Number=SeqID_125205
atgggccccaaatctaccctaaggctcataagaaccctagggccttctcttgcatctctggcccaatctacttggagtttttctatccaatgcccttgcggggtaggattgcatcaaattgttgcttacacaggaagggggatccctcctcctcttcttggaacctcacaatcactctcaaatggctcatttatggaagcaaagcttcatgatgaatcaaaaattattcaaaggtgttttgatgataacaacgatgacacaaagatgatgacaaag

SEQ ID NO: 33521 - DNA, 557 bp, Glycine max
  Peptide Sequence Number=SeqID_125206
taccaactgtagaagaatttgaagggatcttgggatgcccgctaggaggaaggaagtcgtacctgatttctgggttatacccctccatggcaagaatagccaaagtggtcaaagtctcggtgcaagaattggaccgagtaaaacaaaatagaaatggggtggtcggaataccaaggaagtacttggaagagaaagcgaaggctttggaagatcaagatgaatgggcttcattcattgatgtcttagcattattggtgttcagagttgtcctctttccaaatgtggatgggctagtagatctagcggcaatcgatgccttccttgcttatcaccatagcaaggcaaggaaagtctggtcgttgatgttttggccgatgcctatgatacatttgaccggagatgtgagaggagcggtgcaaggattgtctactgcacacccgctctttatgtatggttggtctctcacctctttcgtcatgaaagtagactcgtctgccccctacaaggtcatcgcatgggtgccgaggaagggaaagcaaattgggagcaactcttag

SEQ ID NO: 33522 - DNA, 471 bp, Glycine max
  Peptide Sequence Number=SeqID_125207
ggcttcccggtatcacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctccgctggagtagctacgttgcttaccacggagcatatacgatccgacgagcggagtgtatactggcttactatgttgggcactgatgagggtgtcagtgaagtgcttcatgtggcagggagaaaaaaggctgcaccg

SEQ ID NO: 33523 - DNA, 183 bp, Glycine max
  Peptide Sequence Number=SeqID_125208
atggcacgtagcgtgttcgcttcgtgcccctattcaagggacctatatgggagagagctaaagagtcccagtggagtcgccaactgtcgcaacctacccttcggcgggagggcgacgcgtgactcgcgggatgcgtgttccacgaaaggaatacgcgcggagtcgccaccaacgtttatttga

SEQ ID NO: 33524 - DNA, 471 bp, Glycine max
  Peptide Sequence Number=SeqID_125209
gactacactccctcgccttcgaaaggcgacacgtcctgaacttcagagggctacacgccctcgcctttagaggactacgcgtcctcactttcagggcttgtagtttccttttgacggttcctgggccaccccctgatattggagggcgaccaactgtgcaagcacaaccagagagggaggctatcacacagctactatgcataccggggcaagatttcacccgtaccactgcaaagagacaaggatcgcacccaagcagacacccagtggacccggaaaagtccaacagggccctggggtttcaagctctagttacggggcgaaacaccacagcagcattgggatggccggtagcgggcaatagacacaccgccaccacctctagagttcacctcagctcatccgcaaaaaggttagagcgttgcctacgacacatggccgaccagcaggcgaccaagtccaaagccaaag

SEQ ID NO: 33525 - DNA, 213 bp, Glycine max
  Peptide Sequence Number=SeqID_125210
cttgagaggattgatggggacccggtgttgagagaaacgaggagatgggctacgtgggagtacgtgagctcagttggaggtgggcaacaggggatggagaccttggggacgtcaggtggggtgctattgcccaaaaccaagcttgaccaatcccgacccaacccgggcatagtcggtcagttgagaacctgtgatgtacctaaagcaggctga

SEQ ID NO: 33526 - DNA, 342 bp, Glycine max
  Peptide Sequence Number=SeqID_125211
tcgatccctgtcgtaccagttctgagtgactgttcgacgccgaggaagaggcccgaagggcccgttccaatccgtcccccgaccggcacgcgacgacccgctctcgccgcggaagcagctcgagcagtccaccgacagccgacgggttcgggactgggacccccgtgcccagccctcagagccaatccttttcccgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaa

SEQ ID NO: 33527 - DNA, 774 bp, Glycine max
  Peptide Sequence Number=SeqID_125212
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgaggtatttattcaaataggtataatccacggaattgcggaaattctagaaatcttaaaaaatga

SEQ ID NO: 33528 - DNA, 552 bp, Glycine max
  Peptide Sequence Number=SeqID_125213
atggttctgaaagaggagttagttgcttgttcaaggtccaaaagaagcttgtctcagtgtttatgcgagacggagaccaacatgctagctatcatcgccaagtaccaagaagagttaggtctagccacggcccacgagcatggaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccgcccctgaagagattcatgggcttctcggctattggaaaaacaccataactaaacgtgccacaaggcatccctatcgcaccagatccaaatctagaacgatgggtgatcaagaggagacgcaggaacagatgaaagccgacatgtcggctctgaaagaacaaatggcctccatgatggaggccatgttaagtatgaagcagctcgtagagaagaacgcggccaccgctgccgct

SEQ ID NO: 33529 - DNA, 246 bp, Glycine max
  Peptide Sequence Number=SeqID_125214
atgggtcacatccaagagaattgttattcgttgcatgggtttcctgacaaggttgcacaggtttctagatcaaagaaagcagagtctaagttctctgatgaggagtatctctcatctataccatgtttttcaacagcatgtatctctcaatccattgaaggtcctagtccttggatactcgaatcaggtgcctctgatcatatttctgaaacatgggacggagcgactgattggagaaggacatga

SEQ ID NO: 33530 - DNA, 171 bp, Glycine max
  Peptide Sequence Number=SeqID_125215
atgaagaacaccaaaaatgggtttcctttgctggcagtcacttaccttgtcgaaaatttatctggtctaaaggttttagcattctatttgctctcccttgaggagattccgctgtcctttgcttcaggggcaaggatgaggattcttttgataggccaaggtccaaaatag

SEQ ID NO: 33531 - DNA, 1171 bp, Glycine max
  Peptide Sequence Number=SeqID_125216
atggatggtttggtggacctagccgcaattgatgctttccttgcatatcaccatagcaaggagagctcagtggtagctatcttggcggacttatttgacacatttgaccgaaggtgcgaaaagagtagcgcacggatcatttgttgtttactcgctctttgtgtatggttggtttcgcacctattccaacaagacacaaggcatccatgtccgctccgaagccatcgctcgtgtgtcgaaaagagaagagtagattgggaccaacacttggctgggataggaggtagaacaatcaactggtttcctcgatggaaggaaggaaatgagggagttctattctcgtgtggggactacctaaacatcctgttgataggaacgaggggttgtattaactacaatcccacacttgctataagaaagttagggtaccccatgaggggagcaccgacggaagaaaggctctctcatttccttgtgagagatttcagcgcgcaaagtttcaagattatacaaagagtccataaggcgtgggaaagcccgttaaggaaagataaagaagttaggggcattcgtaatggcatcatcggtggaaaagcgagacttgccaaagaaaaattcaagttggtcgctacagacgtccggaaagagtgtgccgggttacgagaagaaaatgcagctaccacaaaagccctggaacaagaaaccaagagggctcgcaaggaagagcacgaccgtgacaaattccgtggagcattgtggggcagcaacagtgagctcaagcttcgaagggaagagagagaccaatcacgagcacatagcaaggtcttaaaaaaagagttagccgcttgctcaaggtccaaaaggaacttgactcagtgtttgtgcgagacagagaccaacatgttagctatcatcaccaagtatcaagaagaactaagtctagccacagcccacaagcatagggtggcggacgagtatgcccaagtgtatgcggaaaaggaggctagaggaagagtgatcgactcgttacaccaagaggcaaccatgtggatggaccgatttgctcttaccttgaacgagagtcaagaacttccccgattgctagccaaggccaaagcaacggcgaacacctactccgcccccgaggagatccatggacttttcgactatt

SEQ ID NO: 33532 - DNA, 285 bp, Glycine max
  Peptide Sequence Number=SeqID_125217
atggggacaaggacaaggtatgaaaaaatatggaataagtggctgaatcccaaaggaatagaggagcaatggagaataacctttgagaaacaacatcatatttcagcatgtccaacatttaaccaatatgcaatgtacatcaagtatggctcaaaatatatcatgaagcatgaccaacaaaacatgttatccaatgaaacaaaaacccccacacttattcccaaaccaattccaaagctccaaaattcctttaaggatatggtgatatcatggtttttcacttaa

SEQ ID NO: 33533 - DNA, 308 bp, Glycine max
  Peptide Sequence Number=SeqID_125218
gttgcgtcagggttataccactttgggaaaggaggctggtagatcttcccgggagatatcacagccatctggttggcgatgagggatggcaagaggtcttcgtacgtcattgggattgcggtgaatgttgtcctcgggggaaagttccttatcgtgttggaaccgacgccaaagtgggcattactggccgggcgagtcggggttggagccgtagcttgggggtctccctatggatgggcgtaggcgccctagcttgtatgggtgctgagttggaggagtccccggcgcgagctgagaagctcgggtga

SEQ ID NO: 33534 - DNA, 294 bp, Glycine max
  Peptide Sequence Number=SeqID_125219
atgtcggatacaaactgtccaggggacactgtcccgacaaatactgtcgacacatgggaaatgctattaggagctttgattgctgaactcaaggacacatgcaaggtgctggaagcaaccatcaaagccaccacagagaagaaaatggagctggaacgcctgatcaaaagactctcagacagtggaattgatgatggagaagcagctgaggaagaagaagaagcagctgaggaagaagaagatgcagcagaggatacagaatcagatgatgatgattctgatgccaccccatga

SEQ ID NO: 33535 - DNA, 588 bp, Glycine max
  Peptide Sequence Number=SeqID_125220
atgaccacaatgatggaacgcatgatgagtatgagaaggatgatggaggtcaatgtggctacagttgttgctggaggcaaagcattgggaagtatgggtggcccccattttgtacaggtccagagcaagcattccttcccaccatatggcttgcctcccaacaatacaccactcaatactacacacactcccgatgagaatgtcgaccactctgctcccatacccattgagaaccaacatccccaatctggtcatgcgcaggtctctcaacccatgggggagacacatgaagcaccccgagaccacaatctagtcgacttcgagcctcatgtcggatatgccactgagggagtcccttctgctatggtggaaagagagagatttgatcatataaaggagaggctgagggatattgaaggaggtggagattatgcctttgctgacatggcagaactatgcctagtgctcgacgtcgttatccctctgaagttcaaggtgtcagatttcaataaatacaaggggactacttgccctaagaatcacactgaagatgtacaacaagaaaatgggggcatactcgaaaaatga

SEQ ID NO: 33536 - DNA, 366 bp, Glycine max
  Peptide Sequence Number=SeqID_125221
atgacgttgtcacttagcaacattctgcccagcgaccgtaatgccgatctccccctgcggaagtatcagttggtctgtgttgtcccgacggatcgcgcccacaagacacccagtggacccggagaagtccaacagggccctggggatcgcgcccgcaagacacccagtggacccagagaagtccaacagggtcttggggtttctagctctgattacggacctttttcagttctacggagtgcttgtcgcccccagcaaggtcatcaggcccctactaatcgagctttcatcaagaagtactgcgtcccaggcagttgcagggcgaaacaccacagcagcctagggatggccggcagtggacaatag

SEQ ID NO: 33537 - DNA, 371 bp, Glycine max
  Peptide Sequence Number=SeqID_125222
agagaatctcctctatccctgcactacaaactgttgaggggacacatgtcccagacattgtctcgacatcagggaaagctgcttcaggtgctgtgtccaaggatgccttgattgctgaactcaaggacacatgcaaggtgctggaagcaaccatcaaagccaacacagagaagaagatggagctggaacggctgatcaaaaggctctcagaaagtggcattgatgatggtgaagcagctgaggaagatggtgaagcagctgaagaagaggaagaagcagccgaggaagaagaagaagctgctgaggaagaggaagatgcagcagaggatacagatccagatgatgatgatgattctgaagccaccccatga

SEQ ID NO: 33538 - DNA, 468 bp, Glycine max
  Peptide Sequence Number=SeqID_125223
atgattatgaggagtcaagacatttatagtagccaagatgaggctactacttcaccttcctctagtgaaagtgaagaagcaaaaggagaagaatctagtgaagaaatctacccccaagaagaaggaaaacctttaatggttaaggaggagtgtaaggagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgttttattactcatgcacccaacatcttcatgatttgtgtacatagggactcattaggtagggttcccatgaaccctaaaagaataaaggtcattcctgagtggcccgctccaccaagt

SEQ ID NO: 33539 - DNA, 638 bp, Glycine max
  Peptide Sequence Number=SeqID_125224
gtgcgaataaccataaggtgtgtccacgtgctatcaaaccctcgggtcacgatagcagaattgagacttttttgcggtctcggtcggaagacgctgacatctccgggaagggtgcagatgacaacattggtgcagataaccataaggtgtgtccgcgtgctaccgaacccttgggtcacgatagcagaattgagactttttcgcggtctcggccgaaagacgctgacatctccgggaagggtgcagatgacctcattggtgcggataaccataaggtgtgcccgtgtgctaccgtacccttggttcacgatagcgatattgagacttttttgcggtctcggccggaagacgctgacatctctaggaagggtgcggataaccataaggtgtgtccgcgtgctaccggacccttgggttacgatagcgaaattgagactttttcgcattctcagccggaagacgctgacatcttcagaaagggtgcagatgaccacattggcctctgcttgtcaatcagacttgggcacgttggcctcttaacagtgaatggctcttttttcttgggagatcccactgttccttcttctgagggcaaggatggaaattctcatcctgggtcaaggtttatggtgatttga

SEQ ID NO: 33540 - DNA, 633 bp, Glycine max
  Peptide Sequence Number=SeqID_125225
atggctgcaagtgacattgctattctcagagatagagcccacgttgcagggtgtgccatctatggtggagctcacaattctggctatcgtatccccaatgaagaaccagttcatgaagtcaattatatggggaatcagccaagacaaaatttcaatgcaggtggatattccaaatttcagcatggccaaccatataattctcagcagggacagtggaggaatcaccctggaaaccaattcaacaaagaccagggtggtccatctacaaggccacaacaacaagggcttagtctctattatcgaacaatgaagctggaagagactccagctcaatttatgcaaagtttggaagtccaagtgggccagctcgcaaagcaattggcggacaggccgtcaagcagctttactgcaaatactgagaagaatccaaaggaagaatgtaaagctataatgacaaggagcagaatggcaattcaggctgatgaaggtagagctaaagagaaggtggaggaattcaaacaactgtcgacagttaagccaacaccggaaccagtttctgattttgttgaacttgaggaagttatggaagacgaagatgaccaacaggagagagacaccaatgaaagagagtga

SEQ ID NO: 33541 - DNA, 189 bp, Glycine max
  Peptide Sequence Number=SeqID_125226
atgaagtccaagattctccaccaagtgtgcttaggtgtcatgaggcatgccttggatcttcttcatcaatggagtcctttgctttttgaagatcatggcagcggaatggagaaggagaaagatgattggagatgccacttcaaggagaagatgatactagaagaagctcaccaccataggaagccatga

SEQ ID NO: 33542 - DNA, 447 bp, Glycine max
  Peptide Sequence Number=SeqID_125227
atggggatcgcaccacaagacacccagtggacccgaaaaagtccaacagggccctggggtttccagctctggttacgggcctctatcagtcctacagggtgcccgtaccccccccggcaaggtcacgtcatcatagggattgcgcctgcaagacacccagtggacccgaagaagtccaacagggtcttggagttgtcaagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaaggttagagcgttgcctacgacacatggccgaccaatag

SEQ ID NO: 33543 - DNA, 209 bp, Glycine max
  Peptide Sequence Number=SeqID_125228
gctgcgcaactggtggggaagggcgatcggtgcgggcctcttcgctattacgccagctggcgaaagggggatgtgctgcaaggcgattaagttgggtaacgccagtgttttcccagtcacgacgtttgtatactgggcttactatgttggcactgatgagggtgtcagtgaagtgctttcatgtggcaggagaaaaaaggctgcaccgg

SEQ ID NO: 33544 - DNA, 66 bp, Glycine max
  Peptide Sequence Number=SeqID_125229
atatgaaaatgatagattaaaagagaaaaagatcgagaaaatatcaaaaaagaagatttttagcag

SEQ ID NO: 33545 - DNA, 243 bp, Glycine max
  Peptide Sequence Number=SeqID_125230
cacccaggcccacttgggccctctggaatattcctccagaaggcggttgcttctggaggaagcaaccctgctcgcctaggcgagctgggcggcaaccacctcccctattttgctataaataggggaggaaccgaggcgcttccgaaacgtttccgtaacgttttccgtgagggatttcgcaaagatttcaaccgttcttcgacgttcttcattcgttcttcatcgttcttcgatcttcaacgg

SEQ ID NO: 33546 - DNA, 231 bp, Glycine max
  Peptide Sequence Number=SeqID_125231
atggccaaatttgcaatactaatgagggcaccaccttcgttagtaacaacacaaaaacttcatggtcaacaaggcaatcaacatggctcaacctctaatcttgaggacttatcagatgaatacgagacttgttgggtcaaaaaccatgatagtgatactgactcctcttccgggcccgaaggaagtaacctatctccatcccacgaacgtatattcaaacaggattggtaa

SEQ ID NO: 33547 - DNA, 606 bp, Glycine max
  Peptide Sequence Number=SeqID_125232
atgatgactcaaccgttggcgggagcgaaatcagtggtaactgagaatgaactggatattcgggacagaccaacggttaacatgctcggggggtactattcccagcagcaattcctgcgaaacctggatattaaagccagtctcgcgacgccggaccaggcttccgttatggatgaagcctataaagagttcgtgatgcaactggcttcatgggatacacgccgtgatttctggtcccagacggattactacaagcagcgtcgggttgataacaccaaagccgatgccgcgctgctggacgatctgattaacaatattcaatttatgccgggtgatgcgctgcgtaacgtcaacgacagcgtcaagctgattgcagaaaccgcgccggacgccaacaatctgttgcgtcagtacgtcgcgtttgccagccagcgtgccgcaagccatcttaatgaagagctgaaaggcgcatgggcggcccgcacaatccagatgaaggcgcaggttaaacgccaggaggaagtggcaaatgccattttcgcccgccgcatacataacattgaacaggcgttgaaattgcggagcagcacatatttcccgctctga

SEQ ID NO: 33548 - DNA, 390 bp, Glycine max
  Peptide Sequence Number=SeqID_125233
tgccgactgtgaaagagtttgaagaaatcctgggatgcccactgggaggaaggaagccatatcttttctctggcttctatccctccacgacaagagttgccaaggtagtgaaaatctcagcacaagagttggaccgtgtaaagcaaaacagaaatggagtagtcggagtaccaaggaagtgtgtcctctttccaaatatggaagggttagtggacctagcagcgattgacgctttcctcgcctttcatcatggcaaggaaagcccagtcgtcgccattttggccatgcatgacacgttcgaccagagatgtgaaaagagcggcgcaagaattgtttgttgtacaccggctctctatgtgtggctggtttcgcacctttttcaccaagaag

SEQ ID NO: 33549 - DNA, 512 bp, Glycine max
  Peptide Sequence Number=SeqID_125234
gccatgctaggaatgaggcactcatggagaaaaacatggccaccactgccgctgtcagttcggctgccgaagcagacccaactctcctagctaccgcgcaccaccctcccccaaatacggtaggacgaggaaggaacacactggggcacaacagcaacccccatttgggatacaaccgagcggcttacccttatggattgccgcctaattacacgccgccaatcatgcaagatgatgcgagggatgttgatttctatcccccgatccccgttgaggggccggcacccaacactttgccccatcccaacctcataacacagccaataatcttgtccacagaaggaccacccccggcgaccgaagaaagaaggaaactcgatctcctcgatgagagattgagggctgttgaaggctttggtgactatccattcgcgaacatgacggatctttgcttggtaccagatgttgttattccccccaaaattcaaagtgtcggacttcgacaagtataa

SEQ ID NO: 33550 - DNA, 376 bp, Glycine max
  Peptide Sequence Number=SeqID_125235
ggccttggggtttccggctctgatcacgggcctctgccagtcctacggagttcctatcacccccagcaaggtaatccgaccactgatcacccgagccttcatcgagaagtactgcacgcctaggcaggcgcagggcaacgcacatcaggacgcgggcgcacggcccccacctcggcaggccgattcggcggccaaacaccatggacaggtgcagatacatgagtgtctctaccggttcagcctcagtcagcagggccagcccgatgcccaggtaggggaggaccctactggatccccgggtgaggcggatgaatcccgtatggatgaggatatgaatgacctgctcggtttcttgcgagggagcggagccacatga

SEQ ID NO: 33551 - DNA, 276 bp, Glycine max
  Peptide Sequence Number=SeqID_125236
atgattcaaaggactaaccgcctgagaattctttgtcccaacacattggagggtatatcctttgtggtacaagtagagggtacatctacttggggattgtttactgagaacaagagagggtacatctcttgtggatcagttcaagtggagggtacatccacttggttttcaaagagaacaagggagggcacatcccttgtggatctttggcttgtaaaggatttacaggttgaaaaaaatctcaagaaccggaggtatcttcgggattggatgtag

SEQ ID NO: 33552 - DNA, 93 bp, Glycine max
  Peptide Sequence Number=SeqID_125237
atgactcaacaaacttttagaaaaggtattgaggaaagaatccctaagtttcaagaacctctggctttgaggtcaaatccttttcaaggctga

SEQ ID NO: 33553 - DNA, 264 bp, Glycine max
  Peptide Sequence Number=SeqID_125238
atggtcgtcattctgcctaaggaaaacctagttgtctggttttgttctttacataacaggtcagacaactaccttaacagaataattaacagcactagtgctttgaaaggacttgatgatactccacaaccgaaatccaaggcttttgctaggtggattgttgttaagtattttaatgaagttagaccattggaagcagagagattcaaggcacttcgcatacagtgggcacaatattatctaaaagttagaaatcaaacatag

SEQ ID NO: 33554 - DNA, 1045 bp, Glycine max
  Peptide Sequence Number=SeqID_125239
atggacaagaaaatacgcagcattgtgagtagcattttgaaagacgcctctgtgcctgaagctgatgaagatgtcccaacatcgtccaacccaaatgtttctgtgcctgatgtcaagaaagatgttccaacatcttccgctccaaatgctgaagcactcccttcacccggtgaagagggatcaactgaggaagatgatcaagccgcagaggagactcctgcaccacgggcaccagaacctgctccaggtgatctcattgacttagaagaagtcgaatctgatgaagaacccattgccaaccggttggcacctggcattgcagaaaggttacaaagcagaaaagggaagacccccattaagaggtctggacgaatcaaaacaatggcccagaagaagagtactccaatcactcctgccacatccagaagaagcaaggttgctatcccctccaagaagaggaaagaaatttcgtcatccgattctgataaggatgtcgaactagatgtctcgacatctaagaaggccaagacttcagggaaaaaggtgcctggaaatgtccctgatgcaccattggacacatctctttccactccattggcaatacttgcggttgagagagaactgggaagagatgccttggattgcaaggagatcatggacctcatcaaggctgctggactgctgaagactgtcagcaagttgggagattgctatgaaggcttagtcagggaattcattgtcaacattccctctgacatatctaacagaaaaagtgatgagtatcaaaaggtgtttgtcagaggaaagtgtgttaaattctcccctgctgtgattaacaaatatctgggcagacctactgatggagtgatagatattgatgtttctgagcatcaaattgccaaggaaatcactgccaaacgagtccagcattggccaaagaaagggaagctttcagcaggaaagctaagtgtgaagtatgccattctgcacaggattggagctgcaaactgggttcccaccaatcatacttccactgttgccacag

SEQ ID NO: 33555 - DNA, 546 bp, Glycine max
  Peptide Sequence Number=SeqID_125240
atggaggccatgaaagagcaaatggccacaatgatggaggccataaggagcatgaagaagataatggaagccaatgcggttgcagttgccactaccagggctgttgctaaggtgaacccgatgcccccatctgccctcaaccaaatgaatcatccaacctcagctagggtaggcaaagatttggaaagtacgggcggcccccattatgcgcaaattcagaacaagcatgccttcccaacatatggctggcctcccaactatacaccacccaatgtgacgtacactcccaatgagaatatcaacaaacccaaactaatcatgcacatgcctctcaaaccgtggaggagacacatgaaattccccaccacaatccagccgactccgagccttgcctcggatatgccactgaagggcaagcagttggtgatatacccctgcaaaacactttggagggccctcagtatcacccacaaccacaccccttgcattccacaacgattaaaaaccctcgtgctatggcaaaaatgggaaagttggatcatctag

SEQ ID NO: 33556 - DNA, 540 bp, Glycine max
  Peptide Sequence Number=SeqID_125241
atggcgccgaccaggcaccctatggacccagatacgtccaaccgggccctgggatttcccgcactgatcacaggactctgccagtcgttcggagtccccgtggcacctaccaaggtgattcagccgcccatcacccgggcttttattgagaagtactgcacccagagacaggctcagggtgatgctccaaaggccgcaggcgcaccaccaccacctcatcgggctggcccggctgggtcatttgatatggagcagtatttacggcatttggttcagcaacaggcggccaaccaccgggcacatgtacagacccatgattgtctgtaccagctgagcctcagcatgcagagccagggcttcgcttcttcttcatgccctactccagaccagttcagggcaggggtcgcatggcccggggattggcccgaggcccaagcaggagaggcacccccagaggttcccgacgatggagaggaggcccacgaggacgaggagatggccgattttcttgacttcttgggagggagtggagctacatga

SEQ ID NO: 33557 - DNA, 555 bp, Glycine max
  Peptide Sequence Number=SeqID_125242
atggctgttggtcgttgggcactcacagggtacccaatgggccctttctaccatcctgcgacgatatgggccgcaatcacaggcaaactaggttgcacgtgtgagggtgctggcaagcgtcgtatattcgcaataggaaactatgtgagagggacgaatgtatttgaggtacccttcgttaagagggctctgtctcaagtgtcctttgtgaccggtcaaccgttaggctattatggttattggcctttgttcgcgttcacccatcatgttttggtgtggtgggctgcggaacaggttagacctgggatcctgttcgacaggtatgctatattaggtgatgatgttctcatcaccgatccacttgtggcggaacagtaccggctaggcttacaacggcttggtgttaagatatccacacacaagtctttgatatcctcaactggtgctgtagagtttgccaaacaatttctggtcaaggatatgagggttaacctctctcctgtgtccatgaaagctttatgtggcttccaccacccccacggatactacttctaa

SEQ ID NO: 33558 - DNA, 435 bp, Glycine max
  Peptide Sequence Number=SeqID_125243
ggccctgggattccccgcactgatcacaggactctgccagtcgttcggggtccccgttgcacctaccaaggctcagggtgatgctccacaggccgcaggcgcgcccccaccacctcatcaggctggccaggctagggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgacggagaagaggcccacgaggatgaggagatgaccgatttgcttgacttcttgggagggagtggagatac

SEQ ID NO: 33559 - DNA, 153 bp, Glycine max
  Peptide Sequence Number=SeqID_125244
atggataagagcttcaaggaggagaagatgagaggagggagaaggagagaaggagcacaaaattttgtgcctcaaatgaggcactatttgtcttcttgtttgcatcgtgatcacgacattcgttgttggacattatacacatcatcatcatag

SEQ ID NO: 33560 - DNA, 222 bp, Glycine max
  Peptide Sequence Number=SeqID_125245
atggagaaaacaccgagctttttcaatctcacaagtttccagaactacgtaggtcgagttcctttcattttgtgtcatggaaataacccagacgactcacatatggtcatccttaccctcggagatgtcaaaaaggaagatttccgaaggaaagtttcaatcaaagagaaagcaaaaaaagaaaagaaaggaaattcccaatcaaagagtgggagaaagtaa

SEQ ID NO: 33561 - DNA, 507 bp, Glycine max
  Peptide Sequence Number=SeqID_125246
accgggctagagtgctgttaccaccggaagaaatgccatgatgctctcttgtggcaattgaagtggaacttcacttcaaggggatgtgatgtctggtgtggcgaaccgtcatcactactgcaggagagagctgcaatgagactcgctgcggaagactcaagcttcgtagttagggcaaagtactggcatgctgctattggtagactgatgaagtcacaaaggctgaattggaaaaagtcggataccttcataagggtttggcatgagttagcgggagactctgtgacggctcactggttggtgagaacgctggatgaaaacgaagttgctagaatgctgtttcgaaagggccgttccaaggggaggcgaccctccagtttgcttgacagggttaatctaggtgccctctggctcgcattccgtcccagttccttacctcctttggtccatccaaaagatttgccaccactacttccggagtggaccgctttcgaacaagatggaacg

SEQ ID NO: 33562 - DNA, 435 bp, Glycine max
  Peptide Sequence Number=SeqID_125247
atgactgaagcacgtcaaaaaggggtatggaaagtaaatgaaaatgagaataaaagtacacgaaacaaatggggaccaccacgggtacatagaaatgaattgaaaagctcggtttggggtatttaccggttgaagaccgaagaaaaacgaagaacgaacgatgaatgtcgaagaacggttgaaaatcttcgcgtaattacccacagaaacgttacggaagtgcctcggcttggatttttttcacgaatacaagttttcctcagcaatttcaagtccccagtggagtcgccaactgtcgcaacatgccccttttgcgggcgagcgaaggcgaggctcatgggtgctttctccaaaggaggaaagatgcgcagagtcaccaccaacgtttatttgtgggaagacatcggaaaaaccgaaggaaaccggtcaaaatga

SEQ ID NO: 33563 - DNA, 81 bp, Glycine max
  Peptide Sequence Number=SeqID_125248
ggtaaggtttatggtgagtcaggattttggctataaccaaggcttgcttaaatggctagacatgatacatgtttcagtaag

SEQ ID NO: 33564 - DNA, 316 bp, Glycine max
  Peptide Sequence Number=SeqID_125249
atggctaagtccttgaatgagaatctccttccatacatgttccccggagaggacaatcagatggcgatgcgcttgccactttgggcaggagcgggacgtgttaagctcttggtatttcgacaaaaatcaagcgatactgatcgtcctggaagctctcattttaagagaaaccacaacatgacaatcttggacgagtcgtgggatgcctggggcaacatgacgaatccgggaaaaaggagcgcgcttatgggcatcccatcgcctaaggcagtatatgctgagtcatactacctggttgatatccaaaatggacccg

SEQ ID NO: 33565 - DNA, 518 bp, Glycine max
  Peptide Sequence Number=SeqID_125250
atgttggtgcgcatgatccgcactcgtctctttgcagcggcacgggtgaaatcttgccccggtatgcatagtagctgtgtgatagcctccctctctggttgtgctcgcacagttggccctcctccaatatcaggggtggcccaggaaccgttaaaaggaaactactggccccttaaccggaagggcaagtctcgcacactgaaaatgaggacacgtagccctctaaaggtgagggcgtgcagccctctcaaggcgaggaggtgtagtcctctggaggtgagggcgtgcagccctctgctggcaaggacgtgtagtcctttcaaggcgaggacgtgtagtcatctcaaggcgaggacaagtagtcctctaaaggtgaggacgtgtagccctacgaaggtgaggacatgcagtcctctgatggcgagggcgtgtagccctctgaaggtgagggcgtgcagccctctgatggtgagacgcgtagtcctctcaagcgagacgtgtagtcctctcacggtgag

SEQ ID NO: 33566 - DNA, 642 bp, Glycine max
  Peptide Sequence Number=SeqID_125251
atggcccgcacgaagaagacaggggagatgacgactgaggccgcaaaggaaatcactgagaagattgattcgtttaaggagcaggccacacagggatcgttcatcccccatggacgtcaggatgttctggccgctgctattggacgtccagagcaccctggacgtgtccgtgctgctggagccgccagcttcagttgcagatgcaatctcaaggacttgcagtgccttctgagcctctggttgggtcctggtccctccggtcctcgagtgagcacaaaggggagttgtgttgatccctcaggaaacgatcctgagatgggtgactctgacaggtgcggcttgtacatagaagcagatcttgcccgcctggttgccatggggagagtttatgagggatccactattgttcataacactcctttgttgcctggccaagtaaaggtgagtgtggaggaggttacatatgtagatgctctagttcctgtacccactgatgaggtttccttagtggggcaggcacttcacaccttccttgcttggccgacacatctggtcaagtctttatcacagcaggtagttgtgtctccgccaaaaccacctccgaagcccgatccggaggtcgatgatccgctttatctgatg

SEQ ID NO: 33567 - DNA, 480 bp, Glycine max
  Peptide Sequence Number=SeqID_125252
atgaaaggcaccatgcaaaaacctcaagcaaacctaggggcaaatgagaagttctcacccaataggttcccagctgcaagtccgcatttaccaaatttcacgacaaaggttgcatgcctctgcatccctaaaattcatgttaactgcatagatttcctacatttaatgtccaatctttttgtcgcaacgtgcccttttgcgggcgagcgaggcgaggctcacgggtgcgctttccaaaggaggaaagatgcgcggagtcgccaccaacgtttatttgtggaaaacattgggaaaaccgaaggaaaccggtcaaaaacgaaaattctaagttcgggagttgtatttacgtttgaggaaggtattagcacctctcacgtcgacaaatgcggggctcttgctcctacgtaccctccatcaaagaggaaatcagacctacgtagttcttccttaagcgtgaatcaagcgattctttttacttga

SEQ ID NO: 33568 - DNA, 462 bp, Glycine max
  Peptide Sequence Number=SeqID_125253
atgattggtgagtgtaaaggtgttcaagataatacacgtttggaacgacgatggtggggagcaggatcaggagctggatatggcgcgggagttggtgcaggatatggcgctggagttggcgcaggatacggtgcaggagttgctgcgggatatggtgtaggcattgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33569 - DNA, 513 bp, Glycine max
  Peptide Sequence Number=SeqID_125254
atgatacgtggagataccttacggttatccgccccccctttgccattcagacacagtcgtgttcgatggcaagcagagaccaagtttggtcattctgcacacatgatacgtggagataccttacggttatccgccccccctttgccattcagacacagtcgtgttcgatggcaagcagagaccaagtttggtcattctgcacacatgatacgcgaagataccttacggttatccgccccccctttgccattcagacacagtcgtgttcgatggcaagcagagaccaagtttggtcattctgcacccatgatacgcggagataccttatggttattcgcacccattcttttgctatcttggctgacacagctctccgcaccttttgttcctccggggaacaacaaagtcatttacatgcggaaatttcatggtcgcccgcgactctcgtcaaccgagaggagcgaattagtgtcatacactgattttcggggacctttgcttgatgacatgtga

SEQ ID NO: 33570 - DNA, 96 bp, Glycine max
  Peptide Sequence Number=SeqID_125255
atgcagattatctttgactggaggaaatccactaaaatagtgttagttcaaggtctaacagccactgtttacaaccttctcagtgggatcctctag

SEQ ID NO: 33571 - DNA, 315 bp, Glycine max
  Peptide Sequence Number=SeqID_125256
atgacaattgaggaatcaatacatgttacttttgatgaaactaatattacctccccgagaaaggagtttgttgatgatattgcatatgctttggaagatactcaaaatgaagaaagaaatctgaaaagaatgagagatgatgaagacaaggatgatcaagatgacacaacacaagaaaatgataatcttcccaaagaatggaaaacttcaagaaatcatcctcttgacaacatcatcggtgatatctcaaaaggggtaacaactagacactctcataaaacaccccccgccataatatggcatttgtttcattaa

SEQ ID NO: 33572 - DNA, 549 bp, Glycine max
  Peptide Sequence Number=SeqID_125257
atggggacagatcaaactggcaaaaggttttatcaagtcaagattaagggcctagatattaccagcattaaggagttggggtggttgatgggacctctccaaatgcaagccttccgcaaggtgtatgggaagatcttagatttgaccatagcaaagatatccatagaagccattgcatcactcacccaatactatgatcagcccttgagatgcttcacgtttggagacttccaattagtaccgaccgttgagaatttgaggagatctaggatgtcctcttgggggaaggaaaccgtatcttttctccggatttcttccctccttgagcaagattgcagttgtggtcaaggatttggcgagaggattggatcgtgtaaagcacactcgaaacggcatagtgggcctaccacgaaagtacttataagacaaggcgagggatatggcgaatcaacaggagtgggtcttgtttatggacgtattagcattgctaatctttggggttgtcctctttccaaacgtggatggtttggtggacctagccacaattga

SEQ ID NO: 33573 - DNA, 183 bp, Glycine max
  Peptide Sequence Number=SeqID_125258
ggtgtgggggaagggttttgccttgcaaaccttcccggtgatgcttttagtctatgggggaacttctttgaggcaaagaaacaaatgatgccccggaatgccaagtttgcgggggctgcttgggttaagccattgcttaagtttttccatgtgcccggtggtcggttttgggccgtggctaag

SEQ ID NO: 33574 - DNA, 628 bp, Glycine max
  misc_feature (116)..(116): n is a, c, g, or t
  Peptide Sequence Number=SeqID_125259
gaactgtgcacccacaaaaggaagttcaagggaaatgaaaggattagcatgggtagaaaggtgtcagcattgataggtaaatttgttcctcacattcctgagaaatgtaacggacnccagattgttgatgattatatgtttgattttgacaatgttcttcatggtaggaaacatccatttttatctgatttgcatacttgtcattccttatgcattgaatctgaatctgagtttgaatttgattctatgtctgatttttatgctgagaatgaatctgaatttgagtctagttctgattttctgggtgttgtaccttttgatgttgattttttagagtcagaatgcactaaccatgttgcaaaaagtacatatacttctgacttgctttatgaggtacaggctgatgaaccttcttcttttcctacaatggttcctcccactgttcagccaccacccacaccagagttgaagcccttaccagaaaaccacaaatatgcttacttggaggacaaggaaaaatttccagtgatcatctctgcctcccttgttgctgagcaagaggagaagttgttgctagttctcaagaagcacaagaaagccattggatggactttagcaggcattcctt

SEQ ID NO: 33575 - DNA, 91 bp, Glycine max
  Peptide Sequence Number=SeqID_125260
atgcatatgacacagatgcaatttacgaatacgggagcccgaggaattgtttccttcttggatacaacgtttgggcagcgtggcacccaac

SEQ ID NO: 33576 - DNA, 219 bp, Glycine max
  Peptide Sequence Number=SeqID_125261
atggtcatcattctacctaaggaaaaccttgttgtctggttttgttttttgcataacaggctagacaactaccttaagggaataattaacagtgctttgaaagaacttgatgatactccacaacctaaatccaaggctgctgctaggtggattgttgttaagtattttaataatgttagaccattggaagcagagagattgaaggtgcttcgcatctaa

SEQ ID NO: 33577 - DNA, 237 bp, Glycine max
  Peptide Sequence Number=SeqID_125262
atgtctatgctgcagagcctgcaccagggccagctcctgattatgcagagtttgcagattatgcagagtttgcaggatgtggtccagcaacggccatttatgagcctggaggagtttgttcagaagcttgagccatttgcaccagtgccagacctgcctctttctcaggattcaccatcaggcactactacattggacctgaatgagcatgccacagactctgcacaggatcattga

SEQ ID NO: 33578 - DNA, 713 bp, Glycine max
  Peptide Sequence Number=SeqID_125263
atggaaaaacggctttgccgcggccctctcacttccctgttaagtatcctctggcatcttccaaggaaatctccgcccgttcgtaagccatttcccgctcgccgcagtcgaacgaccgagcgtagcgagtcagtgagcgaggaagcggaatatatcctgtatcacatattcctgctgacgcaccggtgcagccttttttctcctgcccacatgaagcacttcactgacaccctcatcagtgccaacatagtaagccaagtatacactccgctagcgcccaatacgcaaaccgcctctccccgcgcgttggccgattcattaatgcagctggcacgacagttagtattatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgttgatgtccggcggtcctttgccgttacgcccacccc

SEQ ID NO: 33579 - DNA, 459 bp, Glycine max
  Peptide Sequence Number=SeqID_125264
atgaaggcacaggccatccagaagcagaatactgccccccacgttttgtctcgtgggggttatgattatttggagcagaagctcgtggctgagaagacaaagaagctgcaagaagctgcacagtcaggaagcgttgatggcatcatcgaccctccatccccggtcagacgccacatgaagtggaagatggcccgcacgaagaagacaggggagatgacgactgaggccgcaaaggaaattgctgagaagattgattcgtttgaggagcaggtcacacagggatcgtttgtctcccatggacgtcaggatgttctggccgctgctattgggacgtccagagcaccctggacgtgtccgtgctgctggagccggtgtcaccatcaagcaatactttggatcggctcccacggacgtcccgtagcgcttcctccctgcctcctaacaaattacagcagctga

SEQ ID NO: 33580 - DNA, 258 bp, Glycine max
  Peptide Sequence Number=SeqID_125265
atggctgcaagtggatactcaggttttcaacatggtcagaactacaaccagcagcaaggacaatggaggactcacccagggaaccaattcaacaaagaccagggtgagccatctaataggccgcaacaacaagggcctaacctttatgaaagaaccacaaagctggaggagacactagctcagtttatgcaggtttcaatgtccaaccataagaggacagaatctgcaattaaaaaccttgaaatccaggtggggtag

SEQ ID NO: 33581 - DNA, 219 bp, Glycine max
  Peptide Sequence Number=SeqID_125266
atgttgacatctccggaaagggcgcagatgaccacattggcctctgctcatcaatcacacttggggtcactgaatgacgagggtcaaggatactcattacatgcagatatacagtattttgatgctagatgggaagttcttgttgtgcttcctctgcgtgattgttttgcccaagagatcaacatgctatgccgccttgatgggtttgtagtcctctag

SEQ ID NO: 33582 - DNA, 400 bp, Glycine max
  Peptide Sequence Number=SeqID_125267
atgaggggccaagacatttatagtagccaagatgaggctactacttcaccttcctctagtaaaagtgaagaagctaaaagggaagaatctagtgaagagatctacccccaagaagaaggacaacctttaatggttaaggaggagtgtaaggagacacttgttagcattgccacatctcttaggcttgagtttattcctcaagtaaaggagttgttggatgagggtttggttcgcaagagattaaatccttgtgctttgttggtgcccaaaataagtattattaggcaccaaatccctaaaataggtggtgtgatgaatgctttgggtggtgcaatactcttttgtaaaatcactcttgcactcaacatcttcatgatttgtgtacatagggactcattag

SEQ ID NO: 33583 - DNA, 318 bp, Glycine max
  Peptide Sequence Number=SeqID_125268
atggagagggagatgataacaatgataatagacacgttaccggtgttctattatgagaagatggtgggttacacgccttcaagttttgccgatttagttttcaccagcaaaaggatcgaagttggtctgagaataggaaaatttgattatcctgctttgatgaataggaagcctggggcaaatgaagagaataagaaggagggagaaacccatgctatgactgttgttcctacatggccaaatttcccactagctcaacaatatcaatactcagccaatatcaacccttctcaatacccaccaccctatcagccatga

SEQ ID NO: 33584 - DNA, 170 bp, Glycine max
  Peptide Sequence Number=SeqID_125269
atgggggtgcaaatagcaaccaggcccacttgggccctccagaagattcctccagaagccgaggcacttccgaaacgtttccgtaacattttcgtgaggaatttcgcgaaggtttcgaccgttcttcgacgttcttcattcgttcttcatcgttcttcgatcttcaacgg

SEQ ID NO: 33585 - DNA, 879 bp, Glycine max
  Peptide Sequence Number=SeqID_125270
atggaacctctccaaatgcaagccttccgcgagacttacggaaagatcttagatttgaccatagcagaggtatccacagaggccattgtgtcactcgcccaatactacgaccagcctttgagatgcttcacgttcggagacttccaattgaattgcaactgtggtcaaggattcagcaagaggtttggaccgcataaaacagactcgaaacggcatagcgggcctaccacggaagtacctagaagacaaggcgaggggtatggccaatcaaggagattggcaatcgacgctttccttgcataccaccatagcaaggaaagtctggtggtagctgtcttggcagatttgtttgacacatttaaccgaaggtgcgaaaagagtagcgcatggatcatatgttgcttccccgccctctgtgtttgggttggtttcacacctgttccagcaagacacgaggcatccatgtccgctcctgagccatcgctcgaaggaaaaaagggagtccttttctcatgtggagggtacccaaacattccgctaataggaacgaggggttgtattaactacaatcccgcgctcgctataagacaactagggtaccccatgaggggagcaccgacggaagaaagcatgtctcctttccttgtaagggatttcggcgcgcaaaatttcaaggctatacaaagaatccataaggcatgggaaaccccgttaaggaaagatcaagaacttaggggcattcgtaacggcatcatcggtggctaccatgaatggctgaaagttcatatacgaggtttagattggctcgccaagctaaaagtcatcagcgaagagagttttgaagcaccggaagaggacgaagaaggtgggatcctctag

SEQ ID NO: 33586 - DNA, 254 bp, Glycine max
  Peptide Sequence Number=SeqID_125271
atgttcggtttaggcaaaggttggaagttacatggaagttacatggaagttattaaaacttccatcaacggttggaaggcaggatttcagaagatggcagaagaagatgcactttctcttgacaacattgaatgtggtgtatgtgctgagtacaccgatgccgatgtttatggaagacgaaactctggatcaagcaaggaagcgttcgaaatgggagaacgacgattacatttgtcgtggacacattctgaacg

SEQ ID NO: 33587 - DNA, 381 bp, Glycine max
  Peptide Sequence Number=SeqID_125272
atggaaatcagagataagcaggaggttgcagagatgggaaaaagacaaagtggaaaaaatatattgattctatgggatgcacttaagcagataaaacaacaagacccagactgtatatggtgctttatgggtgacttcaacaatataaggcatcattctgaaagagagggtatatcacctaggggagcagaagctagtattatcaatgatttcaacgaatggattgccttttctactgggaaacggagagcagaacctaatggatacacaacaaggagtgcataccttttgatgcaaggagaagcaactgaggaaaatagtgaccagaacctaatggatacacagctttccaagcaacactacctgcattcgaaaccctag

SEQ ID NO: 33588 - DNA, 507 bp, Glycine max
  Peptide Sequence Number=SeqID_125273
atgggttatgtacgtaacatgttcagattcaatgctggttgggtattgcctgatgctgattgggctggaagatgttcagatgacagaaaaagcacttctggtggaatgtttcttcctgatgctgggcaacaatcttatttccaacatggttccaagaagcagaactggaagaagaatctgcatgaggaacccattgcgcaacaagttggcacctggcaatatttcaaaaggctcaacagcagaaaagggaaaacccccattgacttaggctggacgaatcaaaactatactagaagaagagcacaccaatcgactcccaccactccagatggagcaaagttgcaatcccgtaagaggaaagaaatctcctcatctgattctgatgatgatgtcgaactagatgttctcacatcaaggcgggccaagaaatcagtttggaaaaaggtgcctggaaagctgatgctccatttgcttaaggacaacatttacattccactccttatctga

SEQ ID NO: 33589 - DNA, 183 bp, Glycine max
  Peptide Sequence Number=SeqID_125274
atggcgaagccgaagaagctcttgcatgcgccatttactttacatgctcaattgattaactatattgatgatgaaattgctaatgcaaaagcaggtaagcctgctcaaatcatcgtcaaacccgggggatccactagttctagagcggccgccaccgcggtggagctccaattcgccctatag

SEQ ID NO: 33590 - DNA, 255 bp, Glycine max
  Peptide Sequence Number=SeqID_125275
atggagaattgcactaagcaatcactacgcatggctccaactcgttggtggaggacgcatgaacgaaaacacaattcatgggactccgaaaaaggattgagaatggagaattgtactaagcacattatggcgcatggctccaaagtcatgggaatggagaattgcactaagcaatcactagcgcatggctccaaactcgtgcgtggaggacgcatgaacgaaaatgcaattcatggggctccgaaaaagggttga

SEQ ID NO: 33591 - DNA, 715 bp, Glycine max
  Peptide Sequence Number=SeqID_125276
ggaattcattgtcaacattccctctgacataacaaacagaaagagtgatgagtatcaaagagtgtttgtcagaggaaaatgtgttagattctcccctgctgtaatcaacaaatacctgggcagaccaacagatggagtggtggatattactgtctctgagcatcaaattgccaaggaaatcactgccaaacaagtccagcattggccaaagaaagggaagctgtctgcagggaagctaagtgtgaaatatgcaatcctgcacaggattggagctgcaaactgggtacccaccaatcatacatccactgttgccacagaatcctttgctgtcaaattacccattgccttcccaactgtattgtgtggcattatgttgagtcaacatcccaatattttaaactacactgactctgtgatgaagaaagaatctcctctatccctgcattacaaactgtttgaggggacacatgtcccagacattgtctcgacatcagggaaagttgctgcttcaggtgctccaccatcaagccaacacagagaagaagatggagctggaacggctgatcaaaggctctcagaaagtggcattgatgatggagaagcagctgaggaagaagaagaagcagctgaggaagaagatgctgcagcagaggaagaggaagatgcagcagaggatactgaatcagatgatgatgattctgaagccaccccatga

SEQ ID NO: 33592 - DNA, 59 bp, Glycine max
  Peptide Sequence Number=SeqID_125277
tcggggctatttcacgaccgatgtcgggtattggagttttcagttcattccctgaatga

SEQ ID NO: 33593 - DNA, 798 bp, Glycine max
  Peptide Sequence Number=SeqID_125278
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaagcgacaaggtgctgatgccgctggcgattcaggttcatcatgccgtttgtgatgcttccatgtcggcagaatgcttaatgaattaccaacagtactgcgatgagtggcagggccggggctggctgctgccagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 33594 - DNA, 450 bp, Glycine max
  Peptide Sequence Number=SeqID_125279
atggaagaggcagagaaagagatcttggaaacgttcagaaaagtagaggtaaacatacctctattggatgcaataaagcaaattccaagatatgccaaattcttgaaggagctgtgtgtcgcaacctacccttcggtgagagggcgacgcgtgactcgcgggatgcgtgttccacgaaaggaatacgcgcggagtcgccaccaacgtttatttgaggaaaacgtcggaataaccggaaaagaaacgatctacgaacttttaagtgaaaggttcgggagttgtatttacgcacggggaaggggagaaacgttaaggcgttggaccattaacgatctctgttttgaaaggagagaaacgttaaggcatggaccattaacgatctctggggtggtcgacaaaagcgggactttgctcctacgtatcctcaaggaggaattcagacctacgtag

SEQ ID NO: 33595 - DNA, 696 bp, Glycine max
  Peptide Sequence Number=SeqID_125280
atgttggtgcgcatgatccgcactcgtctctttgcagcggcacgggtgagatcttgccccggtatacatagtagctgtgtgatagcctccctctctggttgtgctcgcacagttggccctcctccaatatcagggggtggcccaggaaccgttaaaaggaaactactggtgtggatgtcgagcacactgaaaatgaggacacgtagccctctaaaggtgagggcgtgcagccctctcaaggcgaggatgtgtagtcctctagaggtcagggcatgcagccctctgttggcgaggacgtgtagtcctctcaaggtgagggcgtgcagccctctgttggcgaggacgtgtagtcctctaaaggtgagggcgtgcagccctctgttggcgaggacgtgtagtcctctaaaggtgagggcgtgtagccctacgaaggtgaggacatgcagtcctttgagggtgagggcgtgtagccctctgaaggtgaggacatgcagtcctctgatggcgagggcgtgtagccctcagaaggtgaggacgtgtggtcctctgatggcgagggcgtgtagccctctgaaggtgaggatgtgtggtcctctaaaggtgagggcgtgtagccctacgaaggtgaggacgtgtggtcctctaaaggtgaggacgtgtggtcctctaaaggtgagggcgtgtagccctacgaag

SEQ ID NO: 33596 - DNA, 264 bp, Glycine max
  Peptide Sequence Number=SeqID_125281
atggactcgggaaggtccaagttagtgtaccagcatgagggtttttacttgtcgtggaatgcaagaggtgtagctgggggtgatactgagggccttccgaagtgttttcaaggggtataccaccaactgcttgcccttcagtggcatattcgagccaaggctctaagtcggctagattgtaatggggaatttcatgtgtctcccccacggtttaagagacatgtgcatgatcagattgaggttgttggctctcaacgagtatag

SEQ ID NO: 33597 - DNA, 658 bp, Glycine max
  Peptide Sequence Number=SeqID_125282
ggcgtggagaagtccattgaggaaagacaaggagcttagaggcatctgtaatggcgtcatcggtggttatcatggatggctaagagttcacacgcgagggttagattggctctctaaattgaaagttatcgatgaggagaacttcgaagctccggaggaagatgaggaagtccaagctctaaaattagagctagggaaggcaagactcgccaaagaaaacgcggccactgcaaaagcccttgaacaagaaaccaaaagggcccgcacggaggaacatggccgagagaaattccgaggagctttgtggggtagcaacaatgagctcaagctccgaagagaggaaagagaccggtcacgggtgcatggcatgatcttaaaagaagagttagctgcttgcgcaaggtccaagaggagtttggctcaacacttggaagccacggagcaaagcatgctagctatcatagggcagtacaaggaagagttgaaccagtctgtgacccatgaacaaaagctagtgggaggattttgcacaagtgttcgccttgaccttgaatggaagtcaagaccgcccgcgactattagccaaagcaaagccatggccgaaagtgggtacggcccccgagagattcatgggctatcgattactgtcaacacatga

SEQ ID NO: 33598 - DNA, 417 bp, Glycine max
  Peptide Sequence Number=SeqID_125283
atgggtgttaagcgtctcaaagtgatcaaccaagaagcggacgaccatcatcatcccagatatcatcaaacttgttcgcctctggatggtaaaagggacttcgatagtctttggataggaagggtgcgggtgaccatatgttgtctccatgtgtcatcggacttgctgtctctggatgacgaaggtacggataaccatgaggtatctccgcatgctatcggaccatcaagtcacgatagcagaattgtgtgtacggataaccataaggtatctccacatgctatcgaaccctcgagtcacgatagcaaaggtgagactttttcgcagtctctgccggaagacgtcgacatctccgggaagggtacagatgaccacattggtctctgcgtgtcaacgggctcgcttgcctctagttga

SEQ ID NO: 33599 - DNA, 168 bp, Glycine max
  Peptide Sequence Number=SeqID_125284
atgactttgagcttagctcatcagtgggctaagcgcgcatccatcgctaagtgtagcttcagcgcgcttagcgtgatagaagaatctggaagggcatcaatatcaaggctgcatgctaagcgcgagatcagtgcgctaagcgcaacaattttcttcagccaggcttag

SEQ ID NO: 33600 - DNA, 660 bp, Glycine max
  Peptide Sequence Number=SeqID_125285
atggtatcgactattgaagagtttgaggaaatatttggatgccctcttggggggagaaaatcgtatattttctccgggtttcttccctccttgagcaagattgcagctgtggttggagattcggcaaaagaggtggatcgcatgaagcaatctcggaatggcgtagtgggcctgcctcggaaatacttggaaggcaaggcaagggatatggcgagccaagaaaagtggggcccgtttgcggatatattaactttgttgatttttgggtttctcctctttcggaacgttgacggtttggtggacttagccgccattgacgctttcctcgcatatcaccatagcaaggagagtccagtggtggctatcttggcagatttgtttgacacctttgaccggaggtgtgagaaaaatagtgcacggattgtctgttgtttacccgctctctgtgtgtggttggtgcgcaaagtctcaaggttatacaaagagtccacaaggcgtggagaagtcccgttgaggaaagacaaggagcttaggggcatccgtaatggcgtcatcagtggttatcatggatggctaagagttcacacgcgagggttggattggctctccaagttgaaagttatcgatgaggagaactttcgaagctccggaggaagatga

SEQ ID NO: 33601 - DNA, 384 bp, Glycine max
  Peptide Sequence Number=SeqID_125286
atggattgcgggcagcttgaagtgtccataggagggagggaagaaccacaaatttgcatgcagtcggaagagaagaaggaattccctcccgactcagtaaaaggtgccaacatcccgcagcataaagagcccggcccaatcggagcttctcccctccccggctggagttctccaaggggtaataagcgcccatggtccaagagcctcaatagacgtagccacccgctccctcgaaagaagtacttccctcctattcccagtggcataagaggggctccgaaaagaaagaaggtcttcataggaaagacggtgactttggaagaggcccatgaggttccttcgcccctctccaacaaagtgagtttaaggtgtcgagcaacgtga

SEQ ID NO: 33602 - DNA, 225 bp, Glycine max
  Peptide Sequence Number=SeqID_125287
atgtggctcagcatgccaccggtctcttgggacacggtaacaaaaagtggggtggtcgacaaaagcagggcttttgctcctacgtatcctcaatttgtgatgaggaactcagacctacgtagttcttgccaactaggaagcactgggttcaacaaaaatagaagaaaatcactcaaagtgtatcaatctcacacagtgcggggcgagaaagtcgctagcgcataa

SEQ ID NO: 33603 - DNA, 204 bp, Glycine max
  Peptide Sequence Number=SeqID_125288
atgtttggcgaaggaaccaatcgggaaaatagcaaaaaaccatatttcccagtcaccggaggctccgtgcttgataacggaggacacatgaacagcgctaggcaatcaattcatggggctccgaataggaaagtggaggatacacgaacagcgctaggcaatcaattcatgggactccgaataagatttgagggtggaggatag

SEQ ID NO: 33604 - DNA, 861 bp, Glycine max
  Peptide Sequence Number=SeqID_125289
atggcgtgtagtcctctaaaggtgagggcgtgtagccctctgaaggtgaggacatgtagtcctctgaaggtgagggcatgtagccctctgaaggggaggacgtgtatccctctaaaggtgagggcgtgtagccctatgaaggtgaggatgtgtagccctctgaaagggaggatgtgtagtcctctgaaagcaaggacgtgtagccctatgaaggcgagggcatgtagccctctgaaggagaggacgtgtaaccctctgaaggtgaggatgtgtagtcctctaaaggcgagggcgtgtagccctctgaaggggaggacgtgtagtcctctgaaggtgacgacgtgtagccctctaaaggcgaggacatgtagtcctctgaaggtgaggacaagtagtcctctgaaggtgagggcgtgtagttctatgaaggtgaagatgtcttgccctctgaaggtgaggacgtgtagccctctgatggcaaggacatgtagtcctctgaaggggaggacgtgtagccctctgaaggggaggacgtgtagtcatctgagggtgagggcgtgtagccctacgaaggtgagggtatgtagccctctgaaggggaagacgtgtagtcctctgaaggtgatgacgtgtagtcctctgaaggcgagaatgtgtagccctctaaaggcgaaggcgtgtagtcctctgaaggtgagggcgtgtagccctctgaaggtgaggacgtgtagtcctctgaaggtgagggcatgtagccctatgaaggcgacagcgtgtagccctctaaatgggaggacgtgtagtcctctgaaagtgaggacgtatagtcctctgaaggcgaggacgtgtagtcctctgaag

SEQ ID NO: 33605 - DNA, 465 bp, Glycine max
  Peptide Sequence Number=SeqID_125290
atgtcggctttgaaagagcaaatggcttccatgatggatgccatactaggaatgaggcaactaatggagaataacgtggccactgctgccgctgttagttcgactgccgaagcagacccaactctcccagctaccgcacgccatcctatcccaaacgtggtaggaagagaaagaagcacactggggcacatcaaaaacccccatctgggatacaaccgagtggcttacccttatggattaccacttaattacacggcaccagtcatgcgtgatgacgcgggtcatatccctttccccatccttgaaggggagcctcctcgacagtcggacgaggttcacgaggatcatagagagcatgcccaagaagacatcgattcctactcctcggtcctcgtcgaggggccaacacttaacacactacctcagcccaacctcacgggagaacctcgaaacctcccagcataa

SEQ ID NO: 33606 - DNA, 231 bp, Glycine max
  Peptide Sequence Number=SeqID_125291
atgaccaaagtgaacaaagagccatttctagggattcgatttggccaaaattggatgaaggcaagagagcttgggaggattgatggggactcggcgttgagaggaacgaggataagggctacgtgggagtatgtgagctcagttggaggtgggcaacaggggatggtgggtttgtacgtgatttgtggatgtggagaacttgttttacaccatcgcccgaccgtcacctag

SEQ ID NO: 33607 - DNA, 198 bp, Glycine max
  Peptide Sequence Number=SeqID_125292
atgggtgccaaatacctcgaagcggtcgaacgagggtcacatcccaacaccggatggtccccggacaaaattaggatgcagaatggccataatttgtctctgcattttgttggacacgatcgagcctgggcgacgagacacagaatgaccataatttgtctctgtgtgccaccggacacgattgcctctggatggtga

SEQ ID NO: 33608 - DNA, 442 bp, Glycine max
  Peptide Sequence Number=SeqID_125293
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggttaccggtgtcattccgctgtatggccgcgtttgtctcatccacgctgacactcagttccgg

SEQ ID NO: 33609 - DNA, 549 bp, Glycine max
  Peptide Sequence Number=SeqID_125294
cgacgacgaagcccggtgaacggcggcgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctg

SEQ ID NO: 33610 - DNA, 160 bp, Glycine max
  Peptide Sequence Number=SeqID_125295
gccacctaatctgtctcagaaaaacgacgatctcggactcgttcaccgttggatcgtcgtgaaatttgagcaccacgttcgcaacccaattacgagaattctcaccgttgggaattttgatattatgtctgagctaagagaaatacccctcgcattgtag

SEQ ID NO: 33611 - DNA, 411 bp, Glycine max
  Peptide Sequence Number=SeqID_125296
atggctggagataaaggccaaaccgctctttacggaggaacaagggtttccaaggccagcgccagagtagaaagttatggtaatatcgatgagttgaattcttttattggcattgcaaaaagtcatattgaagatgttgaggttttaaagcaattgaagaaaattcagtttgatttatttacagtgggctctgaagcagcaactccggttgataaattaatgcttgccaatggaaaatccaggcttccgttgattatttcagaaaatgagattgaagaattagagcattggatggatgattttgatacccaactggagcctcttcaatattttatacttcccggtggcggaaaatctgcgacatttcttcatgcagcaagaacaatctgcagaagggcagaacgttctctg

SEQ ID NO: 33612 - DNA, 729 bp, Glycine max
  Peptide Sequence Number=SeqID_125297
atggcgaaaccttttaatagaacagttactttatttggaatatataaacagcttattccatttataaggccttatcgtttgatgatttacggaactttattcctgacgtttttaggagctcttgcagcccaggtcaatcctttggttttgaagtatactgttgacaaggtaaccctactaacacatcttccacatcctatgtcggaaggaattcatgtgttggtagtgatttccataatattactgggaaaagaactgttgaatatttttatcaatttcggacagaaattctatggggaaaagatccggatcaatgtaagttctgttctggctcagtcagctattgataaaatactgacgtaccgggttgcatattttaatgatgaaaaccacgaatcaggaaaattgcagatcaggatcgatcgtgggattgaaagtctcaccaagcttgttcagaattttttcatagatattttgcctctcttttccaatgcgatcattgctttgatcatcatgtatatgcaaaatgctaaaaagctgggtggggttcgcaggcagctgagaaatcagcgtgagcaaaagacttcgggccttctgaacctgatcaattcgattatggtgattaaaagttttgtccgtgaaaaattcgagggtaaaaagcagtatgatcttcagatgcaattaatggagagccagatggttcaccagaaaaacaaattttatttatga

SEQ ID NO: 33613 - DNA, 198 bp, Glycine max
  Peptide Sequence Number=SeqID_125298
atggatctgaagaagctcgcttatcagaatgagcctttcatcatggcagaacaagctaaacaagtattttatgttcaagatccttgtgatgaaagatggcacatggctacaccacccagctcacctcctcatcctcctcttgagtcaacagcaccttcttcattgtctacgtcgaagaagacaagaaaagaaacatga

SEQ ID NO: 33614 - DNA, 672 bp, Glycine max
  Peptide Sequence Number=SeqID_125299
aattcctgggctccgttccaaactcgccatgacttcaatgctgcggccttggcggtagacgctatgttgaacaacacacagattgatgcccttatcagtcttattggtaatgcatcggatgatggtggtggtggtgtattaaccatccacaatcacaaggagctgaacgagatctgggaggatgtggagtacttgttccttaaagaaactgtttccgctgtgtatgatcaagaaaccttgtcctttgaagtttggtaccgaccactatggaattgggtgaccgccttggttacagaccccaaactgggaaatgcctttgagtgggacgcaaaacgactccacaaatttaatggcaaggagtggattcagttctatcacgaaccaacaacggcagatctaatgtggactattcaggataactgtacagtacaccagccacaggtccaaacaaatatcacaaggagtcgtgccggcgacctggggaagtggggacaaggagtaatgaagtgggaaaggaggatagaggtagcccggacgagccccaaagtgtatctacgagttcgagcaagtccgaagcgtccaagcaagtctgaagtgtccgagcaagtccgaggcgagtccaaagtgcgggaagacttcggagtcaccggacgaagctcggatgcgaaagga

SEQ ID NO: 33615 - DNA, 252 bp, Glycine max
  Peptide Sequence Number=SeqID_125300
atgggcagagacgggggtgcaaaacaaaccaccgaacgaatgaggcaccactggcctcacactttaggcggtaccagcaggatcggtgttaccagatgggatgcaatcttcagatattgcatgaacgttcgccaagatcattcaaccactggtcacgtggctcctggtggaactcgggtctccatcttctacgatgttcccgaatccaacagcaggccagcgatctattatattaagtctcgatccgtgtga

SEQ ID NO: 33616 - DNA, 222 bp, Glycine max
  Peptide Sequence Number=SeqID_125301
atgatggtcaactacgtccttagcgagcctcctcatgtgaatctctacgccaaatacgccgctaaacggtatatgaaggttagtgtctatgtccgccaatgggcgctcaaccactggtctgaaggcgatgaaattaacctgatcgacgacctctccatgctcaaaatcgaagcaagagaactacgactcaaagctgaagaagaggccgaaatacccgtttga

SEQ ID NO: 33617 - DNA, 594 bp, Glycine max
  Peptide Sequence Number=SeqID_125302
atgtggaacaagttccaaaacactatcgctgaggagcgcgaaagttacgctcgattggaagagtcgaggaaggctctcgtggtccaacaacgcacggctcaagcagagatcgaaagtcagcgatcacaacttcgcgaagcctcctcgtcaaagaagcagctccagagcgaactctcccagttgcaacaggaagtggctgtcgcgaagaatgaagcctcagagcttcgtgctgtaattgagacataccaggccaaagaaggagaataccgaagcaaacttgaagccgctgagatcgcccgtgccaaggcggctcgtgctgaggctcatggtacctgtattttctatgtctctctccacgaggctgactccccttttgtagctcgtcgcagtcttactgacatggaaaagacacatgcccaagcagtagaagaacggaatgcctccgaagcccgcctccaagcgactgagaagaaactccgtgagctggagaataagttcgaggaagagaatcgtgaggccacagatctgagcttgctgcatcagcgtctggtagagaactgcaagacgaacgaaagcagcaccaggaagatctga

SEQ ID NO: 33618 - DNA, 438 bp, Glycine max
  Peptide Sequence Number=SeqID_125303
atgaccaggagtaggacaaaacagtcagtggataccctccaacaaatggtagtaggcatacttaacaaggcccaagcggagaaggatgaaggcccaagtggagaaggacgaagacccaagtggagaaggatgaaggcccaagtggagaaggatgaaggccagagtaaggatcacatcaggcgaggtcaactgaatacaaccctaactaagatcgtcccaacacaaccattgtcgatatcgaccaaacacaaccttggtcaaggttggtcgaaaagaaccctaattgagcctagtcgcggtcagctgaaaatacccctagccgaggtcggccaaaagttaaccttacttgaggttgaccgaaaattaaccctacttgaggtcgacgaaaaacagtttggccaaggtcggccaaaaacagtcttggccaaggttggttga

SEQ ID NO: 33619 - DNA, 273 bp, Glycine max
  Peptide Sequence Number=SeqID_125304
atgggtgccaagtccctcgaagtggtcaaacgtgggtcgcatcccaacaacggatggttcccggacgaaattagggatggtattttttttgactgtatttctattcattactttgtcctcttttctttgactaaattacccaacgtaggttacggcacctttgacccattgttgagactcggaaatttgattttaaccgacatgattaacggtatgtacaatgctggcaaagacggtgatcggctggacaatttattttactttttagattaa

SEQ ID NO: 33620 - DNA, 171 bp, Glycine max
  Peptide Sequence Number=SeqID_125305
atgcatggctccaaactggaaggtggaggacacatgaacgaaaacgcaattcatggggctccgaaaaaggcaatcactacgcatggctccaaactcgaaggtggaggacacatgaacgaaaacgcaattcatggggctccgaaaaagattgagaatggagaattgcactaa

SEQ ID NO: 33621 - DNA, 489 bp, Glycine max
  Peptide Sequence Number=SeqID_125306
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcacggttcctctcgtactaggttgaattactattgcgacactgtcatcagtaggtaa

SEQ ID NO: 33622 - DNA, 460 bp, Glycine max
  Peptide Sequence Number=SeqID_125307
cagggccctgggatttccctcgctgatcacaggactctgccagtcattcggagtccgcgttgcacctaccaaggtaattcagccgcccatcacccggacttttattgagaagtactgtacccagagacaggctcatggtgatgctccacaggccgcaggcgcgccaccaccacctcatcaggctggccaggctggggcatttgacatggagcagtatttacggcatttggttcgccagcaggcggccaaccaccgagcacataggcagggcttcgttttactttttccgtgccctactccggaccaattagtcagggcagaggtcgcatggcccggagattggcccgaggcccgtgcaggagaggcaccagcagaggctcccgacgaggcagatgaggcccacgaggatgaggagatgaccgattttcttgatttcttaagagggagcggagccacatga

SEQ ID NO: 33623 - DNA, 522 bp, Glycine max
  Peptide Sequence Number=SeqID_125308
atgacgtctgaggcagcaaaggaaattgctgagaagattgatttgttggaggagcaggcgtcacaagaacaccttggtcgtgtgcgtgctgctggagccggtgtgaccatcaagcaatactttggaccagctcaacggacctcccacactttttccttcatcgctcctgaagaactagagcagctaactcaaaaaataagggaccaactagaggagtcgatcatagaaaaagtgacacgacagctgatgttatccttcagccagatgcagtcccagtttcagtcacaaatgcaatcacagggacttgcactacctccggagcctgaggttggtccctcagttgctcgtgtcagcacaaaggggagttatgttgatctctcagcgaccgatccagacatgggtaactcaaacaaatgtgggttgtacatcgaagaaaatcctccctgcctggttgccctaggaagagtttatgagggatccacattcattcataacatccctttgttgcatgatcaagtgaag

SEQ ID NO: 33624 - DNA, 390 bp, Glycine max
  Peptide Sequence Number=SeqID_125309
atgcgagcggggaattctgatatctatggattcctcaagccacagtccattcagaggtctgggcaatcgcagtttgagtctgaaagttacataaagacttggatgcagagttcaaaatgcgatgtctatcttggagcctacctaaatggcctaaatcaaaggcttctgctaggtggattgttgtcaagtgtaatagacaaaaaggaagtactaagtgtggctactatgtcatgcactggatgtccattcctcattttaggatcttttaggaataactgggtaagcgttgtgtctccggcaaaacaacctccgaagcccgattcggaggtcgatgatccgctttatctgatgacattgaccatcccagagcttttcttgaggccttattag

SEQ ID NO: 33625 - DNA, 501 bp, Glycine max
  Peptide Sequence Number=SeqID_125310
atgactcgcagagacaaaatttggtcattctgcacccttgtgtcatccagaggcggcgggcccgatgacacgcggagataccttacggttatccgcatccttttgtcatccagaggcggcgggcccgatgcacgcagagacaaaatttggtcgttctgcacccttgtgtcatccagaggcggcgggcccgatgacacgcggagataccttacggcggcgggcccgatgacacgcggagataccttacggttatccgcacccttttgtcatccagaggcgacgggcccgatgacacgcagagacaaaatttggtcattctgcacccttgtgtcatccagaggcggcgggcccgatgacacgcggagataccttacggttatccgcacccttgtgtcatccagaggcggcgggcccaatgacgcgcggagataccttacggttatccgcacccttttgtcatccagaggcagcgggcccgatgacatgcagagactgacatag

SEQ ID NO: 33626 - DNA, 231 bp, Glycine max
  Peptide Sequence Number=SeqID_125311
atgcggggttaccttatggttacccgcacctttggtcaaccaggggcaaacgagcccgttggcgcgcggagattaacatcgtcctcggcacctttttccgtcttgacccgtgagggttaccttatggttacccgcacatttcgtcaaccaggggcaaacgagcttgttgacgcgcggggactaacaccgtcttctgcaccttttgtcgtcctgccccgtgaagtcaaatga

SEQ ID NO: 33627 - DNA, 369 bp, Glycine max
  Peptide Sequence Number=SeqID_125312
atgggcatcattgaggacttttatcaacagcgtgcgatgaggctcggagtttatgagcagttcaagcaacgagatcctcgctggaaatttattcagttgctcgactaccttaaactcactttgttgaatgaggcgaaggaactcatgggcctcttccaaagtcaccgtctttccttgaagaccttctttcttttcagcccctcttaccactggaggatctgcttctttcgagggggtggctacgtctgtgggctcttggaccatgggcgctttccccttggagggcaactccaccgggtgaggggaagcgaacacccgaccactgcgggttacgccactgaggccggtgatgttggttaccttagctga

SEQ ID NO: 33628 - DNA, 340 bp, Glycine max
  Peptide Sequence Number=SeqID_125313
gagatttagggataaaaaagaggttgcagaacctgaggtagacccagaaagggaccagagaactgtttttgcctaccagttgcttttaaatttgatctacttttgccattggaactgtgatgacttgcctattgaactattttttctccattggaactttattgacttatgttgccaacttcttcttggacaacttgtaatggtgaaaccttctaaagctgaaaagaaccttgttcaatctaatgcttctggtggagcagccggtgtaactggcccctatggagctgtggaccgaaaattgtatgtggggaatcttcacttcaacatgactgagagttag

SEQ ID NO: 33629 - DNA, 569 bp, Glycine max
  Peptide Sequence Number=SeqID_125314
accacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatgacattcactggggaagcagaagtccttttgaaggaagctattcaagaacagatggaactctttttactacaggaacag

SEQ ID NO: 33630 - DNA, 189 bp, Glycine max
  Peptide Sequence Number=SeqID_125315
ggaattggaaaggaggattggtgtcatcccttgaagaatttgagtcaagaagcaagaggccaacctgatgcaatcctccccaggaaaggaccagttaccagagccataagcaagaggctccaagaggattgggctagagctgataaagaaggccttaggattctcataaaccttagggtagatttttga

SEQ ID NO: 33631 - DNA, 330 bp, Glycine max
  Peptide Sequence Number=SeqID_125316
atggcctgcctggggctaagcatcaactccgtccctgtgggctttgaggagcgggagaaattgttggaattctatgaaagagtctcgggagccaggatgcatgccagtttcatacgaccaggtggagtggcacaagatctgcctcttggcttatgtcgagatattgattccttcacacaacaatttgcttctcgtatcgacgaattagaagagatgtcaaccggcaaccgtatctggaaacaacgattagtggatattggtactgtcactgcacagcaagcaaaggattggggattcagtggtgtaatgttaagaggtcgtgcgacatga

SEQ ID NO: 33632 - DNA, 120 bp, Glycine max
  Peptide Sequence Number=SeqID_125317
atggaaatttatatgataacaaaagatgatgacaaaggtgatgacaaaaagctcaaaggtcaatcaaagaatgagttcaagatattcaagatagaatcaagaacacttcaagattcatga

SEQ ID NO: 33633 - DNA, 576 bp, Glycine max
  Peptide Sequence Number=SeqID_125318
atgtcggctctgaaagaacaaatggcctccatgatggaggccatgtttggtatgaggcagctcatggaaaagaacgtggccaccgctgccgctgtcagttcggctgccgaagcagacccaactctcttggcaactgcgcaccatcctccctcaaacatagtaggacggggaagggacacactggggcacgatggcagccctcacctgggatacaaccgagcggcttacccttatggattgccgcccaactactcaccacccgtcttgcaagacgatgcgggccatattgcttctcccgtccttgaaagagagcctcctcaacagcccgaagaagtccacaaagaccctcaagactatgctcgaagggatgtcgagttctatcccccgatccccgaagggccggcacccagcacgttgcctcagcccaacatcgcagcacaaccaatagccttgtccatggaaggaccgttcccggcaactgaagaaaggaggaagctcgatctccttgaggaaagattgagggccgtggaaggatttggggactatccgttcgcagacatgacggatctttgctta

SEQ ID NO: 33634 - DNA, 318 bp, Glycine max
  Peptide Sequence Number=SeqID_125319
atgatacgcggagataccttacggttatccgcacccttttgtcatccagaggcggcgggcccgatgaaaagcagagaccaagtttggtcattctgcacccttgtatcatccagaggcggcgggcccgatgatacgcggaaatacccgagtggttatccgtataaacattcttttgctatctcacccaggcccacttgggccctccggaatattcctccagaaggcggttgcttctggaggaagcaaccctgctcgcctgggcgagctgagctcgcctgggcgagctgggcggcaacctcctcccctattttgctataa

SEQ ID NO: 33635 - DNA, 945 bp, Glycine max
  Peptide Sequence Number=SeqID_125320
atgccagccacagcaggaagggttcgtatgcctgcgaacaatagggttcacagcagtgcagcgcttcaaacccatggcatatggcaaagtgccattggctacgacccttatgcacccaataaggaagataagaaggattcttctcaaaatctgccaaatgcagaacctgatgctgagaatgcatatgctagcttccaggggcttctacagcttgctaagataacaaatgctgaggtggatgtatcccgtggggcctgcaaaaagtgtggccgtgttgggcacctcaagtttcagtgcaagaactatgtgaaaatcaaggatgaaaatgagaaggatcctgaagcaatgcagcctgtggggttggttggattggataaaaagttgaaggctggcaaggtggataggggaagcaatgttgagagctctgaagaggaggaggaggaggatagtgaaagttcagattctgagattgattcggagattgagagaattattgctgaaaggtctgggaagaaaattagtgggaagagaggttcttctagaaagaaaggggatttggatgatgatggatcagacgaagattcaggcaagaggagaaagagaggtaggtcaaagaggaggagtgccaagagggaagttagtgattccgatgattcaggtgaagaaaggaggaggaggaagagaaggtgggaacccaggaggaagagggacaattcttcagatgaagacgatgagtataggcacaggcatagaaagagtaggaaggagaagaggagaaggagaagccgactatcagattctgattcctctgaagattccataagaaggcacaagcgaaagaacaagagggcctcatcatcatctgacactgattcaaggaggaagggtaggaatgtcagtaaatcagaaaagagaaggagccgtcacaatgcgaatgatgaatga

SEQ ID NO: 33636 - DNA, 456 bp, Glycine max
  Peptide Sequence Number=SeqID_125321
atggggatggaggggtttaaccgaagaggaaagttcaaatctccggtagaagctggggataaggtaaaattttgggaggataggtggatttgtcatgagcaatcactagctaaaaagtatcctaggctctacatgatctcttctcaacaaaaccagcttattggacaattggggaagcataataactctggttgggagtggaattttaattggagaagaccgttgttcgatagtgaaattgaattgactatcacttttctttctgaagttgaaggtaagtctatttacaatcagggatctgatagctgggaatgggcagcagactcgtcggatatctattctacacatagtgcttattcaatgttttgggaggaggcatcagttgagagtactgaggaatgttttgaggagctatggaaaatcaagattcttagtaaaatagcagtttttgcatga

SEQ ID NO: 33637 - DNA, 375 bp, Glycine max
  Peptide Sequence Number=SeqID_125322
atggatgccatgacactgtcactcccgctccctccggttccggtctgtacagtgcccgcgtctgcatcaacctcgtcctctgtttctctcactcactcctggtcggccacggccaggcagaggctctcctctcacagaacaagacccattttccggaattattcctctgcggttccaaaacttacagtggtgacatgcggtgcggctgtgacggagatcaacgagacccaattcaaagacacggttctgaaggctaaccgtccggttcttgttgagttcgtcgctacttggtgcggtccttgccgtctcatctccccctctatggaatccctcgctaagggctggcttaaggcccacgtaagggctttaggttaa

SEQ ID NO: 33638 - DNA, 264 bp, Glycine max
  Peptide Sequence Number=SeqID_125323
atggatgccttcagagcaaaagaagcacttaggggggtgatgatggagcctcaatccactgaaagttctgccttaattgcacaaaaggaaaagaagattgatcaatgccaagacacacccaagacaaatgctagaaacttcatggtaagcctccaaatcagaaccaaaattggaccaccaaaggtactcaacaaggagaaccagcacaagcccacctgggtcagtaaggtgttacagcaggcagttcttccagaccccttatag

SEQ ID NO: 33639 - DNA, 1293 bp, Glycine max
  Peptide Sequence Number=SeqID_125324
atggagaacgacactgccgccgccgttaacaataacaccaccgccaccgccaccgctaaagcaggttctggaggagtgaaatcgaacaaccataacctagaagaggagcattccaatttgaatggcgaggagcacatggcagaacaagtggaggcagaagaagaggaagatcgagaagccgatgatggtgaaggagaacaaactggatctcgtcaaccttccagaacccctttcactaatctcagccaggtcgatgctgacctcgctctcgctcgaacccttcaggaacaggaaagggcatatatgatgctgagaatgaataatgaaggaagtgattatggaagttgggaaggcggaagctatttgcatgatgaaggagatgattttgatgatctacatgatggcactgatgtggatgaggatgaagatgatgatgatgatgaagatgatgatgatgaggaggatgaggatgaagatgcatttgatgtccatgctcatgctagtgctggagaacatgataatcccactattgaatttgacccagatgtattttcaagtgatgaagcatatgcaagagcattacaagaagctgaagagagggaaatggcagctagactattggcttttgctgggataaatgatcgggaagaagaggacatagaggagcatggtgctaattctcagcggcacctttctgtggcgatgacctctgttgtgggtcggattgaaggagtggccgtcgcgtccgctatcacgctggtgcggggtggccctatcgcggggttggctgctcctcgctgcgacaacaatattgacaactatgccctaaaaagctctacatctttagcagaacaaagggtggtaaaaaagaatgagtcttgcaagctgccacttagaagccttactcttggcacaatggcaaggctgttgccttgggatgcttgggaggatgttgatccagatgaactttcatatgaggaattactggcattgggtgaagcagttggaactgagagcagaggtctttcaactgatactattgcctgtttgccttcagtcaactacaagactgggagtgatcaacatggaagcaatgattcgtgtgtcatttgccgggtggactatgaggatgatgagtccttgacagttctttcctgcaaacatctgtaccatcctgagtgcattaacaattggttgaaaataaacaaggtggtagttctagtttacagttccattaggtccttaatacatgctcctgtatgcatctggttggataatgcttttgtgtcctaa

SEQ ID NO: 33640 - DNA, 108 bp, Glycine max
  Peptide Sequence Number=SeqID_125325
atggatgttagacgacttcaaaatgtgagcaactctttcaatggatgtgagcaacggaaggggaagggagtgcaaatagtgcgagtgggagaaggggaactattttga

SEQ ID NO: 33641 - DNA, 159 bp, Glycine max
  Peptide Sequence Number=SeqID_125326
atggttgatggagttagaagtactattactgatatccatgaagacttgggttattttcaacaaacagtggaaacattgacacataagactgatatggatgcagcgcagagcttcatagagattgcaagaatctgttcagtattcactaatcaattctga

SEQ ID NO: 33642 - DNA, 696 bp, Glycine max
  Peptide Sequence Number=SeqID_125327
atgatgcttcttcggagaattattgctgcatgtcctcaatcaaagaggatgttcagctcttctgttacccatggctatgaaagtgctattcaagaactcaacaaggaaatggaatcggtattcggtgaacctcctacaaatggactagctagctctgcaagcaatagtcggttgaacaatgaatcccagctgtcatctccaaacacaggtgaaagttcttttgaattgactcatactggcgaatcaggggaagctcaaatggtagatgtgtctccaaaagaaagcagtaaaagaactgccattgctgtttgcaaggtaattcttggaaagaaggtgtttgatttggtcttggccaatcaaatggcgaaaggagatgtgcttactgtagcgaaaattgcgggcataaccgcagcaaagcaaactagcaaccttattccgttgtgccataatataagcctttcacacgtgcaagtggacttgagattgaatcatgaggacttcagtgtaacaatagaaggggaagctgcatcaaccggtaaaaccggggttgagatggaagcaatgacagcagtctctattgcaggcttaaccgtgtatgatatgtgtaaggctgcttcaaaagatatagccattacagatgtaagacttatgcataaatctggtggaaaaagtggagagtattggtggacacaatga

SEQ ID NO: 33643 - DNA, 258 bp, Glycine max
  Peptide Sequence Number=SeqID_125328
atgaggttcttcatagtcatccacctattcatttggtcccccgaacacaagttcaagatcatcacaggatccaaacacaacaacacacagggaggagaccagtcagggtcacaatgttttgcgagaatgctccaaccatatgggatcaacatagacttaaaggagcactcaaaccttgtgacccccaaggcctacactccgaagagtccgtcaaggcctctccctcctgattcaggtccaacccagaaaatattttag

SEQ ID NO: 33644 - DNA, 1257 bp, Glycine max
  Peptide Sequence Number=SeqID_125329
atggcttcgaattcgatcgacggcgacgccgttacggggtcgggactgtgcataaacgacgtgttaagggacgacgagctgcgttccattctggggcgagtggagagcgagaaggacaaggaaacgttcgggttggtctgcaagcgatggcttcggttgcagagcacggaaaggaagaaactcgccgcacgtgcgggtccccacatgctccgaaaaatggccgataggttcacacgcttagtcgaactggacctcgctcagtccgtctctcgttccttctatcccggcgtcaccgattccgatctcgccgtcatcgccactgccttcacttgcttgaagatcctcaatttgcataattgtaaaggaattacagatgctggaatgaaggctattggtgaacatctttccttattacagtcgttggatgtgtcttactgtagaaagctgactgacaagggattatcagctgttgccaaaggctgttgtgacttaaggatattgcatatggcgggttgcagatttgttactgatggtgtattagaagctctctccaaaaattgcggtaacttagaggagttgggattgcatggctgcacaagcattactgacaatggactgataaaccttgcaagtggatgtcgacggatcaggtttttagacataaataaatgtagtaatgccactgatgttggggtttctagtgtttctagggcttgttcatcttctctcaagacattgaaattgttagattgctataaaattggggatgaaaccatattatccctcgccgaattctgtggtaatctggagactttaatcattggtggttgccgggatgtctctgctgatgcgataaggtcgctggctgctgcatgtggaagcagccttaaaaacttgaggatggattggtgtttaaacatttctgattcttcattgagctgtgttttaagtcaatgcagaaaccttgaggcactggacattggttgctgtgaagagttgactgatgctgcttttcagctattaagcaatgaggagcctggattgagtttgaagattttgaagattagtaattgtccaaagatcacagtggcaggtataggcatcattgtgggtaaatgcacgtctctgcaatacttggatgtgaggtcatgcccgcatattacaaaggctggcctagatgaggctggtttccattttcctgaatgctgcaagattaattttaatggtagcgttaatgagcctgttgtgcttctttga

SEQ ID NO: 33645 - DNA, 630 bp, Glycine max
  Peptide Sequence Number=SeqID_125330
atgcagacttcacttcttcaagttgttggaactccagtcatctcagcaacatatgatcagcttcaaaagtcagttaacagatacttacctggtcctgccactcaatgccaatattcaaccacaacatcaaagcaaatgagactggggacaaacatatctgaaactgttaagagaaagctaagtttaggggctcgcattcttcgagtgggtggagtggaaaaagtgttcaagcagttttttagcatgggagaaggggagaggctgttgaaagtttcccaatgttatctttccaccacatctggtcctctagcaggtttcctcttcatctccactgacaaggttgccttttgcagtgagagatcaatgaaagtctttactcagaaaggtcatatgttgaggattcgttataaggttaccattccactaaagaagatcaagtgtgtgaaccaaagtgctaatgttcagaagccaacacagaaatacatagagattgtcactgaggacaactttgatttctggtttatggttattgatgtcactgtatccatcttatcaattaggattgctctaactgtgagattgaatctgaaacggacaagtttggattgtccaaatgatacagatatatag

SEQ ID NO: 33646 - DNA, 528 bp, Glycine max
  Peptide Sequence Number=SeqID_125331
atgcagcagccggagaagcagattaacgcgccagccggaatgcctctcccggagcgccggagaaggcgacggagctctggtatatgtgccacttccggtgttagggttcagccacaagaagaacaacaacaagtggcaacgcgtgggactgttcttacagactctgaccagttctatttcaactggtatgctcacattgacgttcacgaagagatgatcaaggatcgtgtgcggactgatgcttataagaatgcaataatgcgtcataaggattttattagagacaaagttgtacttgatgttggatgcggcactggcatccttgctatattttgtgctcaggctggtgcaagacgggtgtatgcagttgaagcaagtaacattgccctgcagacaatccgtgttgttgaagctaacaatcttttgaacattatcacggtattgcacggacgagttgaggtagggtactctgaccaatatattttactctttgaaagaggtactataactttcaattttatattatga

SEQ ID NO: 33647 - DNA, 1473 bp, Glycine max
  Peptide Sequence Number=SeqID_125332
atggctgaaaccaactattttgcaagtaacagatcaagcatgatcacaaggcattggatttggaagtatatgagtagtgttggtgagaaagtgaaaaggtattcaggtttggcatggagaacagcagtgaaacctttgttcaaagggattggacaaaatgccatgtcagctgttctcactgtggttgtggtgatggagtttactgttggagcaacattaggcaaaggactgaatagagggttggggactctgctggcaggatcattggcatttcttgttgagtatattgctgacatcgttggtcgggtttttcaagctgttttcattggtgctgcagtttttattttaggagctacgactacttatgtgaggttcatcccccatatcaagaagaattatgactatggtgttatgatatttctcttgactttcaatttgataactgtatcaagttaccgtgttgataatgtgtgggaaattgctaaagatcgtatagccaccattgctataggtggtggcctatgtcttgtaatgagcctattggttttcccaaactggtcaggggaagacctccataattccaccatatcaaagcttgaaggcctagccaattctatagaagcttgtgtagtgagatattttcatgattctgaaaatcaagaaacccaagatgattcaactgaggatctgatttacaaaggttacaaggctgttttagattccagagctaaagatgaaacactggcattacaagcaagctgggagccaagatggtcaaggtattggcacagaatcccatggtggcaatatacaaaagtgggaactactcttcgccagtttagttacactgttgttgcactacatgggtgtctgttgtctgaaattcagacaccggggtcaattcgagccctatacaaagactcttgcatcaaacttgcagaagaagtgtctaaagcactaagggaactggccaacagcataaggaacaaacgtcaattctcccttcaattactctctgataatctcaatgaagctctacaaaacctccacaatgacttgaaatcccagccacaactttttctaggctcaaagaagtttggtggaaccacacatcctgaagaagacactagagtctcattctcaagtgttaggagtgattgttcttccatgtttgaatataaatccaaagagcattctggtgaaatgtcaatggagggacacaagaaggttttaaagccactgatgagtaagattgcgatgactagccttgagttctcagaagcactgccttttgctgctttcacttctatgcttgtggagatggtggcaaagctggatcatattatagatgcagttgaagaactggcaaaattgtcacgctttagagagttcagagatggtgatgagattgttgtgacttgtgagagaccaaaagtagctaacaatgacttgccttctcatgcattagattaa

SEQ ID NO: 33648 - DNA, 987 bp, Glycine max
  Peptide Sequence Number=SeqID_125333
atggcagcagccactctctccgtccggcccgaccgtctctcgcccggttcggtgtttcccagaccaccggttcagcctccgctgcgaaaaccaatcgcggcgcccgagccgtggcgcgccgcggcgccgcggatacgcatcaggacggtggcgccggtccaggcgagctcgcgcgccgatgactccgcgccgttcgagatgtcggtggagaacgcgctgaagctgctgggcgtgtcggagggcgcttccttcgacgacatactccgcgccaaaaacgcaatcgtcgccaattgcaaagatgaccaagatgccattgctcaggaatctatgctcaaagttaatgtaaacattcattacacgaattcacaaggtggtgattggtcagtagtgaagctaggttatgtttggataaacttctcaatagatattatagactgtgttggttataaggttgaggctgcatacgacatgttgcttatgcagagcctaactcagcgtcgggcagggaaagtagtgaacagtagtgttcgttatgctgatgtcaaacgtgtgaagtcccctgctgggggatcaatgcctcaatggttgaagaattcacctgtatctattgagtcaccttccactagtgatttgggtttacaagctggagtgtatggtgcattgatgggtttaacttatcttaatggggcttctgcacccgccgcaggttatgctggggctgatgttcctggactcctcttggctggtagctttggagcttccctgtacttcatgaccaaaaagaatgttaagttagggaaggccactgtcataaccataggagggctcgtagctggtgccgttgtagggtcagctgtagagaactggttgcaggctgctgttataacttataaccataggactcgtagctggccccctgtggttgtgtcagctggagagaactgttataccatttctgggcatacactctcctgcttctgttgttag

SEQ ID NO: 33649 - DNA, 2685 bp, Glycine max
  Peptide Sequence Number=SeqID_125334
atggcggcggcagcggcgactactccatcgtggcagcctcaggagcaagggttcaaggagatctgcggcctacttgagcagcagatttcgcattcttcttccgccgataaggctcagatttggcaacaccttcagcgctactcgcatctccctgacttcaacaattacctcgccttcatcttctcccgcgccgagggaaagtcggtggaggttcggcaggctgcagggttatatctgaagaataacctcagaaacacgttcaaatctatgcagcctgcataccaacagtatgtgaaatcagagttgctgccttgtcttggtgcaacagataagcacataaggtctacggcaggaactattattagtgttgttgttcaaataggaggagttgttgggtggcctgaattgttgcaagcccttgtaaattgcttggatagtaatgatctaaatcacatggaaggtgcaatggatgcgttatctaagatctgtgaggatattccccaatatcttgactctgatgtaccagggttagcagaacgccctattaacatatttcttcccagattatttcggtttttccaatctcctcatgcttcattgagaaaattatcactgggttctgtaaatcaatacattatgttaatgccttctgccttatacgtatccatggatcaatatcttcaaggtctgtttattctcgctaatgacgctgctgctgaagtgcggaagttggtttgtgcagcatttgttcagctaattgaagttcgcccatctttcttggagccacatttacggaatgttattgaatacatgttacaagtcaacaaggatacagatgatgaagtagcccttgaagcttgtgaattttggtctgcttattgtgatgctcaactgccacctgaaaacttaagagaattcttgccccgtcttattccagtattgctgtcaaacatggcttatgcagatgatgatgaatcagttattgaagctgaggaagatggttctcagcctgatcgagatcaggatcttaaacctcgatttcacgtatcaaggtttcatggatcagatgaagtagaagacgatgatgatgatgttgtcaacacatggaatttacggaaatgcagtgcagctgctcttgatattctttcaaatgtgtttggagatgagatccttccaactcttatgcctattgttgaggctaagttatctgctggtggggatgatgcttggaaagatagggaagctgctgtcttggctcttggtgctataggcgaaggttgcatcaatggtctttatccgcatctgttggagggtattgggcatcctaaaggctatgaacaatttgataatgttcttatgggtcttctacgaagaattttggatgataataagcgggtccaagaggctgcttgttcagcctttgcaactctggaagaggaggctgctgaagagttggctccacgcttggaaattatactgaagcacctgatgactgcatttgggaaatatcagaggcgaaacctcagaattgtatatgatgctattggaactctagctgaagctgttggaggagagctgaatcagcctgtttatcttgacattctcatgccaccattaattgagaagtggcagcaactttcaaattcagacaaagatctttttccgctcctggaatgctttacatctatagcacatgctctgggtactggttttgctcaatttgctgaacctgctgatcctgccgccaccacaggggttcagtatgacaaggagtttattgtatgctctcttgatttgctttctggactagcagagggtcttggcagtggaatagagagtttggttgcacaatgttctttgagggacctacttctgcattgttgtgtggatgatgctcctgatgttagacaaagtgcctttgccttacttggagaccttgcgcgaggtggggactgggtgaaaataagtttgggtctacccaaacatgtgtgcccggttcatttgcaccctcgtttgtctgagtttcttgaggctgcagccaagcaactggagatttctaaggtaaaggaggctatttcagtagcaaataatgcatgctgggcaattggagaattagcagttaagcttcaacttgctgtttcagatgagaaactttttcatccaaagaaacggaaactgagtggcattctggaaactgggattgatggactcaacaagtcacttatagaaaatagtgcaataacattggggaggcttgcatgggtctgtccggagcttgtatcaccacatatggagcatttcatgcaatcttggtgcactgctttgtcaatgatacgagatgatgttgagaaagaggatgcttttagaggtctatgtgctatggttaaggctaatccttctggagctctaagctcgcttgtttacatgtgcaaagccattgcaagttggcatgaaataaggagtgaagatttacacaatgaagtctgccaggtcttacatgggtataagcagatgctgcgcaatggagcgtgggaccagtgtatgtctgctttggagcctccagtaaaagaaaagctttcgaaatatcaatgggagctgagtctcggtccaagttttcagacagggtaccagtacttaaacaattcgtttgagcttgatgattacaggaagttccacaagccttga

SEQ ID NO: 33650 - DNA, 219 bp, Glycine max
  Peptide Sequence Number=SeqID_125335
atgtggaataaggtccccttcctgaccaaaaagtgttatctctcaaccatagccatcacgaacgaagagagacagaaaagaaaggtcaaaggaagtgaaatcttatttctctcctctttcaaggaaatcaaagtacaccggagagaagttcctatggagaaagatacaagtcttcctaatggagaaaggtttcaagatcctgttgtttcctataattga

SEQ ID NO: 33651 - DNA, 1935 bp, Glycine max
  Peptide Sequence Number=SeqID_125336
gaatttgaagataagctttttgctgagataagaggaaggattaaggaggaggatgtctctgcacctttacgcaaagggccttattactattataagagaactttggaagggaaggagtatgttcaatattgcaggcgccttatatctgataaccaaaaggtgccatctgtgcatgacatcatgcccacaggacctgaagctcctccagagcatgttattttggatgtgaatgttaaggcacaacatcacctatactacagtatcggtgcttttaaggttagcccaaataacaagttggtagcatatgcagaagacaccaagggagatgaaatatatactatttatgtcattgatgttgagactcaagctactattggagagcctcttgttggtgtaacatcataccttgaatgggctggtgacaatgctttcgtttacatcacaatggatgagattctcaggcctgacaaggcatggtttcatgtgctgggaacagaacaatcaaaggatacttgtctttatgtggaaaaggatgatatgttttctcttgatcttcaagcttctgagagcaagaaatatttgtttgttgcatcagagagtaaaaatacaaggttcaatttttatctggatgtttctaagcctgaagagggtcttaaagttctgacaccacgtgttgatggtattgacacaactgtcagccatcgtggagatcatttctttattaagaggagaagtgatcagtttttcaattcagaggttgtagcttgtgctgtcaataacacctcttcaactacagttcttattcctcacagggaaaggagccttgaaagtggtcaggcggtcagttttgttgatcctgtatactcagcagaatcctcagattcagagttttcatcaagtattttacggttttcgtatagctcattgaggactccttcctcagtctatgattatgatatgaaggcaggcatttctgttttgaagaagattgactcggctcctcgctatgcgagcacatgggggatggtcactgtttgcatatgtaaagaggctatttccggattcgaatccatgaccaactggtcaccaagggcgagccctggtgcagcggtaaagttgtgccttggtgacttgttggtcatgggttcgaatccggaaacagcctctttgcatatgcaaggggtgaacatgcgtgataaagctaggtctgaaaaggttctgggaggttttgatgcaacacgttatgtcaccgaaaggcagtgggcaccttcttcggatggaactttgattcccatatcaattgtttaccgaaaagatcttgtgaaactagatggatcagatccattactactctatggatatggatcgtatgagtggtatgaaaatgggaagctgttgaagaaaaagaacactttcactgatttcattgcatgtgctgagtatttgattgaaaaaaaattctgttctaaggaaaaactgtgcatcgaaggaagaagtgctggtggtttgctaattggtgcagttcttaatatgagaccagatttattcaaggctgctgttgctggagtaccttttgtggatgttgtaacaacaatgcttgatccaactattcctctcactacctcagaatgggaggaatggggtgatcctagaaaggaggaattctacttctacatgaaatcatattcccccgttgataacgtgaaggcacagaattatccacacattcttgttacagcaggattaaatgaacctgcgaagtttgtggcaaaactgagggatatgaagactgatgataacatactgctgtttaaatgcgagcttggtgctggacatttttccaagtcgggaaggtatgatgtactctcagatttctcatgtttgctaccgaatgtgaaactttctcgttgtgctggtacaatggatttccgttaa

SEQ ID NO: 33652 - DNA, 462 bp, Glycine max
  Peptide Sequence Number=SeqID_125337
atggtacttccaaatcttcgcttaaactttggtcgcattttctgcattcccctagctgttaccgttgttctctcttccgctgttccgtttccttcctccgccgccgccaccgcagcattctctcgccaccgccgtctcgtcgcctccgcatcgccgatgaatccgtcgtcgcagtctcagtccccgcctcctccggtggcaaagaaggtggagcatgcgatggaaatgttcggcgacgtgagaatcgacaactactattggctccgtgacgattcccgcaccgatcccgaagtgctctcgtacctccgccaggaaaatgcctacaccgattccatcatgtccgacagaacgcctcctagacagcagatcctaatggctatagaaactatttcagatgcacccaggccttctatagtttttactttcttctcgagctggaggttgatgtgtagggtaacttga

SEQ ID NO: 33653 - DNA, 321 bp, Glycine max
  Peptide Sequence Number=SeqID_125338
atgaattgctttgtggtgtgtcagtctcgtttgtgggtagtgaccattgtgttctacacatgcattttgatcccattgatgaaactaaagagggcacttgcaagcatgtttttgttctcttgtgagaccaaaggcatggccaaggagatggagttcccagaaattccttccctgcccgtggcaaggtacgaggatttgaagggtcataactgtgatggagagaaacaagagatttgttccatttgcttggtggagtatgagggggaagatgcagtgagcaagctgggaagggaaaataacgggactagggaatgcttataa

SEQ ID NO: 33654 - DNA, 1902 bp, Glycine max
  Peptide Sequence Number=SeqID_125339
atgaagcaaaagtcttctgagttgccaaatgacttggttggtgaaaattttaacaggaatattgagcagatgtgggaacttttaggggatgatcaagtcttcataattggcatacatggaatggcaggagtgggaaaaacagccctagtaacttatattgagaacgatataactagaaagggcagttttaaacatgccgttgttactgtttcccaagtttttagcatttttaaattgcaaaatgacattgcaaatagaataggcatgacacctgatgaagatgatgagagaatgagagctataaagttgtccttagtgttggaaagaaaagaaaaaacagtgcttattttggatgatgtttggaagaatattgatctacagaaggtgggagttcctcttagagtgaatggcattaaattgattctgacaagtcgtttggaacatgcaacacctgcaaaacttcctcatgaagtagaaaagattgcaagatcaattgttaaggaatgtgatggcttacctcttggaatcagtgtgatggctagcaccatgaaagggggactgattaatgatacagcaagtttggagagagtattggatgagggacttaccatagttgataaactcaaaagccattctttgttgttggaaagtgattatctccatatgcatggtttagtgcagaaaatgaacaatataaagaaaatcccgaatggcacgtcaccaaagtgtccaaacttgtccactttgatttttagtggtaatcccctttgtcatattccagattgttttttcagccacatgagtgctctagctgtgcttgatctatcatgcaatccattttttacccttttgcctaatgcagtgtctaacttgagattgaaaatttcaggaacttccattgagaaagtaccagagggtttgggaaagcttatcaacttgaaatggcttgatttgtctgagaattacaacttgacattgttaccagggtctgtgctacctggtttaaccaataagcaataccttgatatctgctataattatggtcatttggcaaaggtaaatgcagaagatgtacaagggatgaccatgctagaacattttgcaggcagttttcatgattgggataacttcaataattatgtgcaggcaaccttggacagaggtagtggacctaaaacttatcatctccatttgggaatcggtcctggatattctttggattattcttatgactataactttctaacaaacgatgagtgccgaattgtgagttttagggactgcacaaaattagaccatgtgcttccaacagacattgcaagattgtgtatagcagagaataaacaatggagatgcttgtgtgatgttctctcatttagatctccttctttgatgtacattgatattcgagtttgtccaaaactagagagcttgttttgtttgactggtccatgttccttgtgcagtaatctccaaaaccttgaatctttgaatcttacaagtttggaaggcccagctgaaacatggaaggaaaatgaagtcaaagcaaaaaatattcttcttggtggcatgttctctcatatcaaacatctcgaggtctcaaaatgccacaagatagagaaattgctgacaattgggccactgctacagctcaaaaacttggtctcacttgatgttaagagttgtgatttgatgaaagagatattcacagtgagtatcactgaagatgtgggtcgtgttaatgaaattactcttcccaagttaacaaggttggagtttagagagttgccacaattgaagaccgtgtggtggggaattatcaaatgtggattatctccaaaactgaacatcagtgactgtccccaactagaaacacctcctattttacaaagtatttcttga

SEQ ID NO: 33655 - DNA, 1596 bp, Glycine max
  Peptide Sequence Number=SeqID_125340
atggcagtgagaataaacagctccattcaaaacaccctctgtctcctcaaccctcctctgttttccctccgttacagagcttcttccctgaagttgaaaccccaattgcattttcgtcaaaacccctctcgaggagctttattctgcacatgcgccaccaccgatatcactccccaaagtaccgaacactttgtcctcactacccctctctactacgtcaatgctcctccccacatgggtagcgcttacaccaccatcgctgccgatgccattgctcgcttccagcggctattggggaagagtgttatatttattactggcacggatgaacatggggagaaaattgcaactgctgccatggctcagggttccacccctcctgaccattgcaatctcatatctcgatcttacaagacgctttggaaagatttagatatttcttacgacaagttcattagaacaactgatagcaagcatgaagcaattgtgaaggaattttattcaagagtgcttgccaatggtgacatctaccgagctgattatgatggactttattgtgtaaactgtgaggaatataaggatgagaaggaacttcttgataataattgttgtccagttcacctaaagccttgtgtttcaaggaaagaggacaattacttttttgcactgtcaaaatatcagaaggcattggaggatactctttatagaaatccgaattttgtgcagccatctttccgtttaaatgaggttcaaagttggatcaaaagtggcttgagggacttttccatttcccgagcatcagttgagtggggcattcctgttcctgatgacaagacccagactatatatgtatggtttgatgctttactaggctatatatcagcactatctgatgatcaggaacaacctgatttacttaaaactgtttcttcaggttggccagcttcactgcacttgattggtaaggctgcacaaattgttccaacttacacggggttgtcttacgatgagatgcttcttttctgcatggatattctacgcttccatgctgtttactggccagctatgctaatgtctgctggactaagccttcctaaaatggtatttggccatggattcttgacaaaggacaaggctattcatttcctggggagtgttgatagaccttgggaagtttatgtgagaagggatatgaaccagctcaagactcagacactcagtaggcctgaactattagaggtagtcattgtgtcagtttgctgttcatggtgttttgaaggaggaaactccttgttaggggatggaatgaagatgggcaagtcactagggaatatacttgaaccaaacgatttggttaataaatttgggacagatgcagttagatacttcttcctcagagaggtggaatttggcaatgatggagactattcagaggaacgcttcatcaatattgtgaatgcacatcttgccaatacaattggaaatcttcttaatcggacactaggacttctgaaaaagaactgccaatcaattctggtggtggattccactacagctgctgaaggaaatgaattcaaggacaatgtagagaagctg

SEQ ID NO: 33656 - DNA, 384 bp, Glycine max
  Peptide Sequence Number=SeqID_125341
atgaacccaagtttgtctttttcatcaattttttcaatttttgataacttagaaatagatgaagtgactgaatccttctccactgattctgtgacacttgctggacatagttgggaattgaaggatttactcaacaatgatgacaatgttggcagtgattgtcccaacgcagaaggtggtccggcaaatgaagctgaggtaaaactagatacaggcaaaggagatgtatttgtggatattgctaaagcaccaggcggaggtgaggggagaggagaggcaatcagcgacggcgcgacgaagaggctccggaagcttcttgaggaaggaagatctcaacctggatatggcgggaagttgcatcagagagagactgaaggtggttga

SEQ ID NO: 33657 - DNA, 861 bp, Glycine max
  Peptide Sequence Number=SeqID_125342
atggaaaaatggaataagagatataaaccaagtgaggagactttacttcagatagatcatttttgttcaaccattattgctgaatgtgatattaatctgaatcgaccatggtcaagatctttgaatcaccaaactggtgctttagcaatatccacaaatacatctcctttgcctgtatctagttttacctctgaggcaatcctgaaatcactgagttatgtgcgttcccttgtggctcaacacattccgaagcggcatttccaaccagcttcatttgccggaccaccttctgcgttgggacaatcactgccaacattgtcatcattgttgagtaaatccttcaattcccaactatgtccagcaagtgtcacagaatcagtggagaaggattcagtcacttcatctatttctaagttatcaaaaattgaaaaaattgatgaaaaagacaaacttgggttcattgctcatgatattctacaatggcgttggcttgagaaacagcagtcatcatcaatgaaagctgacagtgatcatgctgtaaattcacaaggcatgagagcatataatttcttagaagttggtgctgcagctctacttgaaggagacattggagctaagatgaaggggcaaccatggaaatattttgggactgatgacatgccttatctggatcaattattgcaggcttctccagtaacatcatttactaattctgcatctgcttgtccccacctgagagcaataacagcatctaaacgcacaaaagcaggccctcgtcaagtttggcatgttcttctatcagataactttctgctcagatattttttattctcattttttgttgtttcatctctgttttaa

SEQ ID NO: 33658 - DNA, 447 bp, Glycine max
  Peptide Sequence Number=SeqID_125343
atgtatgtgaatttgattgatgtgtcaaagagaatcgtcaagcaacttgcaggatatatcacacttttacagaccattcctctaacctctgctgccccatttttatctatagaggaggttgacgatagatggatgcacttctctgaatatcttgcactggtgggtcagatttgtgttgctcctagactgtgtgcgccaatcgtcgcaccgattatgccagaaccacctacagctgcacttgcctatgtaaacatgcctcgacatgcagtggaggcttgtcatgcaatagtagaaaggttgaaacgcttgatcaacctgagggtagtcacagaaggaactgaagcatacactgtgaccgaggagtgcttaaggatcaccaggggtgtgaatacgcaagggaatgtatatgttcgatcgagacgaaggagacgtacgttggacgcatga

SEQ ID NO: 33659 - DNA, 1377 bp, Glycine max
  Peptide Sequence Number=SeqID_125344
atgatgagagtgtggttggggaatgggcagcagcagtgtcctcacgaaacactgtccttgtcatggaaattgaaacaacctcgtccccaattgcaagcgcgttgcacgctaaccaaacaaggccaacgattccttacaaagctaaccacctcctccgccaccgccgacaacctcattcgtaggttcctactagcttctcccaaatccgtcgttctcagcactctctcccacctcctctccccttccacctcctacccccacctctcttccctcgcctcgcagctttacacgggaatcagccaagccccatggttctcctggaaccccaccaccgtcgccgaactcgccgccctcctccacagtctcggccaccacgcccaatccgaatccctcatttccgacgccagttccaggttacaatcacgccaacgcgacctcgttcttttctacggcaaactcatcgattcacactccaagcgaaactcccacaccgccttcgacgccgcttttggttacctccataaccttgtccgcacttcctcctcccttcacgtgaaacgcagggcctaccagtacatggtgagcggcttatgtttaatggatagaccccgtgaggccgaggatttggttcttgggcttcaaccttcgggcttcgagtacaagtccattgtgtatggatacggaaggttgggtttgtttaatgatatgaatagagtggtggatgaaatggagaggaatggctttgctgttgacaccgtttgttacaacatggttctttcgacttacggcattcacggggagcacgtggagatggtgaggtggcttcggaggatgagcaattcgggtgttccgttttctgtcaggacttacaattccgtctctaatagttgccctagtattaccagaatgacgagggacttgagcaaattggcgttgttgtcgatttcagaattgaaggagggtttggaaggaggggaggggatggtggtgagggagttgttgttgttggggtcttgtgggatattggaggaggtcatggtgtgggattcttcggaggtcaagttggacttgcatggatttcacttggcttcggcgtatttgatcgtgttgctttggttggaggagatgggaagaaggttgaatgattccaattatggagttcctgcggaatttacggtggtttgtgggttgggaaagcatagcagtgtcagaggagagtcgccggtgagagtgttggttcagaagatgatggtcaaaatggggagtccgttgaaggttgataggaagaacaatggctgcttcattgccaaaggtaaagctgtcaaaaactggttaagtcaattcaacaacaacaagtcatccttcactcaacactaa

SEQ ID NO: 33660 - DNA, 294 bp, Glycine max
  Peptide Sequence Number=SeqID_125345
atgataacaaaagatgatgacaaaggtgatgacaaaaagctcaaaggtcaatcaaataatgagttcaagatgttcaagatagaatcaagaacacttcaagattcaagaggaaagttgaattcaagaatcaagaaccaagattcaagagatcaagattcaagactcaagaggaaatttgaattcaagaatcaagaatcaagattcaagagatcaagattcaagactcaagattcaagaatcatgaaaaggcttaatcaagataagtatgaaaaggttttttcaaaaactgagtag

SEQ ID NO: 33661 - DNA, 402 bp, Glycine max
  Peptide Sequence Number=SeqID_125346
atggtcagaacacgaggtttaggtcgtgtcataggtagagttgtaggcagagatagacctgctgaccaggatgctgctgatgttcccgagaggcgtaggcctactgcctcagcccgtaggctacgcgttcatcagatgactacggagggacgtgatatggctgaggacgttgctgacatgactgacgattttcctgagcaggctacgaaggcacctgagatgcgtgcggacgcacagggtgctgatagtggtgaggggtcagatggtgatgatgctgctgagggattccctggtggtccacgagacccgtcagtgctcacatcatttgccgagcatgttgcacatgccgtttggagtggacaggaacatcctgatttgaaattagtgtcacatgggaggaag

SEQ ID NO: 33662 - DNA, 1083 bp, Glycine max
  Peptide Sequence Number=SeqID_125347
atgggagaaaacaacaacaagtttcactgttgtggtgatgatgatggcttcgacgagccactgtatttgaagtaccccgcgctgcaagatctggagtgggaaggcaccctcatttgccttcctcccgatttatcgtctctgtcaaataacttcacccctaaggttcttccactatcgatgtctcccccatcggagaccaccgtcactcgggttcctcctatgttgccgccggtggaggatgccacctacgttcaacccaacctccaagatcaattgtcagcgttacagaacatcaatgcgaaccaggttgctcccatgtggccaggctcccaaatcaatcactcgctgtcacggaagggcagttcttcgaagtccaatgagtgcaggagatggagtgaagaagaacacaggttgtttctgcatgggcttcaaaaatatggaaagggagattggataaacatttcaagaatcatcaaaacaagaaacccaactcaagttgctagtcatgctcaaaagtatttccttcgtcaggcctcaagtaataaaggcaaaagaagaaacattcatgatatggtcctaccagatggtcctgtccctcaccgcatttaccagcagaatggagtttcttttcgaaatcttgatggccctatcactcaccacattaatcatcagaatgggatcaaatatcttggatcaagccttggctacttaaatcctagccataccaaaaaggccaacactctatctaaggccgatttgggccaatgtttcgagtatcactgcaatcgaggacattcaaccgaagagtgtatcattttgaaggacaaaatagaagatttcataaagctgggacacttgaaggattttatccacaagactcaatcttatcgacttcagaatagttataggcaagacaaagacaaaggaagagatagagattgcagtcaccagtctcaaactgagagtgaaagaagtcgaagccggtttagggagaggaaggaacaatcccttaatccaccaagatgtgtcatcaacaccattgtaggaggattcgccgaaggaagggcaatgacctcggactga

SEQ ID NO: 33663 - DNA, 801 bp, Glycine max
  Peptide Sequence Number=SeqID_125348
atggatttcgagagtagaaggcttcatttgctcatctccgttgttgccatcgttgctcttagcttcacagctgaaaaatgcagggaacttgttggggaggaggggtcatctcagagtggaaagtttacgatcttaaattgcttcgatatgggttctggaactgtagcatgtgctgtcaaggaaggtgtgaagctctatttttacaatattaggtcttctcatgctgaaagagcaaggagccaagcaattgagtctgcccttgttgatgctgttgctcaggggatgtccccaacggattcggcaaaacatgctcagaaagaaggtaagaaggcagcaaaattggcttcccgtcaagccaagcggattataggtcccatcatttcttctggatgggacttttttgaggctatttactatggtggtactgtcacagaagggttccttagaggcactggtactttgtttggtacttatgctggaggattccttggggagcaaaggcttggtagaattggctatcttgttggaagtcatctgggcagttgggttggtggtagaataggattaatggtttatgatgtggttaatggagtgcatttgttgttgcaatttgttcagacagcagaaactgaagttcgcgaaaaatccgaacgatctgaaagttccttttttggtgaaactcctgtttatgacggctctgaaggctccagtgtttatgaatcacctctcgatgaagaatcgtatgcctataaatctactgaacgtcagagctatgaaacatatgaagattctgaactgtga

SEQ ID NO: 33664 - DNA, 2958 bp, Glycine max
  Peptide Sequence Number=SeqID_125349
atgaagggctttaagaaatctggatgcacgaacacaacacaacccaacctctccgctccactctgggtttcaatggcgggcatgaaccaaccttcaattctgaaaatcccattgccaatgttgaagctcattgcatcctcctcgcgcatccaccgggtgcaccccacggtgctccgtcccgcacacgattccgcctcgccgctgctcagagtgctgagttctctcgtcgggttaagctggagaaacactaatgttggaggcaggtattttttctgttccggttccagcgacagctccgatcgcgtggttgacgccggagtccaagccgccgatgagtccgagtcaaaggcctccgctatcgttcccacatatcccagacccgaagattatctcactgttttggcactaccattgatacatagaccacttttcccaggattttacatgccagtctttgttaaggaaagtcgagaacgacaagccccatatgctggtgctttcctccttaaggacgagccagaggctgatcctagtgcagtatctagctctgacacagataagaatgtatatgatttaaaaggaaaagagttgtttaaccgtcttcacgaagttgggactcttgctcaggttagtgaggatccacttactgtaaaagttgatcatctcaaggataaaacttataacaaagacgatgatattataaaggccacgtcttttgaggttatatcaaccctaagagatgttcttaaaacaagttccctttggagagatcatgtccagacttacactaagcatataggtgattttacttatccaaggcttgcagattttggtgctgcaatatccggggcaaataaattgcaatgccaacaagttcttgaagagctagatgtgtataagcgattaaaacttacactggagttggtaaagaaagagatggaaataagcaaaattcaggaatcaattgctaaagcaattgaagaaaagataagtggtgagcagcgtcgttacttgttaaatgagcagcttaaggccataaagaaggaactgggactggagactgatgacaaaacagctcttactggtaaattcagggaaaggattgagccaaagagagaaaaatgcccacctcatattttacaagttatagatgaagaacttgcaaagctacagctgttggaggctagttctagtgaattcagtgttacccgtaactacttagactggttgactgcactgccttggggtgaatacagtgatgagaactttgatgttactcgggcgcaaaagattcttgatgaagaccattatggattaactgatgtgaaggaaaggatactggaattcatagctgttgggaaattaagagggacttcacaagggaaaattatctgtctttctggtccacctggagtgggcaaaacaagtattggtcgttcaattgcacgtgccttgaaccgtaagttcttccgattctctgtaggaggattagctgatgtggctgaaatcaagggtcatcgtcgaacctatattggtgctatgccagggaagatggtacaatgccttaagaatgtgggcactgccaaccctcttgttttgattgatgagattgacaaattgggcagaggacatgctggtgatccagcaagtgctttgttagagcttctggatccagagcagaatgctaattttctggatcactatcttgatgttaccattgatctatcaaaggttctttttgtttgcactgcaaatgttgtggaaatgatacctaatcccctgttggatagaatggaggttgttgctattgctgggtatattactgatgagaagatgcatattgctagagattatctggagaagaccactcgtgaagcttgtggaataaagcctaaacaagtatttatctttgctacctgttttgcagtcccttctcctgcagagaatgggatgttcaaagtggaagtgactgatgctgctattcttgccctaatagaaaactactgccgagaagcagggatagcgctacaactcgtgaggcaaggggaaatgattgatgcaaccgtggaaccaataaaagaaaatatagactctgatgaatttggtcaaaatacagttcaaaataagaactccgagttggtggagggtagtgatcctgaaaaagagggtgaaacctctgataaagttgacaaggtgcaaacagatctatcatctgatgaatctcaatgcctcgaggttgcaaaagaaagcgaggaagataaggaaattaaaacaaagactatagaaaaagtattggttgatgagtctaatttaactgactttgttggcaagcctgtcttccatgctgagcgcatctatgatcagacacccgttggtgttgttatgggtcttgcttggactgcaatgggtggttccacactgtatatagagaccacacttgttgaagaaggggagggaaaaggaacactgcaccccactggtcaattaggagatgtgatgaaagaaagtgctcagatagctcacactgttgccagagcaatactactggaaaaagaaccagaaaatcctttctttgcaaactcaaaactacacctccatgtccctgcaggggctacaccaaaggatggaccaagtgctggttgcacgatgaccacttcactgttgtcccttgccatgaagaagcctgtgaagaaggatctagcaatgactggggaagtgactcttacggggaagattcttcccattggcggggttaaagagaaaaccatagctgcaagaaggagtgaagttaagactattatattcccttcagctaacaggagagattttgatgagctagcacctaatgtgaaagaaggtcttgatgttcattttgttgatgactacatgcagatatttaatttggctttgggtgatgatcaatctcagaatatagagagagtcattaatgttctgtag

SEQ ID NO: 33665 - DNA, 1014 bp, Glycine max
  Peptide Sequence Number=SeqID_125350
atggcccagctgctttctgccttttggattcaagccaatcttcctgataatttaccttcaaatattgaagctatagctcattcattcatattgacactacctgtcttacgcataaagaacctgaaagacagagatagcctggtgatccgcttcttccagcttcctctgtctctctggactatgttgttggaccaaagcaatggaatattgtccccagcttgtcagaggtctgtctatgtattgtctgctggcatgttgtcctttgcctgcaaaatatatcagattcctgatctgaatgatgtgtttgcatcattgccaatgtctggtgttgatccctcaaattcagcaggtgaagatgacacaatcagtgaagcatctgtctctgacctttctcgatttattccaaagatgcctctatccccttccgcacctcatgttatcagcattggacaacttatggaatcggcattagaggtagctggtcaagtggcagggacagctatctccacttcgccccttccatacaacaccatggctagccagtgtgaatcactcggtacatgtgtaaggaaaaagctttcaaattggctggcctttgagaatcattacagccaaacacctgatgataaatcgtttttggcaattgctgatattaggaactcagcatctgagaaggtgacaaatggtggtgggcatgcccaattgccaagggaccccatgaagctgcctcctgctagcccctttgacaatttcctcaaggctgctggagcctggaactgtttaaagtgggggccagtgctgcatgccttccctacacactgttttggagtcaattgcactggcaatttgctattttgtgaaaatccagtgtataatggcactggcactgccacactctggtgggcactacctgttcgtggagggttattattggttgcacgtgttgcccaagtcaaaatctgccacaatgcatacataaaggggattaggatcaggtccactttggaagtataa

SEQ ID NO: 33666 - DNA, 1356 bp, Glycine max
  Peptide Sequence Number=SeqID_125351
atgcaacttactaacgatgtccataaagagcaaggtggcacgatgggcagtgtacttgggaggcaatgccctaaaatggattcccttggtgaagcggaattggtaaaggttgtagcaaaccagtggggcacttggtctcgcactttacttgctgacaaacacgacattgtgaaacatattggcgcacatccttccatatctatgaatagaaaaaattatcctataaacggcgaagtgtttttgcggcacccaagtggccacccaaaggggatgaatggaactcctcgagtagagtgggctcttgtggtcagtaagaataatgaaatgctgacccaagaggtaatgcctccattttcggactacggagagaacagcacccatgaaggtcctggacgcataagtttcgatagtgaaaagtttgtcaaacaaagaagtcaagggattggcaatagaagcatagtcctgtataaaacatcggtagaatcccataatgcctacgaaaccacagagctttgttatggacaatggtgcaagccatccgagcatggcactaattttttacagatcgggggtggcaccggaagcggagactatgtgtcccaggctcctggaataaaaatggttgtaactggtaagaaggttttgtcaaggttgtgggtgggtggtgaagtgatgaagaagagtcactggtgttggctgggtcgagtatttgagttaattggaatagtgatgaaacactttgagtgtgcaccaaacgatgaacctgtgattgcaatgcagtacaccaccatttccgaccatcacctaaaaggaatcaatggtgtgtcgtcagacgatggtggcgagatcgagacgaggaaacataggttagactctggggtcagagccggtgctgggacctccacctcgtcgtcagcaatgaataagtcttcaaaagaaagacgattcacgggtaatcacggagtaggagttgacggtagagggcctgagttatctttcgtagaagggatcaccggtgttggaaaatgtgtggaaaggatgaggcagtggcgatcatggcttgctacatggccgcctaagatgtcaacatgtcattgcctgacatccattggtaccagcacagagctgaaccttccatgtaaaatgaagcaaccgttaaacactcattttccgaaatgcattggtggggaaagaggcggacatggtgtgggtggggattttggtgaagaaggggtagtggtgagggatgcgagtttctccagaatgaagtctattttgttattcatgggggccaatgcttgggctagggagacgtggttttgtgtgagggaagtcttgatggaagcttgcttgtga

SEQ ID NO: 33667 - DNA, 468 bp, Glycine max
  Peptide Sequence Number=SeqID_125352
atgggatacttcccataccactcaaattcaaaaggtcttggttcaatggttagggctgcaactagaagacacctcttgggaaaagtggaatttcctacgtcacgtttacaaccttggggacaagatacttatgtgaaccggttcagacgaagcgtgacaaggttttatgcagcaagtgggaggaccgttacagttcctcgagttcgaaggaggaggagaagcaggaagggatcgccaatgaaggctgaatttgacattggtagcgatgctccagtgaagaaggttgatgatgacgtgacaaaggtggctaagattgtcatgaagcatagggacttgaaggagataatggaagcagttaaggagaattttgagaaggctacaattgtcgaagatcagttattggagatgctcgaagttagaaaagcgcaccttgatcggaacgacaacgtatcaaaattttctttttaa

SEQ ID NO: 33668 - DNA, 429 bp, Glycine max
  Peptide Sequence Number=SeqID_125353
atgaaccttcgccggccatgtagctccacccttgatcatcaccgaatgccaacccattttgacatctcagtcaaatccgaaccccaaaccacctcggcgcatggccacacacacattcacctccatcaccatgttggatctaaggttgcgtttcaccctaacccaacaaccccctacatgttctctcatcatccatgtttcatgacgaaacctttcccttcagatctcgtaagtcagcattgtaaagtcagccccaaaacgttgtcgttcagagaagggttcacttacgagatctccatcagacaaatcagctccaacaatcacaagaaaaagaagtgcaggtgccctttgtcacaacttgtctcaaaccaaaggaagcggacacacccagccttcgtagatcaagggttaaaaatgaccattcactaa

SEQ ID NO: 33669 - DNA, 1926 bp, Glycine max
  Peptide Sequence Number=SeqID_125354
atggcgcccggaaggaagaagcggcaagggaacacatccattattcctgtggatgcaaaccccactcagcaaaaagcacaatctttggatattgatgctgagtgtgagagtgagaccaaaagaatgaaatttgctgaggaagatggtgatggggcagggggttcttcttctgttgtgaaaaagaagcgtggcagaaaaagtaaaaaggagaagcaggacacggaaaagatgttagagagcaatttgtcggagaagaaagatactcaaggcgaataccacggtgaaaattgtggagtaggagggtcttcttctgttcaagaaagtgcgaaaaagaaacgtggaagaaagagtaaaaaggagaaggaggacatggaaaagaagaagatggcagaggagaaagatgctcaaaacgaaaaccatggtgaaaatggtggagtaggaggttcttcttgtgttgtagatggtgtgccaaagaagcgtggcagaaaaagtaagaaggagaaggaagacatggaaaaaaagatgttagaggagaaagatgctcaaaacgaaaaccacggtgaaaatggtggagtaggaggttcttcttctgttgtagaagctgtggtaaagaagcgaggtagaaagagtaaaaaggagaaggaagacatggaaaggaagatattagaggagaaagatgctcaaaacgaaaaccatggtgaaaatggtggagtaggaggttcttcttctgttgtagatggtgtgccaaagaagcgtggcagaaaaagtaagaaggagaaggaagacatggaaaaaaagatgttagagggaaatttgctggagaagaaagatgttcaagacgttaaccatgccgaaaatggtggggtacctgatatgaggcgtggaagtaaaagaaagatgcttaaggaagatgatggtgagtttgaaatgcctgtggattcttcaggaagtagcattcagaaacaatatagtcttagggcccctagagtcaatatagaagaggcaatgccaaaaatcaacaagagagatcctaagcagtggattgaagaggagtccttaatgtgtcatcaatgtcagagaaatgataaaggcagggttgtgaggtatcctcatttgaaagaggattatattgctgaggcatgccctgtgtgccgtggtaattgcaactgcaaagcatgcttgagatccaatcaacttattaaaaaaatgaagaaaaaagaagaaaccaatgaaaatgagaagattgaactctctatgcatttgttgcaagtacttcttccgtatttaaggctgttggatgaagaacagatgattgagaatgagacagaagccaagatacgggggctctcagtctcagagctaaatgtagcacaggcaaattttgataaagatgagcgtgtgtactgtgacaactgcaaaacgtcaatatttgattaccacagaagctgtacaaaatgctctttcgacctttgtctcatctgttgtcgcgagcttcgaactggccagcttgtaggtggtgcagatccaattatgttggagtttgtctgtcaaggtcgtgattacctgcatggtgaggaaaatataagtgtaaaacaaaatgaaccaaatgctgttgaacaaaatgaaccaaatgctgttgctgagactgtagttcgtgagtggtcaagatctgggtggcatgcagaaagtaatggtagcattccttgtccaaaagtcaatgatgaatgtaaccatggttttcttgaactgagaagcatattaggtcaacattttatcactgatttagtgcataaagcaaacgaactagcacaagcatacaagcttcaagatgtagttaagacccctgacaacttctgttcgtgtttgaggcttgatagaaacacagatattccagggacaactatttatactgtcctagggctgtag

SEQ ID NO: 33670 - DNA, 327 bp, Glycine max
  Peptide Sequence Number=SeqID_125355
atgaatgttgagatgcagagatccatttctaaccataagatgcaaaatattggagatgctatcccaaatagttgcaaagatttggctaagcaagttctaaccatgttagaactagtcaacaacataatcaaacatcaaactttgatgctcattcatccagtcttaagattgggattcagatgtatttacgataatgaagacagtgcaaaaagtgaattgccttgtttggatggggactggtgtatgttaggttacgtacttgaggacgagactattggagatggcatgcgaggtattctaagtagaattattaaagagggtttttag

SEQ ID NO: 33671 - DNA, 402 bp, Glycine max
  Peptide Sequence Number=SeqID_125356
atgtcagtgccgcattcgaggtcatcggctacggaaaaaaaactcatcgttgcatcgtttggcatcaagaactacgataagggaggtgcaagtcccatcgactccttcacaaactacaacgttaacatgaacaacccccaagaacaagagaacttctcgatctatgcaaatagaaccgttggtccccctcctatcctcttgacaaaggctcttctcaaagcccacgtgcaaaatgcagaagcccacttcagccacatccaccctgatacgagcatctggatgccttccgagcttagctcacctaggcgagctggttacttcacctctaagtttcctaatgggcctaggtgggcccaggggttggaaaatgtccccaaaatgacccttttgcccccattttga

SEQ ID NO: 33672 - DNA, 317 bp, Glycine max
  Peptide Sequence Number=SeqID_125357
gtgctccagtggcttctgtttctatcagctgtccctcctgttcagctactgacggggtggtgcgtaacggcaaaagcccccgccggacatcagcgctggcaagtgtagcgggtcacgctgcgcgtaacccaccacacccgccgcgcttaatgcgccgctacagggcgcgtccccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaa

SEQ ID NO: 33673 - DNA, 198 bp, Glycine max
  Peptide Sequence Number=SeqID_125358
atggcggaaggggatattatacctccagagaccagaagcttcttgtttcagaagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 33674 - DNA, 462 bp, Glycine max
  Peptide Sequence Number=SeqID_125359
atgggaacaaatcaaactggaaaaaggttttatcaagtcaagattaagggcctagatatcaccagcattaaggaggtggggcggttgatgggacctctccaaatgcaagccttccgcaaggcgtacagaaaaattttagatttgaccatagcagagatatccacagaagccgttatatcactcacccaatactataaccagcctttgagatgcttcacatttggagacttccaattagtaccgactgtcgaagaatttgaggagattctaggatgtcctcttgggggaaggaaaccgtatcttttctccgggtttcttccctccttgagcaagattgcagttgtggtcaaggattcagcgagaggattggatcgtgtaaagcaatctcgaaacggcgtagtgggcctaccacggatgtacttagaaggcaaggcaagggatatggcaaatcaagaggagtgg

SEQ ID NO: 33675 - DNA, 141 bp, Glycine max
  Peptide Sequence Number=SeqID_125360
atgcccttttgcgggcgagcgacgcgaggctcacgggtcgacaaaagcggggctcttgctcctacgtaccctccatcgaagaggaaatcagacctacgtagttcttctttaaaggtgaatcaagcgattcttttactttga

SEQ ID NO: 33676 - DNA, 258 bp, Glycine max
  Peptide Sequence Number=SeqID_125361
atgctattgaggtggaacaagcttaatcaattgaaaattgacggtgtgagattttccctggactctactagggcaattttccttggcatccttaatcatgttcaaattgttgcaaatacaaatggtaatgatgctgatgttgcacctgaattttctcctttgaaaactgttcaatttagaaatccttctcaagacactgttgacccaagagacggaggctttggaggaagactatggagatggaaatgggaaaaatga

SEQ ID NO: 33677 - DNA, 537 bp, Glycine max
  Peptide Sequence Number=SeqID_125362
atggcccgggaacgctgccagggtctcgatgtggatatccgcctgcaggattaccgtgacctgaacgaacaatttgaccggatcgtctccgtgggcatgttcgagcacgtaggaccgaaaaactacgacacctactttgaggtggtggaccgtaatttacgaccggacggactcttcctgctgcataccatcggctctaagcggaccgacaataacgtcgacccgtggatcaacaagtacatctttccgaatggctgtttaccctccgttcgccagattgccaacgccagtgaatcccatttcgtgatggaagactggcacaactttggcgcggattacgacaccacgttgatggcgtggcatgaacgtttccagcaagcgtggccggagattgcggacaactattctgaacgattcaaacggatgtttagctattatctgaatgcctgcgcgggcgcgtttcgcgcacgggatattcagctctggcaggttgttttcagccgtggcattgaacacggattacgtgtcgcacgctaa

SEQ ID NO: 33678 - DNA, 324 bp, Glycine max
  Peptide Sequence Number=SeqID_125363
atgtgggcattatccctatctctccaagttgctggtgtcgcaacctacccttcggcgggagggcgacgcggggctcacgggtgcatcttccatgggaggaaaatgcgtggagtcgccaccaacgtttatttgaggaaaacgtcagaaaaaccagaaaggtgtggtctacgaactttaagtgtgaaaggttcgggagttgtttttacgcacggggaagggtgtttccctcgctcctacgtatcctcaattgcgatgaggaaatcagacctacatagttcttttagaactaaacgttggttaagttgttttgatctttttccgtaa

SEQ ID NO: 33679 - DNA, 481 bp, Glycine max
  Peptide Sequence Number=SeqID_125364
aggactacacgtcctcgccttcagaagactacacgtcctcgcctttagagggctgcacatcttcgccttcagagggctgcacatcctctccttcaaaggactacacgtcctcgcctacagaggactacacgtcctcgcctacataggactacatatcctcaccttcagaggactacacgccctcaccttcatagggctgcacgccctcgccttcagaggactacatgtgctcgccttcagaggactacacgtcctcgccttcagagggcaacacgccctcgccttcagaggacttcacatcctcaccttccgaggactacacgtcctcgccttcagaggactacacgtccttgccttcaaaggactacacgtccttgccttcagagggcttcacgcctttacctttagagggctgcacgccctcgccttcatagggctgcacgccctcaccttcagaggactagacgtcctcgcattctga

SEQ ID NO: 33680 - DNA, 303 bp, Glycine max
  Peptide Sequence Number=SeqID_125365
atggagaaaaaaatcactggatataccaccgttgatatatcccaatggcatcgtaaagaacattttgaggcatttcagtcagttgctcaattgttcacccttgttacaccgttttccatgagcaaactgaaacgttttcatcgctctggagtgaataccacgacgatttccggcagtttctacacatatattcgcaagatgtgggcgtgttacggtgaaaacctggcctatttccctaaagggtttattgagaatatgtttttcgtcttcagccaatccctgggtgagtttcaccagttttga

SEQ ID NO: 33681 - DNA, 209 bp, Glycine max
  Peptide Sequence Number=SeqID_125366
atgggaacaaatcaaaccggcaagaggttctaccaagtcaaggttaaaagcctagataccaccagcatcaaggaattagggcggttgatgaaacctctccaaatgcaagccttccgcaagacttacggaaaggaaacagctatgaccatagcagaggtgtccatagaagccattgcatcactcacccaatactacgaccagcctgtgag

SEQ ID NO: 33682 - DNA, 460 bp, Glycine max
  Peptide Sequence Number=SeqID_125367
gtcagggggtgcaaacacgcgaccgctgcaggtcatgccgctcagccccgtgatattggttaccttggctgacaacgagctgatgtcggtggcttcttccttcctttcacttggaggtgcatacctctacggagctgtgtggctattttggcatagaaacagaacaggtttaactaccgaggggtatcggggcatttggggagttacgtctttggtgaaatacaccaccaaaggctcaggccttccaaaacttctctcatctgcggactgcatacatatatgctgctcttcactcccctcatcaccgacttccagccggccccgatctatcatctgttgcaacaggtcctccactgctaaagatgtttccatgtcatgcagctcaccgggatgcatcaaacaagaatcctcttcgtgcccaccgtggggaattacaccccccttttgtagggtctcatag

SEQ ID NO: 33683 - DNA, 457 bp, Glycine max
  Peptide Sequence Number=SeqID_125368
atggggccaagtcaaacgccttcgcttaaaaagaggttctatcaagtcaaggtcaagagcctagggatcaccagtctaagagagttagggcaattgatgggtcatctccagcgacaagtgtttcgcaaaacttacggtaaaatctgggacctagccatggcagaagtctctgcggaggccattgcatcccttgcccagtattatgaccagccgttgaggtgcttcacctttggggacttccagctatcacccatggtggaagaatttgaagagatcctaggatgccctctagggggaaggaaatcatacctcttctcaggattctatccctctttagctagaatttctaagatagtccaaatctcggcgcaggaatttgaccacagaaagcaagtcgaaaatggggtggttggaataccgagaaaatgtttggaggcaaaagcaagaatcttggcag

SEQ ID NO: 33684 - DNA, 255 bp, Glycine max
  Peptide Sequence Number=SeqID_125369
atggcagcggaatggagaaggaagagagagaggagacgccacttcaaggagaagatgagtctagaagaagcttatgaccataggaggccatggataagagcttggaggaagaaggagatgaatgaagggagaggaagagaagagcacaaaattttgtgctctaagagagctttgaaatctgaacccactaattccaagatcaattccaagatttctcccactaattgtgccttggggtgtaataagggcatgtaa

SEQ ID NO: 33685 - DNA, 768 bp, Glycine max
  Peptide Sequence Number=SeqID_125370
atggctgacatcaccaatgatcggaacgtcgacgcgaaccgtcttgttgatcgaggagggatcgatatcgatatggatcttcttcgaattcggcgagaaagcgttgatgcggccggtaatacggtcgtcgaaacgcgcgccgacgcagacgagaacgtcgcaatcatgcatcgtcatgttggcttcgtaggaaccgtgcatgcccagcatgccgagccagttcttgccggacgccggataggcaccgagacccatcaatgtcgacgtgatcgggaagccggtcagctcgaccagttcacgcagcaaccgggttgcttccgggccggaattgatgacgccgccgccggtgtagaaaaccggctttttcgccttcgacatcagttcgatggcggcatggatggcattaaggtcaccctgaaccttcggcttgtagctcttctgctggacggcggcggaaggcggcgtgtaggtgccggtggcgaactggatgtccttcgggatatcgacaacgacaggacccgggcggccggtctgcgcaatgcggaaagcctcatggatgataccagccagttcgttgacgtcctttaccagccagttgtgcttggtgcaggggcgcgtgatgccaacagtatcgcattcctggaacgcgtccgagccgatcagcgtggtgggaacctggccggacaggcagacgagcggaatggaatccatcagcgcatcctgcagcggggtgaccgcattggtcgcgccgggacggggatcctctag

SEQ ID NO: 33686 - DNA, 471 bp, Glycine max
  Peptide Sequence Number=SeqID_125371
atgggaaggtataaagctttacttaggagctgtccttgccatggttactccgattacacccaaatctccatgttgataaaaggaaaacctaatgaatacagaagaatgataaacacttcagcaggaggatactatgtcaatggaaccacaaccaaagaattagccaaggaagccaaattcatgagagaatgcattacaaaattagaagaagccgtaatcaaccttagcaccaacaaggttgattggaatgccataacaacaagaagtgggttagcaactaaagagctactaagaaaggacatggaggtagacgatggagtgaaggaagacatacaagaagagggcatgatagttgaagaaatagcacgagagccaattaagataaagatccaactaacacgagaagctaaacaaggaattacatgtgagaagtcatatcctcacaaaccaacaaagcaagacaaagagtag

SEQ ID NO: 33687 - DNA, 209 bp, Glycine max
  Peptide Sequence Number=SeqID_125372
gggctgagagggaggttctgaggtccagaggtgaaggattggagacaaaaaagagaaaagaagaaggaagacgagaaaaagaagctaaatcgctaccaaattacgaccgttcatcgttcttcgttcttcatccggagcaagggcaacaccctttgatggaagcttgcttgtggggtttctatagaggctggatctttgagcttcaatga

SEQ ID NO: 33688 - DNA, 213 bp, Glycine max
  Peptide Sequence Number=SeqID_125373
atggtagcggaattgagaaggaagagagagaggagacgtcacttcaaggagaagatgtgtctagaagaagctcaccaccataggaggccatggataagagcttggaggaagaaagagatgaatgaagggagagtgattggaatggagaaggaagagagagaggagacgccacttcaaggagaagatgagtctagaagaagctcaccaccatag

SEQ ID NO: 33689 - DNA, 559 bp, Glycine max
  Peptide Sequence Number=SeqID_125374
ggatcgcgcccataagacgcccagtaggcccgaagaagtccaacagggccctggggtttccagctctggttacgggcctctgtcagtcctacaaggtgcccgttcccccagcgaggaatcgcacccacaaagacacccagtggacccagagaagtccaacagggccctggggtttccagctctggttacgggcctctgtagtcctacagggtgcccgttccccccggcaaggtcacgtcatcatagagtacctgtcacctccagcaagggcatcaggccccctactaatcgagctttcattaagaagtactacatccccaggcaggcgcagggcaaaacaccacagcagcctggggatggccggcagcgggcaacagacgcaccgccatcacctctagagttcacctcagctcatccacaaaaaggcaaccaagtccagagccaaggtaagcaaagtactaggtccgtgaccgacaagtcatcacctgtcagctcagacgttaaagaagccctactaggaggcaaactagtaccttttaaatctctgcttgttatttga

SEQ ID NO: 33690 - DNA, 585 bp, Glycine max
  Peptide Sequence Number=SeqID_125375
atggtggaggagcaaaatgacaagacgaccctcactcagaacgaggattttccggtaaagggtcttccggagaaaagggatggctgcggcaagaaggaagtgtcgctagaggaagcaagcgagtttctccgcattattcagcagagcgagttcaagggcttaggcaaggacaacaacggcataaccagcctgataagcgctaaagaaaaccacgggaagtttgggttaggctataaacccacagaagcggacataaagaaaggcattacaggaaggaagagcggaggtcaaggctcgcgactgggacaagaagtcaaaggaggcccgccctgccacatcagtaggagctttataagcgcgggtctaggacacgaaggccaagtcgttgcgatatgtgaagatgattcgccaagtgggtcggagttggaacgcccggacatttatgcaacaagcataatatccgacgacgagtccctcgaaggtactaataccttggacccgaccatcgatttcgagcagaaacaaatcaaacgagataaagaggatgaggatgtgggacttccctccggagttggagaaagatag

SEQ ID NO: 33691 - DNA, 126 bp, Glycine max
  Peptide Sequence Number=SeqID_125376
atgcatctacgtgatcaaggtacctacagggaagatccaacagaggatttagctttcgataccaggaagtcttctttacaacaaagagaagaccaagatgaaagattgcaaaaatacaagtggtga

SEQ ID NO: 33692 - DNA, 252 bp, Glycine max
  Peptide Sequence Number=SeqID_125377
atgagtgaaacagtaaaaatttgtatggcgtacttcaaatgtatgaaatggccccgaggaaacttgcctcaaagagatccaggaaggataaagcggccaaaggaaccagttccgctcccgagtatgacagtcaccgctttaggagcgctgaacaccagtagcgcttcgaggccatcaagggatggtcatttctccgggagcgacgtggccagctcagggacgatgagtataccgatttccaggaggagatag

SEQ ID NO: 33693 - DNA, 632 bp, Glycine max
  Peptide Sequence Number=SeqID_125378
cgccgtcagaggactacacgtcctcaccttcagaggactacacgtccttgccttcaaagggctacacgtcctcaccttcaggggactacacgtcctcacctttagagggctacacgccctcgccttcggaggattacacgtcctcacctttagggggctacacgccctcaccttcagaggactacgcatcctcaccttcagagggctacacgccctcggcttcagaggagtacacgtcctcaccttcagaggactacacgtcctcgccttcagaggactacacttcctccactttagaggactacacgtcctcaccttcagagggctacactctctcgccttcaagatacgcccgcaggacacccggtggacccaaagaaattcaacagggtcttggggttccagctctgattacgggcctttgtcagttctacagagtgcccgtcgccccaacaaggccattaggccccgctataccgggctttcatcaagaagtactgcgcccccagacgggtgcagggcgaaacaccacagcagcattgggatggccggtagcaagcaatagacacaccgtcaccacctctagagttcacctcagctcatccacaaaaaggttagagcgttgcctatga

SEQ ID NO: 33694 - DNA, 330 bp, Glycine max
  Peptide Sequence Number=SeqID_125379
atggagacacttcagaaggtccgcaaggcatgggaggtgttgcaaaagaaggacaaggaactcaggggcagtaacaatgggcccatctgtggctatcgtaagtggttaaaagcccacgtgcaaggtttggattggcttccgagtttgagaaccgctaaaagggaggaagttgaggcaccgaaggaagacgaagaggagaatgccgaactgagggatgtaaatgtagctaccaccaaggccttggaacaagagactaagagggctcgtagggaagagcacggcaggaacaagtttcgaggggctctatttgggcagcaacagggagcttaa

SEQ ID NO: 33695 - DNA, 366 bp, Glycine max
  Peptide Sequence Number=SeqID_125380
atggtggcgcgtgttatgctcaagaacggatttgagcccggaatgggtctaggcaaggactgcctcgggaatgccgacgtggtcgatatcaagggaaatccatacaagtatggattagggtatgaacccgggatgccggggaggaggaacgtgccgtcaagatttcgggcggatagggtatggcccggccgtattagccagtgtttcaccagcgctggaatggtgtccgaggaggaggtggccacaatagaagaggagttccctcaagacccaccaagttttgtgcaaccatgccaccccgattcccaagtggggaactggcgcgtgataagccagtcagaagtctataccgctgattcaatgtaa

SEQ ID NO: 33696 - DNA, 201 bp, Glycine max
  Peptide Sequence Number=SeqID_125381
atggtctggaacaatgctataaaaggtcttgatgaagctccacagcctaaatcaaaggcttctgctaggtggattgtcgtcaagtattttaatgatcctagaccatttgagccaaagagattaaaggccctacggatccaatgggcacaatattatcttcgagttagagctcagagcttggatttagggatcagacattaa

SEQ ID NO: 33697 - DNA, 341 bp, Glycine max
  Peptide Sequence Number=SeqID_125382
agaccaagtttggtcattctgcatccatgatacgcggagataccttatggttattcgcacccttttgtcatccagaggcggcgggcccgatgacaagcagagaccaagtttggtcattctgcacccttgtatcatccagaggcggtgggcccgatgatacgcggaaatacccgagtgtcttctgcaccttttgttcctccgggaacaacaagtcatttacatgcggaaatttcatggtcgcccgcgactctcgtcaaccgagaggagcgaaattagtgtcatacactgattttcggggacctttgcttgatgacatgcgaccattctttggtccttgtgag

SEQ ID NO: 33698 - DNA, 147 bp, Glycine max
  Peptide Sequence Number=SeqID_125383
atgtggaccaccacgggggagatgcttgccgcccagctcgcccaggccccgcccccgccgcttcctccagaagcaacagccttctggaagaatcttctggagggcccaagtgggcctggttgctatttgcacccccatttttactaa

SEQ ID NO: 33699 - DNA, 693 bp, Glycine max
  Peptide Sequence Number=SeqID_125384
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcgttgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgacgaagtgaaagcccctgggattattgaacgtaaatctgtgcacgagcctatgcaaacagggttaaaagcagtagatagcctggttcctataggccgtggtcaacgagaacttataatcggggactga

SEQ ID NO: 33700 - DNA, 630 bp, Glycine max
  Peptide Sequence Number=SeqID_125385
atggtggtctgtgccttcgacggcacccgccgagaagttaggggggagatcgacctccctatacagataggcccccacacctgtcaggttaccttccaattgcccatcctctatgccatagtggaagccgtggaggagtcattagaaacagccttccaatcttttgaggtagtaagcattgcctccgtagattccttctccgggcaaccttgcctgtccgatacggcgatgatggtagcccgggtgatgttggggaatggttatgatcccggaatgggtttaggcaagaacaacagcggcagaaccagcctgataagcaccaaaggaaaccgtgggaagtttgggttaggctataaacccacacaagtggacataaggaaaagtgttgcaggaaggaagagcgaaagtcaaggctcgcaattgggacgagaaattgaaaggggcccgtcctgccacatcagtaggagctttataagcgcgggtctaggacacgaaggccaagtcgttgtgatatgcgaagatgactctccgagtggatcggatttggtacgaccatgccctcttggtttccaactaggaaattggcgagtagaggagcgcccagacatttacgcgacaagcataatgtaa

SEQ ID NO: 33701 - DNA, 267 bp, Glycine max
  Peptide Sequence Number=SeqID_125386
atgacaattgaggaatcaatacatgttacttttgatgaaactaatattacctctccgagaaaggaatttcttgatgatattgcagattctttggaagatatgcacaatcaagaaaggaatctaaaaaggaagagaaatgaagaaaacaatgatgttcaagatgacatagcccaagaaaatgataatcttcccaaggaatggaaaacttcaagaaatcatcctcttgacaacatcatcggagatatctcaaaagggttaacaacttga

SEQ ID NO: 33702 - DNA, 258 bp, Glycine max
  Peptide Sequence Number=SeqID_125387
atgaatttggccattggtaatcgattacatcctgtcgcaacctaccttttggcgggagggcgacgtggggctcacgggtgcatcttccaagaaaggaaaatgcgcggagccgccaccaacgtttatttgaggaaaatgtcggaaaaaccggaaaggtgtggtctacaaaatttaatcatcaaaggtttaggagttgtttttacgcacggggaagacaagggtgtttccctcactcctacgtatcctcaattgcgatga

SEQ ID NO: 33703 - DNA, 264 bp, Glycine max
  Peptide Sequence Number=SeqID_125388
atgcaacagggacaggcagatatccccatagctaggttccctgaccctaactatggtgttaaaacgaaaacgaaaggtcagattagggttttcgttctctacccaaaccgcaagccaagttggaagattccgcttcggttgaagggttcctctcggtgtgggttttcaatggagaacaatgatggtttgtggtggctgtgggtgatggagaaagtgcttggaactttagaaatgactttggaagaaagaaagaagaagaaatga

SEQ ID NO: 33704 - DNA, 815 bp, Glycine max
  Peptide Sequence Number=SeqID_125389
gagcttcattgcctaacagtccaggttacaaaagcaatccccaagagactcaacataaggatgcacatgccaaagttgagtatgtgaaaagattgtatgaccaagtgaaggtgcaatttgcaaagaagaatgaaagctatgccaaacaagccaacaagaacaggaaggaagaggtacttgaacccggtgatgatcctggacatttgagggcaaatgtttttcaagaaggagggaatgatgagaatcctaaaattgccaaaatacagggacctatgaccaggagtaagaccaaacagtcaatggataccctccaacaaatggtagcagacatacttagcaaggcccaagtggagaaggacgaagccctcgattggagaaggacaaagcccccgagttatccttgtggcgtctaccctgacttatcttccttcactggaagtggcgtcatccaaatctccatagcctgtatcaagcgatccgctcctagtcaggatcacatcactccacctcgtgagaggactcttagggaaatggctgcacttgatttcacttatgaaagcttgtgcattcaatatcctgatcaggatgttccgtatgttcttaagactggactaatacatttgctgcctaagtttcgtggtcttgcaaatgaagatcctcataagcatcttaaggagttccatattgtctgttccaccatgaagccccctgatgtccaagaagatcatatctttctaaaggcttttcctcattctttggagggagtggtgaaagattggttgtactaccttgctcccaagtccatttccagctag

SEQ ID NO: 33705 - DNA, 213 bp, Glycine max
  Peptide Sequence Number=SeqID_125390
atggcacgtagcgtgtttactccgtgcccctattttagggacctacaagggagggagctaaaaaggcctttagtgatatttcccaaggtggtcatatctatcttgattgtctctagaggtatcatccccttcaaagaacatattgcagcagtagggactactagcaacaatatgttatcaaagagaaaaactctagatgagggttcactgtaa

SEQ ID NO: 33706 - DNA, 231 bp, Glycine max
  Peptide Sequence Number=SeqID_125391
atggcgaaaatgccactgccattggcagaatgcagtggtgtcgccagtgccattagcgatttggccatgcaagggacggtgtcaatggatatagcaagtggtgttggtgagatcatgcaatatggatatagccattggtgctggcgagatcatgcaactttaaatagcatttttaaaattgcttgctctgcgtttttgaaaattgttgaacctttccttcttcaagtttaa

SEQ ID NO: 33707 - DNA, 916 bp, Glycine max
  Peptide Sequence Number=SeqID_125392
ttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttgttgcgacggccagtgaattttaatacgactcactatagggcgaattggagctccaccgcggtggcggccgctctagaactagtgatagatgatggctttggccagaatggtaacagtgcaacggttaagaagcttttgaattttggatacagttcggagatagaagtgatgagaattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33708 - DNA, 78 bp, Glycine max
  Peptide Sequence Number=SeqID_125393
atgttgtactcaatgcccgggggatccactagttctagagcggccgccaccgcggtggagctccaattcgccctatag

SEQ ID NO: 33709 - DNA, 857 bp, Glycine max
  Peptide Sequence Number=SeqID_125394
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccgttgtagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33710 - DNA, 573 bp, Glycine max
  Peptide Sequence Number=SeqID_125395
atgcacgccctcaccttcagaggactacacgtcctcaccttcaaagggctacacaccctcaccttcagaggactacacgtcctcaccaacagagagctgcacgtcgacaccttcagaggactacacgtcctcgcctccagagggccacatgtcctcgccatcaaaaggctacacgccctcacctttagaggactacacatcctcgccatcataggactacacgtcctcaccttcagaggactacacgtcctcgccatcagagggccgcacgccatcaccttcagcggactacacgtcttcgccatcaaagggctgcacgccctcaccttcagaggactacatgtcctcgccatcagaggattgaatgtcctcgccttcgttgggctacacgccctcaccttcaaaggactacacgtcctccctttcagagggctacgcgtcctcaccttcagaggactacacgtcctcaccatcagaggactacacgtcctcgccatctgcgggctacacgtcctccccttaagaggactgcacgtcctcaccttcaaagggctacgcgccctcaccttctga

SEQ ID NO: 33711 - DNA, 438 bp, Glycine max
  Peptide Sequence Number=SeqID_125396
atgggaacaaatcatactggaaaaaggttttatcaagtcaagattaagggcctagatatcaccagcattaaggagttggggcgattgatgggacctctccaaatgcaagccttccgcaaggcgtacggaaagattttagatttgaccatagtagagatatgcacggaagccattgtatcactcacccaatactatgaccagcctttgagatgcttcacgtttggagatttccaattaggattcggcaagagaattggatcgtgtaaagcaaactcgaaacggcgtagtgggcctaccacggaagtacttagaaggcaaggcaagggatatggcgaatcaagaggagtgggtcccgtttatggacgtattagcatttctaatctttggggttgtcctctttccaaatgtggacggtttggtggacctagccgcaattga

SEQ ID NO: 33712 - DNA, 605 bp, Glycine max
  Peptide Sequence Number=SeqID_125397
atgtcactagcttcaaggaattgggacgattgatgggacctctccaaaggcaagccttccgcaaagtgtacgggaagattctagatttggccgcagcggaggtatttacggaagctgtcgtatccctcgcccaatactatgaccagccgttgaggtgtttcacgtttggggacttccaaatggtaccaactattgaagagtttgaggaaatattaggatgccctcttggggggaggaaaccatatctcttctccggctttcttccttccttgagcaagattgcgactgtgaaatacttggaaggtaaggcaagggatatgccgagccaagggaagtggggccagtttgcagatatcttagctttgctgatttttggggttgtcctcttcccgaacgtcgacggtttggtagacttagccgccattgatgctttcctcgcatatcaccatagcaaggaaagtccagtggtggctatcttggcagatttgtttgacacctttgaccggagcgcgatcaattggtttcctcgttggaaggaaggcaagggaggagttcttttctcgtgtggggactaccctaatattccattgatagggactaggggg

SEQ ID NO: 33713 - DNA, 320 bp, Glycine max
  Peptide Sequence Number=SeqID_125398
gatggaccctcgggtactagtaccctggtcttcagaggactacacgtcctcgccaacagagggctgcacgccctcaccttgggtactagttaccctcaccgtcagaggactacacgtcctcgccttgagaggactacacgtcctcaccatcagagggctgcacgcccttacctccagaggactataagtcctcgccttgagagggctacacgccctcaccttggaggactacatgtcctcaccatcaaagggctgcacgccctcacctctagaggactacatgtcctcgccttgagagggctacacgccctcacctttgg

SEQ ID NO: 33714 - DNA, 369 bp, Glycine max
  Peptide Sequence Number=SeqID_125399
atggaggggagcatagatgtggctctcgtgaaggaattttatgctaatctttatgtcccgggggataaacctccaaagcatgttagggtcagagggcatttaattaagtttgatgtggattcccttaaaacttttctggagactccgattgttctagagccaggggagactgatcgaggccgtacacgaatcaaagaaaacaatgttggagacctagtgtcataccctaatttcatccggggattattatttgatgatatacaacctttgattggccacttcgagatacttggcaccctttgttgcacaatatgtgaagtcccgagacgtgccgaaaatcaaaaggaagcaggcttacgcgatccgtga

SEQ ID NO: 33715 - DNA, 464 bp, Glycine max
  Peptide Sequence Number=SeqID_125400
acgtctggaaagagtgtgccgggttacgagaagaaaatgcagctaccgcaagagcccttgagcaagaaaccaagagggctcgcaaggaagagcatggccatgaaaaatttcgtggagctttgtggggcagaaacagtgagctcaagcttcgaagggaagagagagaccaatcacgagcacatagcatggtcttgaaagaagagttagccgcttgctcaaggtccaaaaggaacttgtctcgacgtttatgcgagacagagaccaacatgttagccatcgtcagcaagtaccaagaagaactaaatcaagccacggaccacgagcataaagtggcggacgagtatgcccaagtgtacgcggaaaaggaggctagaggaagggtgatcgactcattacatcaagaggcaacaatgtggatggaccaatttgctcttaccttgaacgggagtcaagaacttccttga

SEQ ID NO: 33716 - DNA, 48 bp, Glycine max
  Peptide Sequence Number=SeqID_125401
gcatagggcaaaggagcttagaagggtgagggtggcggagggaataag

SEQ ID NO: 33717 - DNA, 78 bp, Glycine max
  Peptide Sequence Number=SeqID_125402
atggctatagccaggtgggcactcaagcagcccgtttatgacattgtgatactacggttggacgacgttcctaaatga

SEQ ID NO: 33718 - DNA, 399 bp, Glycine max
  Peptide Sequence Number=SeqID_125403
atggccgaatatgaagcatgtgccctagccgtccaggcagcaattgactccgatgtcaaactactccaaggtgtacgggcgactcagccgttggtaatcccatcaggctggagaagggggaatgggaaactagaggatccccaagctgataccctccaaagccctacatcaaaggagttggctggagactttcggatggagatctccttcccatcatgttccccgcgagggagaaatcaaatggcgggatgcacttgctacgtgtcgtggcaaacccgcacattgttgccaagtggaagaggaacgggacggaaagcccttggtattacgacatcaagcgatatgtcgaaagcaaagaatacccgccagagattgccgacaacgataaaaggacattga

SEQ ID NO: 33719 - DNA, 204 bp, Glycine max
  Peptide Sequence Number=SeqID_125404
gtctgtgatgcccttagatgttctgggccgcacgcgcgctacactgatgtattcaacgagtctatagccttggccgacaggctcgcgttgactaccgtccctgccctttgtacacaccgcccgtcgctcctaccgattgaatgggccggtgaagtggtcggattggcggcgacctggagcggttcgctgcccgcgacgttgtga

SEQ ID NO: 33720 - DNA, 276 bp, Glycine max
  Peptide Sequence Number=SeqID_125405
atgtgtgttcaggaagaagaaaagcttgtaatggagatgggtgagagtgcattgcttacaactgcttgtaggaagaataaaacaactaggtctcaagctaataagaaggggaatgataaaataccacctcaagatgatattaagaaggtgacaaagtgtttctttagtaagaagaagggacacacgaagaagaattgccccaaattccataaatggcttgagaagaaaggtggattgattttggatctacaatccatattgcaaattatttacaag

SEQ ID NO: 33721 - DNA, 447 bp, Glycine max
  Peptide Sequence Number=SeqID_125406
atgggtgaagtagaggaggtgcaaaagcagatgaaggccgacatggaggccatgaaagaacagatggccacaatgatggaggccatgatgagcatgaagaagataatggaagccaatgcggttgcagttgccgctaccagtgctgttgctaaggtgaacccgatgcccccatctggcctcaaccaaatgaatcatccaacctcagctatggtaggcaaagatttgggaagtacgagcggcccctattatgtgcaaattcaaaacaagcatgtcttcccaccatatgacttgcctcctaactatacaccacccaatgtggcatacactccagtgaggatgtcaataactctgctcccatactcattgaaagccaacaacctcaatctgatcatgcacatgtctcttgaccgatgggggagacacatgaaatgccccaccacaatctag

SEQ ID NO: 33722 - DNA, 252 bp, Glycine max
  Peptide Sequence Number=SeqID_125407
atggcaagtgtagtcgtttctatcctaaaatgttccagcccgcatactgttttagatgctgatgatacatatgtccctgtgaatctacttggagaatctttggatttccaatacatggcagaaaacctgatgttgaaagattacacttccatcttccaggccaacatagtgttctctatgaagaccatgatgatattgatgatgtattgtctaggccaagtatctttgattcaaagtttatttcatggatga

SEQ ID NO: 33723 - DNA, 525 bp, Glycine max
  Peptide Sequence Number=SeqID_125408
atgcaaggtctgggttggctcccgagtttgagaaccactaaagggttggaagttgaagcaacggaggaagacgaagaggtgcgggcccttagggagaatgccgaactaagagatgtaaatatagctaccaccaaggccttggaacaagagaccaaaagggctcgtagggaagaacatggccggaacaaattccgaggggctctgtggggtagtaacagcgaccttaagctccggagagaggaaagggaccaatcacgagtagacagtttgatcttgaaggatgagttgaaggtttgcctaaggtccaagagaagcttgtctcagcgtttatgcgaaacggagaccaacatgctagccctcatcagcaagtaccaagaagaattaaatctagctacagcccacgaacacaaaatggtggacgagtatgcccgagtgtacgcggaaaaggaggctagaggaaaggtgatcaactcgtttacatcaagaggcaacaatgtgggatggaccgatttgctcttactttga

SEQ ID NO: 33724 - DNA, 326 bp, Glycine max
  Peptide Sequence Number=SeqID_125409
atgggttctccacctgcctccacttctcctcctccttctcctcctcctcctcctcctcctacttcggacgcatcggcttcgccctctgccgtgaagcggacacgcaaagcctcacgtctacgattgttgtccactagaccacctagtgctgagagaccagtggtgcatgttgatcctgctaccgggaaggccgacggtccccacaggaagaaattaaaaacatatttggggattgtggcacatgataaggtggacatcacctacgagaactggaagaaggcggaatttgatatcccaaaggcttctgatagtaagacgaacaggaa

SEQ ID NO: 33725 - DNA, 144 bp, Glycine max
  Peptide Sequence Number=SeqID_125410
atggatgcagggaaactgccaggaaaccacattacaagcgaaacctcaaagagagttgggcttcgtcctcaaaaggaaacaacaccagaaaatctagccttccatggattcaaacagaaaacgcaaatgaaacatgaaacataa

SEQ ID NO: 33726 - DNA, 657 bp, Glycine max
  Peptide Sequence Number=SeqID_125411
atgattcctggtcaagcccctgttcctgaaaaactggttcccaaacgacaacagggagtgaagattgctgaaaaccctagccctgcaacaagtcctagggaagtagacccggagatggacaagaagatccgcagtattgtgagtaacattctgaaaaatgcgtctgtccctgaagctgatgaagatgtcccaacatcttccaccccaaatgtttctgtgcctgatgttgataaagatgttccaacatcttccgctccaaatgctgaagccctcccttcacccagtgaagaggaatcaacagaagaagatgatcaagccacagaagagacccctgcaccaaaggcaccagaacctgctccaggtgacctcattgacctcgaagatgtagaatctgatgaggaacccattgccaacaagttggcacctggcattgcggaaagactacaaagcagaaaaggaaaaaccccccttaagaggtctggacgaatcaagactatggcccagaagaaaagcactccaatcactcctaccacatccagaaggagcaaagttgcaatcccttccaagaagaggaaagaaatttcctcatctgattctgatgatgatgtcgaactagatgtctcgacatcaaagagggccaagaaatcagggaaaaag

SEQ ID NO: 33727 - DNA, 562 bp, Glycine max
  Peptide Sequence Number=SeqID_125412
atgggggatcccatcagcagactccccttctctggtaggcgcattgttgtcactcaaaaagcatatgctgctctaaatcagtggaatattgtctctttgctaaagcatgtttgcattttagtggagaaaacaccgagactttttcaagtctcacaagttatccagaactacgtaggtcacgtgacatgcacccttgtatcatccagaggcggcgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaa

SEQ ID NO: 33728 - DNA, 972 bp, Glycine max
  Peptide Sequence Number=SeqID_125413
catgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagggggcttttgctcatggagctatgttttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagg

SEQ ID NO: 33729 - DNA, 252 bp, Glycine max
  Peptide Sequence Number=SeqID_125414
atggatggcgaagagctaccttcacccgtgaactctgatgggcaggatcaccttgggctaccttctggagtgaagacaaaacatgaacggcagaaaccaatcaaggtacttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 33730 - DNA, 849 bp, Glycine max
  Peptide Sequence Number=SeqID_125415
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcacaacttcaaacctcgtcatgaaaaactccccggaagcccgttccaatctaatcgacggttcccctcactcacgacattccagtcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcgggaaatggcttacgaacggggcggagatttcctggaagatgccaggaagatacttaacagggaa

SEQ ID NO: 33731 - DNA, 213 bp, Glycine max
  Peptide Sequence Number=SeqID_125416
agatctgctgcaagtggtttaattcccatagatttggagattaatgctacttgcaggagacgaaatgcagagagaattagaaattttttgcaggacttagaagcagcaacaactccaggagaagaacctcgatcttctgaggaatcttctagttttcctactcaagggcaatctcattcaggagttagaggagacactatcatggctgagtag

SEQ ID NO: 33732 - DNA, 480 bp, Glycine max
  Peptide Sequence Number=SeqID_125417
atgcagaggaactcgccttcctcctctagcgatacttatttcttgccacaaccatcctttttctccgaaaaacctttcattggaatattctcgtttggagtcagggggtgcgaacacacgaccgctgcgggtaacgtcgctcagccccgtgatattggttaccttggccaacaacgagctgatctcgtcgggatgcatcaaacaggaatcttccccgtgcccaccgtgaggaattacgcccccctcgtagataaacctcctgggtgtcattacgtccttcaaaggcttagacctacgcggcctacccgactcaacggcattaactgctccccctccatgattggcaagcgggcagtgttcggtggagtggcccggggtttttcccatggtatgcgcaggttgcgtcagggttataccactttgggaaaggaggctggtagatcttcccgggagatatcacagccatctggttggcgatga

SEQ ID NO: 33733 - DNA, 339 bp, Glycine max
  Peptide Sequence Number=SeqID_125418
atgccaatctcccccttgcaaaagtatcagttggtctgtgtcgtcccgacatggggatcgcacccacaagacacccagtggacccggaaaagtccaacagggccctggggtttccagctctggttacgggcctctatcagtcctatagggtgcccgtacccccccggcaagggatcgcacctgcaagacacccagtggacccgaagaagtccaacaggagtacctgtcacctccagcaagggcatcaggccccctagtaatcgagctttcatcaagaagtactgcgtctccaggcaggcgcagggcgaaacaccacagcagcctggggatggtcggtag

SEQ ID NO: 33734 - DNA, 213 bp, Glycine max
  Peptide Sequence Number=SeqID_125419
atgaaagttatgccaagcaagccaacaagaataggaagaaagtggaagtccaaacttcaacctagaggagacggacctttccaagtactagagaggatcaatgacaatgcttacaagatagatattccaggtggtgattctaaaggtttgagggaaaatgctttccaagaaagagggaatgatgagaatcccaaagctgcccaaatacaatga

SEQ ID NO: 33735 - DNA, 192 bp, Glycine max
  Peptide Sequence Number=SeqID_125420
atggaaatttatatgataacaaaagatgatgacaaaggtgatgacaaaaagttcaaaggtcaatcaaagaatgagttcaagatattcaagatagaatcaagaacacttcaagtttcaaaaggaaagttgatttcaagaatcaagaatcaagattcaagagatcaagattcaagactcaagatagagtcatga

SEQ ID NO: 33736 - DNA, 348 bp, Glycine max
  Peptide Sequence Number=SeqID_125421
atgactctaagacaacatggattaagattaaagagaattcacccgaacaaaaagatagaggaagcaaaagaacatcacctagatgaagatgctctgataccacatggtgcaagctccattggagcttgtaggcctaggatcttcttcatcaatggattcctttgcttcttagaagatgaatggcagcggaatggagaaagggagagagaggggagacgccacttcaaggagaagatgagtctagaagaagctcaccaccatagaaggccatggataagagcttggaggaagaaggagatgaatgaagggagagggagagaagagcacgaaattttgtgctctaaatga

SEQ ID NO: 33737 - DNA, 378 bp, Glycine max
  Peptide Sequence Number=SeqID_125422
atggtgcaaaggaaggacaaggaacttaggggaagtagcaacgggcccatcggcggttaccataggtggttgaaagcctacgcacaaggtctggattggctcccgagtttgaggaccactaaggagatggagggtgaagctccgaaagaagacaaagagagaagaaagggaccaatcgcgagtagatggattgattctgaaggacgaattgaagacttgcctaaggtcaaagaggagtttgtcttagtggttatgcgagaccaaaacaaacatgttagccatcatccgcaagtaccaagaagaattaaatttagccaccgcccacgagcacaaagtggtagacgaatacgcccgagtgtacgcgaaaaaggaggctag

SEQ ID NO: 33738 - DNA, 648 bp, Glycine max
  Peptide Sequence Number=SeqID_125423
atggttgaatacaacggtgataagggggatcggtccccgctgcatccatgggagttgcatgatgtagagacgtgcttagtatccaaggagctgttgcagggattgatagatgaagggcgaattgaaattggccgcgtaatgagggaggaaggagaggtgttcatgcagtcaagtgacaccaacctgggtaagcctaaacctttggtaattcattttaccagagatgttaccactcaagtgcctcgaggtttccaacccgttgtggtgagaacaccatctccattcccttacaaaagtgacaaggcgatgccatggaggtatgacatacaaggatcctacggaaggcaagacgcgtctgtcatgtgtgttggggctagcatgccgactactaagattacgaatatttctagtatgagtggcatgatgagtagtgggcatctttttgctcctcccgaactactggcaaagtcgaatgacaagggaaagacgagggaggatgtggtcgaaagggagaatgtaggccctgtgatgaataacaaggcccctgtcaaaaagcccatggaggaagaagacagttttggcaagaaagagatatttactgaggaagcaacaaaatttccgagaatcattcagcagagcgaattcaag

SEQ ID NO: 33739 - DNA, 207 bp, Glycine max
  Peptide Sequence Number=SeqID_125424
atggagaaagacttcctcactagactcttcaccccttacttcatcttcacttccactagaggaagggcaagaagttgtctcctcttgatgcaatcctatcccgcaagggcattgggtagaagactccaagtagattgggctagagatccaagggaaggccctagggttctcatgaaccttagggtagatttcaagcccatgggctaa

SEQ ID NO: 33740 - DNA, 259 bp, Glycine max
  Peptide Sequence Number=SeqID_125425
ttggaacctcttacgtgccgatcaacgtctcattttcgccaaaagttggccccagggcttccccggtatcaacaagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 33741 - DNA, 93 bp, Glycine max
  Peptide Sequence Number=SeqID_125426
atggggttgagagacatgtacatgattgagggttgtccggctctcaatgaggtatgggagtgggaggttatcgacatccctcttttagggagt

SEQ ID NO: 33742 - DNA, 135 bp, Glycine max
  Peptide Sequence Number=SeqID_125427
atggtggctgacttgttggctgttgggggtgttgaggaaaaaagcccagagtttcaagaatctcgggatttgaggtcaaatccttttcaagggagagggaatgatgcaatcctaccccgcaagagcattggatag

SEQ ID NO: 33743 - DNA, 773 bp, Glycine max
  Peptide Sequence Number=SeqID_125428
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattggagaaaaaataacattaagacagctagaagcacatctttttaaagctgctgataaactcagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33744 - DNA, 100 bp, Glycine max
  Peptide Sequence Number=SeqID_125429
ggggatgggtttgtatttttgtgggctgccttcggtctctcctaatgggatgcagactgtaattgtcttgcttttatctttgtatcttcagtacacctag

SEQ ID NO: 33745 - DNA, 219 bp, Glycine max
  Peptide Sequence Number=SeqID_125430
atgtatgaattctcgagaagagaggagccgtggtggtcccccccggatcgcccggatcccacgagagaagtacgccatgctaatgtgccttggatgatccacatctcagggtcaggcgccgatgagcacattaaactatccatgtggctgagagccctcacagtccaggcacaacgacgcaattatcaggggcgcgctctaccacgtgggatcctctag

SEQ ID NO: 33746 - DNA, 352 bp, Glycine max
  Peptide Sequence Number=SeqID_125431
atggctaagtttgaccttgatatagtcctggagttttatgctaatgcttggcccacagaagagggagtgcgagacatacggtcatgggtgagggaggaggccattgctcagctattatgcacaccgggtcaagatttcacccggaccgctgcagggaggcgagtgcggatcatgcacaccagtatgaccaccttgacccagatgtggatgacattgttgctcagcaatgtcctgcctagtgatcataactccgaccttcctctgtcgaagtgccagctggtgtatgccatcctgacacggatgagcgtccatgtggctcagttgattgctgacgccatctatttatttgtag

SEQ ID NO: 33747 - DNA, 210 bp, Glycine max
  Peptide Sequence Number=SeqID_125432
atgggtgaccaagaggagatacaggaacagatgaaagacgacatgtcggctttgaaagagcaaatgacctccatgatggatgccatgctaggaatgagacaacttatggagaataacgtggccactgctgccgctgttagttcggctgccgaagcagacccaattctcccagctaccgcacaccatcctctcccaaatgtggtaggatga

SEQ ID NO: 33748 - DNA, 668 bp, Glycine max
  Peptide Sequence Number=SeqID_125433
tccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggccgcgagagcgagacaccaggaggtttgcctagagcagccacccttgaaagagtgcgtaatagctcactgatcgagcgctcttgcgcgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaaggggcctaagatcaggccgaagggcgtagtcgatggacaacaggtgaatattcctgtactaccctttgttggtcccgagggacggaggaggctag

SEQ ID NO: 33749 - DNA, 857 bp, Glycine max
  Peptide Sequence Number=SeqID_125434
atgctatcagccagttcctgggataccctttagtgctggaagagggtcaggagtgcgagtatggccagaggaggaaccggtctgatgggttcgatgaggaggccatcgcccatttgttatgtataccggggcaggattttgcccggactgctgccaggagatgggtgcggatcatgcgcaccaacatgaccaccctgactcagatctggatgactttgctgctcagcaacatccaacccagcgatcataatttcgacctccccctgccgaagtgtcagctggtgtacgccatcctgacacggatgagcattcacgtggctcagttaatcgttgatgccatctatctatttgcaggtatggcgcctaccagacaccctctggacccgaataagtccaatagggccctgggatttcccgccttgatcacaggactctgccagtcgttcggagtccacgtcgcacctagcaaggtgattcggccgcccatcacccgagcttttattgagaagtattgcacacagagacaggcccagggggatgctctgcaggccgcagacgcgcagccacctcatcaggctggtccagccggatcgtttgatatggagcagtatttgcggcatttgcttcgccagcaagcggccaaccaccgggctcatgtacaaacccatgatgtcttaccagatgagcctcagctgcagagccacggttttactctttccgtgcctacttcggaccagttcagggcagaggtcgcatggcctggagattggctgaggcccgggcaggagaggcgccagcagaggcaccagcagaggctcccgacgaggcagatgaggcccacaaggacaaggagatga

SEQ ID NO: 33750 - DNA, 631 bp, Glycine max
  Peptide Sequence Number=SeqID_125435
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgggcgtcttgtcgctgaccgacctgtccaactatcgtgtgatcgagcgcgcaccggtctgcttcaattatcgcgctcttgatgtgtgcgggatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33751 - DNA, 202 bp, Glycine max
  Peptide Sequence Number=SeqID_125436
atgcatattgttgtggtaagacaggggcaggatcatcttgagctaccttctggggtgaggacaaaatgtggacggcagaaaccaatcaaggtacttagggcggatgcaagttggggatggggtcacgaccgaccgatttgttgccccttctctgcgcgaaacaagcagagaaatgtcgctgcaaggcagccccgtatccttt

SEQ ID NO: 33752 - DNA, 736 bp, Glycine max
  Peptide Sequence Number=SeqID_125437
cggcgcgcgccgaccagcaggcgatcccggcggtgcagtatctgatgagcgaagatggcggcagcgccaacgcttcttcctgctcggcaccgactacgtctatccgcgcaccaccaacaagattctgcgtgccttcctgcatagcaaaggcgtgcaggataaggatatcgaagaggtgtacacgccgtttggttacagcgattaccagaccatcgtgtcaaatatcaaaaaattctccgccggtggcaaaactgcggtgatctccaccatcaacggtgattccaacgtcccattctacaaagagctggcgaaccagggcattaaagcaaccgacattccggtgatcgccttctcggtgggggaagaagagctgcgcggcatcgataccaaaccgctggtcggtcagctggcggcgtggaactactttgagtcagtggataacccgactaatgcgaagttcgtggccgactaccgcgcttacgccaaagcgcacaacctgccgaacgccagcaccgtagtgaccaacgatccgatggaagccacctacgttggcctgcacatgtgggcgcaggcggtagagaaagccggcaccaccgatgtggataaagtgcgcgccgcgatggccggacagacgtttaaagcgccggacggatttacgctgaccatggacaaaaccaaccaccatctgcacaagccggtgatgattggtgaggtggaggagaacggccagttcaac

SEQ ID NO: 33753 - DNA, 56 bp, Glycine max
  Peptide Sequence Number=SeqID_125438
tcccgagacgtgtcggaaatcaaaaggaagcaggcttacgcgatccgtgaaattcc

SEQ ID NO: 33754 - DNA, 498 bp, Glycine max
  Peptide Sequence Number=SeqID_125439
atgttgctaagtagcaacgtcatctatatctatgtaagagtggtcatgttggtgcgcatgatccgcactcgtctctttgcagcggcacaggtgaaatcttgccccggtacgcatagtagctgtgtgatagcctcccctcttctggttgtgctcgcacagttggccctcctccaatatcaggggggtagcccaggaaccgttaaaaggaaactactgatgtggagcacactgaaaataaggacacatagccctctaaaggtgagggcgtgcaaccctctcaaggcgaggatgtgtagtcctctggaggtgagggcgtgcagccctctgatggagaggacgtgtagtcttctcaaggcgagggcgtgcagacctctgaaggtgaggacatgcagtcctctgatggcgagggcgtgtagccctctaaaggtgagggcgtgtagccctacgaaggtgaggacatgcagtcctctgatggcgagggcgtgtagccctctgaag

SEQ ID NO: 33755 - DNA, 243 bp, Glycine max
  Peptide Sequence Number=SeqID_125440
atgtcgcaacctatccttcggcgggagggcgacgcgagggctcacgggtgcgtcttccatgggaggaaaatgcgcgaagtcgtcaccaacgtttatttgaggaaaacgtcgaaaaaaccagaaaggtgtggtctacgaactttaagtgtgaaaggtttgagagttgtatttacgcatggggaagggtgtttctcttgctcttacgtattcctcaattgtgataaggaaatcaaacctacgtag

SEQ ID NO: 33756 - DNA, 165 bp, Glycine max
  Peptide Sequence Number=SeqID_125441
atggcagaaatcaaccaagggacggatgcgagtggggctagggtcacgaccgaccgatcgttgccccttcccggtgctaaacaagcagagaacgtcgccgcagggcagcccagtatcctttgcgttcgcagtttcttttactactgtttgtttttaaataagtaa

SEQ ID NO: 33757 - DNA, 336 bp, Glycine max
  Peptide Sequence Number=SeqID_125442
gtgctccagtggcttctgtttctatcagctgtccctcctgttcagctactgacggggtggtgcgtaacggcaaaaagcaccccccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 33758 - DNA, 320 bp, Glycine max
  Peptide Sequence Number=SeqID_125443
gtcgactctagaggatcccacctccggaggggcaccatggtgcttaccaacatggatggcgaagagctaccttcacccggatttccggtccgttgtatctcttgttatgatctttcaaagaaatgaacatggatttgaggcttttagtcctcacgggcaggatcaccttgggctaccttctggagtggagacaaaacacgaacggcagaaaccaatcaaggtacttaaggatgaacgcaagcggggatggggtcacgaccgaccgatcgttgcccttctctgtgcgaaacaagcagggaatgtcgctgcaaggcagcccc

SEQ ID NO: 33759 - DNA, 50 bp, Glycine max
  Peptide Sequence Number=SeqID_125444
atggcatcaaggtctaccaagggtcgggcctccaccgatctactgataag

SEQ ID NO: 33760 - DNA, 834 bp, Glycine max
  Peptide Sequence Number=SeqID_125445
atgaacaaagtcggcatcggcatcatcggctgcggcaacatttccagcgcctatctcaaggccatggcttcgtttcccattctcgacattcgcggtcttgcggatatgaacgagcaggcggcaaaggcccgcgccgacgaattcggcctccaggcgaaaagcatcgacgcacttctcgccgatccctcggtggagatcatcgtcaacctgacgatccccaaggcgcatgtagaagtgggtctgcgcgcgctggacgccggcaagcacgcctattcggaaaaaccgttgggcatcaatttcgccgaaggcaaacgccttgcggacgcggcaaaggcaaagagcctgcgcatcggttcggctccggacaccttcctcggcggcgggcaccagacagcgcgccggttgatcgacgagggtgtgcttggccagcccgtgggcggcaccgccaccttcatgtgccccggccatgaacgctggcaccccaacccagccttctattatgaggttggtggcgggccgatgctggatatgggaccctattacatcaccgatctcgtcaacctgtttggcccggtcgccagggtggcgggttttgccattgccccccgcaacgaacgcctcattacaagtgagccaaagaacggcaaaaagatccccgttcatgtcaccacccatgtgtccggcgtgctggccttcgagaatggcgccgttgtgcaggtgggcatgagctttgatgtcgccggccacaaacatgtgccgctggaactctacggcacggaaggtacgctgatctgccccgaccccaaccattttggcggcaagtgcaattgttga

SEQ ID NO: 33761 - DNA, 228 bp, Glycine max
  Peptide Sequence Number=SeqID_125446
atggatgggccctcgggtactagtaccctggtcttcagaggactacacgtcctcgccaacgtagggctacacgccctcacctttagaggactacacgtcctcgcctttagaggactccatgtcctcaccatcagagggctgcacgccctcacctccagaggactacacgtcctcgccttgagagggctacacgccctcaccttgggtactagttaccctcaccgttga

SEQ ID NO: 33762 - DNA, 336 bp, Glycine max
  Peptide Sequence Number=SeqID_125447
atgcaacccgtgcatgatgacataatgcagatgcgaaaaagaaagggtaacaaggagatgtacacagcatggcaatatcatacagcaaaggcaaacatgacatttagaggtatcatccccttcgacaaacatattgcggcagtagggactactagcaacaatatgttatcaaagagaaaaactctagatgggggttcactattaacaagcaagtcggagacccagcatgaccacagattcacctccactccttatgttcccacggacccgggtatagggccccttttcaactcattgtttgtgaaaaaagatattggtgttgtgtgcatcaaatga

SEQ ID NO: 33763 - DNA, 111 bp, Glycine max
  Peptide Sequence Number=SeqID_125448
atgtatattgttgtggtacttaaggacgaatgcaagtggggatggggtcacgaccgaccgatcgttgcccttctctgtgcgaaacaagcaaagaatgttgctgcaaggtag

SEQ ID NO: 33764 - DNA, 283 bp, Glycine max
  Peptide Sequence Number=SeqID_125449
gtggcatgagcaccgggggattcgcgagactctgtttgatcttctcgaaggcctcttggcagtcactgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaagggtgtttccctttgctcctacgtattcctcaatttgcgatgaggaaatcagacctacgtag

SEQ ID NO: 33765 - DNA, 157 bp, Glycine max
  Peptide Sequence Number=SeqID_125450
ttacctcaaagttgcattacgtcatttgggttccatggctcaaggaaggcaagtttaaggagaatctaaaggttttgaagtttaataagtgtgaatttttaacagagatacatgacgtatctgatctcccaaatttggaagaactttcatttgatgg

SEQ ID NO: 33766 - DNA, 270 bp, Glycine max
  Peptide Sequence Number=SeqID_125451
atgaagagggagatgcttgactcgactggaaatgacgggtcgacaactccgaatcacaagctatttactactgtattgtattacacggtaacgacgcgcccccgccttccttgttcaagtagttcaagagttaagggcgtagcaaagtttgtgggggaggttttccttgatctctatgacctctccgaaggggccacacgatatgaatggctgcttaaggaagaggcccaaagcaagcaaaggaaggcttctttcttcccaagacactga

SEQ ID NO: 33767 - DNA, 282 bp, Glycine max
  Peptide Sequence Number=SeqID_125452
ggaggaagctggtacttggatagtggatgtagcaatcacatggctaaggatgagactattttcaaaagcattgatgagttgtcaaagtcaaagttcgactgggaaatggaagtgtggttgaatcaaaaagcaaaggcactgtcatggtggagacagataaaggatgtctccttggtaagcaacactgatttcctttctcacaagcgaagcatggagagcgaaagatctattggagctgatacatacggacgtctatggaccaatgaggacgccatcacatga

SEQ ID NO: 33768 - DNA, 366 bp, Glycine max
  Peptide Sequence Number=SeqID_125453
atggaggccatgaaagaacagatggccacaatgatggaggccatgatgagcataaagaagataatggaggtcaatacggctgcagttgccactgtcagcgctgtttctagggtggacccgactcccccatctggtctcaacctaataaatcgtccaacctcagatactggtggccctcattttgtgcaaacacatgaaatatcccatcacaatctagccgacttcgagcctcgcctcggatatgccactgaagggcaagtatttggcgatatacccctgcaaaacactttggagggccctcagtatcacccacaaccacaccccttgcattccacagcgggtaaaaaccctcctcctatggcataa

SEQ ID NO: 33769 - DNA, 75 bp, Glycine max
  Peptide Sequence Number=SeqID_125454
atgggtgttaagtacctcgaagtggtcaagcaaaggttgcatgccaacaccaaacggtccccggacgaaattagg

SEQ ID NO: 33770 - DNA, 563 bp, Glycine max
  Peptide Sequence Number=SeqID_125455
atggctacctcaccaaaagaaacttcagctcctggttcaccctctgtaccatcatccaccaaagcaccatcaaaccaggaacgacctgaattcaatatccagcccatacaaatgattcctggttcagcccctgttcctgaaaaactggttcccgaacgacaacagggagtgaagatttctgaaaaccctagccttgcaacaagtcctagggaagtagacacagagatggataagaagatccgcagtattgtgagtaacattctgaaaaatgcttctgttcctgatgctgatgaagatgttccaacatcttccaccccagatgttgctgttcctgatgctgagaaagatgttccaacatcttccacccccagcaaagaggaatcaacagaggaagatgatcaagccacagaggagacccctgcaccacgggcaccagaacctgctccaagtgacctcattgacctagaagaagtagaatctgatgaggaacccattgccaacaagttggcacctggcattgcagaaagattacaaagccgaaaaggaaaaacccccattaagag

SEQ ID NO: 33771 - DNA, 204 bp, Glycine max
  Peptide Sequence Number=SeqID_125456
atggaagtttggaaacctattggaagctcccaacacacttctaatgagaggcctttttgttacaaaaacttgaaagcaatgaagctcttaaggtggttggccccttgcttcttgactcaaattcttcaagggatggcaccaatcctcctttccaatttcctatatagcaactcacaaataaggaaacaaagagacaagcaataa

SEQ ID NO: 33772 - DNA, 87 bp, Glycine max
  Peptide Sequence Number=SeqID_125457
atgcggaaattgattaaggttaagtggtggcaggacagaaatatagaaatggcaataaatgaagctacagggctccaaatgaggtga

SEQ ID NO: 33773 - DNA, 255 bp, Glycine max
  Peptide Sequence Number=SeqID_125458
atgtggtccatgcacttgactgacacatgcaaagccttgttatgccctcttccctcggcagggatttcttctttgcgaagcgagatagttattggcagtgatattattgacgagccctccaaatccttctacagagatatcttgggccacatgggcatcggtcaaaccttactaacaacgcccgatgaggctcgagtacatgagtattccacagcgagaccttgccgggttttgttgagctactcaataacttga

SEQ ID NO: 33774 - DNA, 390 bp, Glycine max
  Peptide Sequence Number=SeqID_125459
atgctgcaggtcgactctagaggatccccagaaggtgatgaagaaagagagacaccaataagagattgtcaagagaaaataaagaatcggtacatccatagtgacaaaattgttgtggaaggcaaagctttcatagacttgggagctagtatcaatttaatgcctttttccatgtgtcggcgacttggagagatagagataatgcccacacgcatgtgtggaagcaaagcttccaagcttattttgatgatgctaaagactcaagtcaagaatcaagattcaagcaagtttcaagaatcaaagagtcattcaatcaagaatcaagattcaagtgaagattcaagagaagactcaagatatgcaagaacctcaagaaaagcatcaagataa

SEQ ID NO: 33775 - DNA, 210 bp, Glycine max
  Peptide Sequence Number=SeqID_125460
atggctctagtgactgtgcattttgagcattttgagtattctgttgctggtgattctgaacattctgattttgagcattcgactactaattttcatactgagaacatggctcaacctccacctcgtgagaagactcttagggagatggttgcacctgatttcacttatgaaagcttgtgcattcaatatcctgatgaggatgttccatat

SEQ ID NO: 33776 - DNA, 603 bp, Glycine max
  Peptide Sequence Number=SeqID_125461
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctggcgaaagactaatcgaaccgtctagtagctggttccctccgaagtttccctcagatagctggagccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatgg

SEQ ID NO: 33777 - DNA, 711 bp, Glycine max
  Peptide Sequence Number=SeqID_125462
atggaggactacatatcgtgggagctgggatatagcatcagcgctagatccctcggagacgacatagtactaattactggtctttcagcggataaggcccaacagcttatcaactcagagacgaacggcggcaataccctcttttattccctcgagaggtggcgtccggggtacagggtatctaatcggatcgtgtggcttcaagtatggggtttcccgattgaagcatgggaagtggaccatatgaagcaggtcgtctcaaccatcggagacgtgatcgaggtcgatgaagacaccgaggacaggaggagactggatcgtgcacgattgttagtacgaactcccctgccgccggcgataatcaaggaaacaatcgttcgttgtggtgaagaagatcacagagtgtggttggtggaggaggtaggtgacggcggggacatgcggagaaccagattatccatgtccggcgagtggacggatgaggtcacgtcggaggaggagggtgttgcggaggaagacgatgacggtgacaccgcattttcctactcgccggagctgtcagtaaccaacaacaacttcttcttgaaccaccagtcaaaagttttacccagcggtccttgtggccaaactcgggatcgaggagatgcagggaaatctttccccagtggtcataacatcggaacccgagttagacgtgcttcgaaagtctga

SEQ ID NO: 33778 - DNA, 246 bp, Glycine max
  Peptide Sequence Number=SeqID_125463
atggcaacaaaagatgatgacaaaggtgatgacaaaaagctcaaaggtcaatccaaggatgagttcaagatgttcaagaaggaatcaagaacaaggatgagttcaagatgttcaagaaggaatcaagaacaattcaagatcaagactcaagaggaaaagttgaagaacatttcaagattcaagaagacggatgaattcaagaatcaagatcaagattcaagattcaagaatcaagagaagacttaa

SEQ ID NO: 33779 - DNA, 141 bp, Glycine max
  Peptide Sequence Number=SeqID_125464
atgactaaagcacgtcaaaaggggataccaggaaaagagggagaagagggagaagcttgccacccagctcgcctaggcgagctaggttgcttcctccagaaggcaccgccttctagggaacttcctggaaggcccaagtga

SEQ ID NO: 33780 - DNA, 756 bp, Glycine max
  Peptide Sequence Number=SeqID_125465
atgggatcaagtcaaacaccttcacttaaaaagaggttctatcaagtcaaggtcaagagcctagggatcaccagtctaaaagagttagggcagttgatgggtcagctccagcggcaagctttttacaaaacttacggtaaaatatgggacctagccatggtcgaagtctccacagaggcctccctcgcccaatattatgatcagctgttaaggtgcttcacctttggggacttccagctatcacccatggtggaagaatttgaagagatcttaggatgtcctctaggggggagaagaccatacctcttctcagggttctatccctcattagctagaatttctaagatagtccaaatctcggcacaggaattagaccacaggaggcaagtcgaaaatggggttgttggaatactgagaaaatatttggaggcaaaagcaagaatcttcgcagcgatcgacacttttctcgcctatcataaccataaggaaagcctggttgtcgctatgctagctgacctatatgacaccttcgaccgaagatgtgagaagcgcagtaagaggattctctactgtactcccgctctttatgtatggttggtttcacacctttttcgccaagaggtgaggcatgcctgcccgttagaaagccaccgttcatgcacagagaaaggaagggcgaattgggaccaactcttagcaaacagagaaggagcatctgtcaactggttccctcgatggaaagaaggaagaaccgga

SEQ ID NO: 33781 - DNA, 243 bp, Glycine max
  Peptide Sequence Number=SeqID_125466
tgttttaaaggctacttggacgtttcagcttttgaaggctcacttagcgagccaatcttgctaagcgagacgcgagaagggacaaatgactcgttgggcaagcttgcggcatgctgggcgcatacatctgtgactgatcctcttctagggtttcccaacatgctaagtgagctgcatgtctcgcttagcggatgtcactcgctaagcgcatatgcctcgcttagcgagacatcaactgcttga

SEQ ID NO: 33782 - DNA, 609 bp, Glycine max
  Peptide Sequence Number=SeqID_125467
atggaggccatgaaagagcaaatggccacaatgatggaggccatgatgagcgtgaagaagataatggaagccaatgcggttgcaattgccgctaccagcgttgttgctaaggtgaacccgacgtccccatccggcatcaaccaaatgaatcatccaacctcagatatggtaggcaaagatttgggaagtacgggcggcccccatgatgtgcaaattcaaaacgagcacgtcttcccgtcatatggcttgcctctcaactatatgccacccaatgtggcgtacactcccaccgacttcgagccttgcctcggatatgccactgaagggcaagcagttggtggtatacccctacaaaaccctttggagggccctcagtatcacccacaactacacctcttgcatcccacaacaagtaaaaaaccttatgctatggcagaaatgggaaagttggatcatctagaggaaaggctcagggccattgaaggaggtgaagattatgcctttgctaacctagaagagttgttcctagtacccaatatcatcaccctccaagttcaggtgccggactttgacaagtacaagggactacttgccccaagaaccatctaa

SEQ ID NO: 33783 - DNA, 186 bp, Glycine max
  Peptide Sequence Number=SeqID_125468
atgaagttttatatgaagttgcaaatgaagaaactgcaagtggcttatggctcaagttggaaaagttgtatactgactaagtcaatctgcaacaagctcttcttgaagaggctttatttggttcatcatgaaaaagacataggattaaatttcctagaggaagcaattcacaccactgaactctga

SEQ ID NO: 33784 - DNA, 486 bp, Glycine max
  Peptide Sequence Number=SeqID_125469
atggaaaaacggctttggccgcggccctctcacttccctgttaagtatcttcctggcatcttccaggaaatctccgcccccgttcgtaagccatttccgctcgccgcagtcgaacgaccgagcgtagcgagtcactggcacgacaggtttcccgactggaaagcgggcagtgagcgcaacgcaattaatagcggccgccaccgcggtggagctccaattcgccctatagtgaggtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgacccgctacacttgccagcgctga

SEQ ID NO: 33785 - DNA, 207 bp, Glycine max
  Peptide Sequence Number=SeqID_125470
atggctgatgagcaccagcaaagagttacccttgaggactattcaaacaattcagtgccgcaattctttaccagcattgcacgtcctgaagtgcaagctcacaacataaactaccctcattctttgattcatttaatacaggggaacttattccaaggattaccaaataaggatccctatgcacatttggcgacattaacactataa

SEQ ID NO: 33786 - DNA, 477 bp, Glycine max
  Peptide Sequence Number=SeqID_125471
atgatatatgctataaaaaatgtgaggatccccaagtatttggacttggaatggttctctcaacaagggttcaaatttcctaatttgctggaagcacaaggattgtcaaagctggtgcagatgaaaaaaactttttatctggagctagtcaaggttttctactcttgtgcacatgctgaccttgaaggtaacctcttctctattgtaaatagagtagatatggtcattgatgctgttgtgtggaaggaagtagttagtttggacatgggtggagtctgtaagtttgatgaaaatcttgatgggtatagcatgatgcagacttataggggaatgcttcttgatttagctaggaacttgaggaatcacttaggagttggtggactgactgtagaagacagaatgttggtttaccttatcacctacattctcacttcgaggttaagcaatcatgctcaagaaacaaatgatggtctatag

SEQ ID NO: 33787 - DNA, 693 bp, Glycine max
  Peptide Sequence Number=SeqID_125472
atggtggatattgatgtttctgagcatcagattgccaaggaaatcactgcgaaacgagtccagcattggccaaagaaagggaagctttctgcagggaagctaagtgtgaagtatgcaatcctgcacaggattggggctgcaaactgggtacccactaatcacacgtccactgttgccacagaatcttttgctgtcaagttacccattgccttcccaactgtattgtgtggcattatgttgagtcaacatcccaatattttaaacaacattgactctgtgatgaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggtgaagcagctgaggcagaagaggaagcagctgaggaagaagaagaagcagctgagaagaagaagatgcagcagaggatacagaatcagatgatgatgattctgaggccacccatgaccatcagacctttattttgccttttactcttactagctatagggagcatgtccctttga

SEQ ID NO: 33788 - DNA, 360 bp, Glycine max
  Peptide Sequence Number=SeqID_125473
atgtgtaagaaggagcatgaatctttcaaagaatgcgcccaaaggtggagggatctagcagctcaagagaagatgatgggttacatgccttcaagctttgtagatttagtgtttgctggcgaaaagattcaagtgggtctgagaagaggcaaatttgattgtcctgctttgatgaataggaagcctgaggcaaatggagagaataaggagggaggaacccatgtcgtgactgtcattttctacatggccaaatttcccactagctcaacaatatcaatactcagccagtatcatccccttctcattacccaccaccctattaaccaagaacacccaatcatccataaaggtcacccctaa

SEQ ID NO: 33789 - DNA, 429 bp, Glycine max
  Peptide Sequence Number=SeqID_125474
atgaagaattgggaaaccattttagaacttcaaacaagattcactcacattgtgaactatctccttggtcaaggaaaaacatgtgaagatgaagagctgaacatcaagattttaaattgtcttacaagaacttcagaaccaaagcttaaagtaatcaaggaatctaagaatttagctacaatggcgatggaagctttcttcgctaaattgcttgcctatgaacatgaacagattcatcaatcttacatagaagaaacagaaaagaaaagaaaaggaattgcactgaaattcaactccttaaaggaagaatacagagatagttccagtagtgaggaagatgcagagaacttcaatttgatggcaagaaaatttggaaaatttctcaggaatccaaggatagaaaattctccaaatcatccagaagattga

SEQ ID NO: 33790 - DNA, 138 bp, Glycine max
  Peptide Sequence Number=SeqID_125475
atggaggaagaactgcaggatgttcgtggagccaatctgaagtattgctttatggtgacactggctccagcagcacggacacgactagggtgctctggtcgcccaatggcagcagaattaatcaaacattgggcttaa

SEQ ID NO: 33791 - DNA, 444 bp, Glycine max
  Peptide Sequence Number=SeqID_125476
atgtccaaatcttgtggattcgggatgaccggccctctcgatgagtcgatctcttgctttctcataagggtggacccttgggtacttgtacctatcacctttagaggactacacgtcctcgccttgagaggactacatgtcctcgccatcagaggacttcatgtccttgccatcagagggctgcacgccctcacctgcagaggactacctgtcctcgccttgagaaggttacacgccctcaccttgggtactagttaccctcaccaagggctgcacgccctcaccattagaggactacttgccctcgccttcaaaggactacacgtcctcgccttgggtactagttaccctcaccgttcagaggaccctacatcgagctttcatcatagaagactactgcgtcctccagtcaggcgcagggtgaaacaccacagcagcctttga

SEQ ID NO: 33792 - DNA, 753 bp, Glycine max
  Peptide Sequence Number=SeqID_125477
atgcagcaacctggagcaattgagcagcctgaagcttatgctgcaaatatttacaatagacctcctcaacctcagcagcaaaatcaaccacagcagagcaattatgacctctccaacaacaaatacaaccctggatggaggaatcaccctaacctcagatgttccagcactcagcaacaacaacagcagcctgctccttctttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagctgccttctcaagctgtccaaaatcccaaaaatgtcagtgccatttcattgaggtcgggaaagcaatgtcaaggacctcaacccgtagcaccttcctcatctgcaaatgaacctgccaaacttcactctattctagaaaaaggtgatgacaaaaatttacctaacaatttctgtgcagaagcatcacatccctcctcttccattccctccagagcagtttccaacaaaaaaatgaaagaggcagagaaagagatcttggaaacatttagaaaagtagaggtcctttgcagtcaactgatgtggtaa

SEQ ID NO: 33793 - DNA, 423 bp, Glycine max
  Peptide Sequence Number=SeqID_125478
atggcgaattcgtcagattccattgtgtcttccacaatggaatctgataagtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaatcctgggtcttgaacagtaattcgattgatgataaagaagagaattcttggttcagttttctaccttacgacagaaaaaggattgatcaattctatgagtctgactcatag

SEQ ID NO: 33794 - DNA, 327 bp, Glycine max
  Peptide Sequence Number=SeqID_125479
atggtgggttacacgccttcaagctttgcggatttggtcttcgctagcgaaatgatcgaagtgggtctaaaaagaggcaaatctgatcatcatgctttgatacatgcaaaaaaaactggggcaagtgaagagggagagaatgagggagaaacccatgttgtgactgccattcctatacaaccaagtttcccactaacccaacaatgtcattactcagccaataacaaaccttctccttacccaccgcccagttatccacaaaggccatccctaaatcaaccacaaagtctgtctaccacacttccaatgacgaacacccacctttag

SEQ ID NO: 33795 - DNA, 513 bp, Glycine max
  Peptide Sequence Number=SeqID_125480
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctggttcgagtgagagcataccctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 33796 - DNA, 410 bp, Glycine max
  Peptide Sequence Number=SeqID_125481
gtatttattcggcgcaaagtgcgtcgggtgatgctgcccaacttactgatttagtgtatgatggtgtttttgaggtgctccagtggcttctgtttcttatcagctgtccctcctgttcagctactgacggggtggtgcgtaacggcaaaagcaccgcccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccaggcggtttgcgtattggggcgctagcggagtgtatactggcttactatgttggcactgatgagggtgtcagtgaagtgctttcatgtggcaggagaaaaaaggctgcaccg

SEQ ID NO: 33797 - DNA, 287 bp, Glycine max
  Peptide Sequence Number=SeqID_125482
tgacttcttttggataccgtaaggatcagaatggtcaatggctgaagaaagatgcacttcctcctcaagatgagcgtactccttctcctcctcctcagcgagatgattcagccctcatgactgaagttctttccgagttatggggtcttcattcttatgttggtgaacgtttcgactcattggatactcactttgccggaatggatctccgtcttacacagcttgaagaagatgtgggttacattcgtcagagtttcgatcttccaccaccacctccaccttcttag

SEQ ID NO: 33798 - DNA, 273 bp, Glycine max
  Peptide Sequence Number=SeqID_125483
atgtgtaatcgtttacatcataatggtaatcgattaccagtgataggttttgaaaaattgccaagagtcacaacttttaaagtgactggttttgaaaaaattgccaagagtcacaacttttttaaagtgacagggaccaacgttccttgtgatgaggacatgaccaagagcaagggcaaggatccacttgaaggacttggaggacctatgacaagggctagagcaaggaaagccaaggaatctcttcaacaagtgttgtccatactattttaa

SEQ ID NO: 33799 - DNA, 366 bp, Glycine max
  Peptide Sequence Number=SeqID_125484
atggtagccataaccctagccaaggttcatcaacctccatttctccgagaatacgactcgaacacaacgtgtgcttgtcacggagaagccccggggcgttccattgagcattgtagggctctgaagtgtagtgtcgcaacctacccttcggcgggagggcgacgcgagactcgcgggatgcgtgttccacgaaaggaatacgcgcggagtcgccaccaacgtttatttgaggaaaacgtcggaaaaactggaaaagacgcgatctacgaactttttagtgaaaggttcgggagttgtatttacgcacggggaaggtcgacaaagggtgtttccctttgctcctacgtattcctcaatttgggatga

SEQ ID NO: 33800 - DNA, 813 bp, Glycine max
  Peptide Sequence Number=SeqID_125485
atggagttcttctcaaatgagaattttgaatgctttcaagcatttgaaaactccaatcttattccattcatgtctctgaaattacctgtttattctgaactagtcaaagctttctattctaatttagaaatccatgaaggtaccctaatgtctgaggtttatgggattaagatggtcattgaccaatccctattttatgatttaacaaaattgcctagtgaaggtgtgccttttgagggtgcactgattgatgattggaaattcgatttttctgtgcatgatgcccgccggttggtttgcaccaaccaatcggatatgatcggaaggcttcttgccggatcattggcttttgaaagccacatcctccattaccttattgttcgcattttgcttcctagatcttcaaaccttgcccaggtttctgaagaagatctcatagtcatgtgggcctttcataaaggtttacaaattgattgggcacaccttgttagatatcgcatgcataaggcattgcgattgaatgcccttttgccttatcctcatcttattacccttttccttcaacacttcaacatccctcttgattctgaaccctatgttccaatcaagagatcattccttataggcgcttctgtcatagcatcctttggttatattaaggagcatgatggctcttggattttggaaagggttgatggtcttcaaacctttgttggtgagaggtttgatactttggaattgcaagtggatatgcgcttcattgaaatggagtcaagattgacaaaggttgaagaagaggtatcttacatctga

SEQ ID NO: 33801 - DNA, 96 bp, Glycine max
  Peptide Sequence Number=SeqID_125486
atggcattgggcaaaagcatcaatggaacggggaaacaacagaggctagagagaaaactcagaaacatggaggcgatggagcagatgagatcatga

SEQ ID NO: 33802 - DNA, 189 bp, Glycine max
  Peptide Sequence Number=SeqID_125487
atgccgatctcccccagcaaaattattggttggtctgtaccatcccgacataggggtcgcgcccgcaagacaccctatggacccaaagaagtccagcagggtcttggagttgccagctctgattacgagcctctgtcagttctacggagtgcctgtcgcccccagcatgatcatcaggccccctactaa

SEQ ID NO: 33803 - DNA, 1005 bp, Glycine max
  Peptide Sequence Number=SeqID_125488
atggtagtggtggaattgctcatcgtcctgctggcgatctggctgggtgcgcgcctcggcggcatcggcattggctttgccggcggtttaggcgtgctggtgctgacgctggtttgcggcatgaaacccggcgcgattccgtttgatgtcatcgagatcattatggcggtgattgcggccatcgccgcgatgcaggtggctggcggcatggattatctggtcgggctggcggaacgtctgctgcgccgccatccgcgctatgtcactttccttgcgccgctggtgacctatgcgatgacgttgctggcgggcaccggtcataccgccttttcaactctgccggtgattgcggaagtggccaaagagcaaggcgtacgcccttcgcgcccgctgtcgatagccgtagtggcgtcgcaaatcgccatcaccgcctcgccgctttcagccgcggtggtattttttgcctcgattcttgaaccgcgcggcgtcagttatctggcgctgctcggcgtcgcgctgcctgccaccatgctggccattttctgtgccgccgtgatcaccaacttcctcggcaaagagctcaaagaagatgacgtctaccaggcgcgcctggcgaaaggtgaagtaacgctgcgcggtgagcaggtttatcacattaagccgggagccagacgcgcggtgctgctgttcctgatcggtattggggcggtggtactgtacgcgacggcaatcagcgacagcgtgggcctgatcagcaatccggtgctgccgcgtaacgaagccattgtggtgtttatgctgacggttgctacgctgatttgcctgacctgcaaagtggaaaccggtgaaatcctcagtgccagcacgtttaaatccggcatgagcgcctgtatctgcgtaatgggcgtcgcctggctgggcgatacctttgtcaaagcgcacctgagcgacatccagacgctggccggcgacatgctgcagagctatccgtggatgctggcgctg

SEQ ID NO: 33804 - DNA, 240 bp, Glycine max
  Peptide Sequence Number=SeqID_125489
atgtcggataatctagcaagagcttctagcgcaagggagtaccagatagagcttcaacaagtgggaatcaatacagcaacaagtccgatgttgaatgagatagctttcatcttccaatctttccgagctaagaagtttgaaaggggcagtcttccatgtcactcggaaggcagatcaagtcaaaagtttgatgcactggctagcctagactcccattcaggcactgccgggatagactga

SEQ ID NO: 33805 - DNA, 492 bp, Glycine max
  Peptide Sequence Number=SeqID_125490
atgacagatcttgtgagcgcggaagatgacataaatttctgcgtgtcaacgggcttgtcggccgcggttgacgaagggcgcagaagacgacgtttgtctccgcgtgctatcaggctttttttcttacagacagcaaaaaagaatgtttatacggataaccactcgggtatttccgcccgtcagcatgactcaaatgtcagtatgacagatcttgtgagcgcggaagatgacgtaaatctccaggtgtcaacgggcttgtcggccgcgattgacgaagggcgcagaagacgacgtttgtctccgcgtgctatcaggcttttcgtcttacagacaacaaaaaagaatgtttatacggataaccactcgggtatttccgatcgtcaacgtgactcaaatgtgagtatgacagatcttgtgagcgcggaagatgacgtaaatctccgcgtgcaaacgggcttgtcggccgcgattgacgaagggcgcagaagatga

SEQ ID NO: 33806 - DNA, 724 bp, Glycine max
  Peptide Sequence Number=SeqID_125491
gggagcaccggtggaagaaagcatgtctcctttccttgtgagggatttcggcgcgcaaaatttcaaggctatacaaagaatccataaggcatgggaaaccccgttaaggaaagatcatgaacttaggggcattcgtaacgacatcattggtggttatcatgaatggctgaaagttcatatacgaggtttagattggctcgccaagttaaaagtcgtcagcgaagacagtttcgaagcaccagaagaagacgaagaagtccaagctctcaaaaacgagttaggaaaggcgaaacttgccaaggagaagttcaagttagccgctacacacatccggaaggaatgtgccggattacgggaagagaatgcaactaccgcaaaagcccttgaacaagagaccaagagggctcgcaaggaagagtatggtcgtaacaaatttcgcggagctctgtggggtagcaatagtgaactcaagctgcgaagggaagagagggaccagtcgcgagcacatagcatggttttgaaagaggagttagttgcctgttcaaggctagagaagggtgatcgactctttacaccaagaggcaccatgtggatggatcggtttgctcttaccttgaacgagagtcaagaacttccccgattgttagccaaggccaaggcaatggcggacacttactccgccccgaagaaattcatgggcttctcggctattgtcagcatatga

SEQ ID NO: 33807 - DNA, 148 bp, Glycine max
  Peptide Sequence Number=SeqID_125492
atgggggaaagttctacagttctagacctaaagccacatgagggaggagaagttgcctttggaggcataggtaaaggaaaaatctctgatataggtaaaattggtattccttctctagcctccataaataatgtcttgtatgttgaag

SEQ ID NO: 33808 - DNA, 423 bp, Glycine max
  Peptide Sequence Number=SeqID_125493
ggtacatcctttgtggtacaagtagagggaacatctacttggcttgttgtaactgagaacaagagagggaacatctcttgtggatcagttctagtggagggaacatccactaggttgttcaaagagaacaagggagggttgaaaagaaatctcaaggaccgccagttcgcttggggactggatgtaggcacgggttgttgccgaacccggtgcctgatgctaaaaggtgtggaagcaatgacttccaagattattttgatgatgccaaagaatcaatcaggagtcaaaaagcttccagaatcaagtttcaaagaatcgggattcaagattctatcaagtttcaagaatcaagattcaagaataatcaagatcaagattcaagactcaagattcaagaatcaagagaagactcgatcaagataa

SEQ ID NO: 33809 - DNA, 598 bp, Glycine max
  Peptide Sequence Number=SeqID_125494
aggactacctgtcctcaccttcagaggactccacgtcctcgccttcagagggctgcacgtcctcgccttcagaggactacacatcctcaccttcagaggactccacatcctcgccatcagagggctgcacgccctcaccttctgtggactacacgtcctcgtcttcaaatggtcatgtaccttcaccttcagaggactacacgtcctcgccttcagagggccacacgccctcgcctttagaggactacacgtcctcaccttcagagggctacacactttctccttcggctacacaccctcatcttcagaggactatacatcctcccttgagaggacgacacgtcctcgccttcggagggctgcacactcccttgcctttagagggctacacgtcctcgctttcagagggctccacatctgcaccttaagggaatttaagggcgccaactatgcgaatacaaccaaagagggaggctatcacgcaactactatgcataccggggcaagatttcactcgtgtcgctgcaaagagacgagtgcagatcatgcgcaccaacatggccactcttacacagatatggatgacgttgctacttag

SEQ ID NO: 33810 - DNA, 372 bp, Glycine max
  Peptide Sequence Number=SeqID_125495
atggcaattctttctatgaaaaaatcagcacagcgagttcaagattttcaggaactccctgcttataacgaaatacctgaacttctgtggctcagcatacgcgatgcaccatcaagcttatcgataccgtcgacctcgagggggggcccggagaaaaaaaggctgcaccggtgcgtcagcagaatatgtgatacagggatatattccgcttcctcgctcactgactcgctacgctcggtcgttcgactgcggcgagcggaaatggcttacgaacggggcggagattttcttggagatggcaggaagatacttaacagggaagtgagaggggccgcggcaaagccgtttttccataggctccgcctcccctga

SEQ ID NO: 33811 - DNA, 744 bp, Glycine max
  Peptide Sequence Number=SeqID_125496
atggtagaatcgtcaaagaaacgaaagggttcttccgcctccgcttcggcttcaagagctcatcgttctggagccactagcatccacagcaccaattccaccctcattgtcctcttcccccagtgttttctttcgacgaacagcagaaacgcctttcagaacttaggtcttctaccttttatgtcattacaattgcctatttatcctgaattggttaaagctttttattgtaatcttgaaattcaggacatcactctgatttctgaggtttttggaataaaaatggtcattgaccagtcccttttccatgacttaaccaaattacccagtgacggtgtaccatttgaaggtacactggatgacgactggaaatttgatttctctgcacatgatgcccgccagttggtttgcaccaacaatgcggatatgaccgaacgccttcttgccgggtcattggcttttgaaagccgcatccttcactatttaattgtgcgtattctgcttccacggtcttccaaccttgcccaggtttctgaggaagatctaattatcatgtgggcctgtcatgcagggcgtcaacttgactgggcacacttagtcagatatcgcatgcataaggcattgcgattaaatgctccactaccatatccacagcttgttactctctttcttcgtcattttggaattcctcttgattctgaatctatatccaatcaagagatctttttaatggggctgctgtga

SEQ ID NO: 33812 - DNA, 720 bp, Glycine max
  Peptide Sequence Number=SeqID_125497
atgaccaccctgacccagatatggatgacgttgctcctcagcaacatcttgcccagcgatcataattccgacctccccctgccgaagtgtcagctggtgtacgccatcctgacgcggatgagtgtccatgtggctcagttgatcgctgatgccatctatatttttgcaggtatggcgcctactaggcaccctttggacccagataagtccaacatggccctgggatttcccacactgatcacaggactctgccagtcatttggagtccccgttgcacctaccaaggtaattcggccgcccatcacccgggcttttattgagaagtactgtacccagagacaggctcagggtgatgctccacaggccgcaggcacgcccccaccacctcatcaggctggccaggctgggtcatttgacatggagcaacccatgatttctgtaccagatgagcctcagcatgcagagccagggcttcgcttctttttcatgccctactccagaccagttcaggacagaggttgcatggcccagagattggcccgaggcccaagcaggagaggcgcccccagaagctcccggcgatggagaagaggcccacgaggacgaggagatgccgatttgcttgacttcttggagggagtggagatacgtgactgggagatcccagattcatgttttctttcatatttctttgtcatttttatctatgttattgtttga

SEQ ID NO: 33813 - DNA, 360 bp, Glycine max
  Peptide Sequence Number=SeqID_125498
atgaggattccttttttacaggccaaggttcaaaaaggtccgaggttgtgtttcaatggggtcttttatcgtgggaacccaatcttgatatctggggtgaaacaaatctgggtgacaaggtgtcggtctcgggccgaacttccacattattccataaggcacacgcatgacaatgatgatttgaaaacaacgtgcaaaattagtcatggctacaaccaggtgggccctcaagcatcccgtttatggcattgtgatactacggttgggaatttacacggacagacccaacgtttcccaattatgttctttcatcagttcaacgaattcatccatccttatctcggttcattccggaaataa

SEQ ID NO: 33814 - DNA, 354 bp, Glycine max
  Peptide Sequence Number=SeqID_125499
atggttatgggagatttcatcagcagactctccttccccgaaaacacccttgtatcatccagagacggcgggcccgatgatacgcggagataccttacggttatccgcacccttttgtcatccagaggcggcgggcccgatgacaagcaagaccaagtttggtcattctgcacccttgtatcatctagaggcggcgggcccgatgatacgcggagataccttacggttatccgcacccttttgtcatccagaggcggcgggcccgatgatacgcggaaatacccgagtggttatccgtataaacattcttttgctatctgtaagacagaacgcttgatagcatgcagagactga

SEQ ID NO: 33815 - DNA, 663 bp, Glycine max
  Peptide Sequence Number=SeqID_125500
ttggaactcttacgtgccgatcaacgtctcatttcgccaaaagttggcccagggcttcccggtatcaacagggacaccaggatttatttattctgcgaagtgatcttccgtcacagctgtcctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattttccttggcggagccattgggaatgtcggcgtttacggcacgagcctgttcagccttctccgtcacatcgtcttctggttcttcgtcactggaccagtccatgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaaagtgcttcatgtggcaggagaaaaaaggctgcaccg

SEQ ID NO: 33816 - DNA, 318 bp, Glycine max
  Peptide Sequence Number=SeqID_125501
atggtctttgtacttgatggtgctcatgttcatacgtcgtatgttgtgtatgttcatggggggttccttgtgaggaggactacttgtactagggggtgtgtcactcagtttgggaactcccttgtagcccaggctgatcaccatgggaggggggagttacggtgcacgacagggtggcctcgacatgatatgaatggcagcggaatggaaaaggaagagagagaggagacgccacttcaaggagaggatgagtctagaagaagttcaccaccaaaggaggccatggataagagcatggaggaagaaggagatgaatga

SEQ ID NO: 33817 - DNA, 344 bp, Glycine max
  Peptide Sequence Number=SeqID_125502
gcggtttgtcctttgaacacttttgtataagggaaagggaagaatcaaatcaattctcagactgcgtcgttttgaattctttgacaagggagaaaggagacagaaaagaattcgggcggttagtcccttgttcttttggaaaagggagaagagagacacaaaaagaattcaagcggttagtccttggcgaattctttttggcaaagggagaagggaatgaaaagatgaatagcacaagttttcaaggtttagaaaaccagaaaaactttggaaagcttttggcaaaaggaagaagaagaagaagttcaaagagattcaaggcttgtaaaggattgtatgaataa

SEQ ID NO: 33818 - DNA, 204 bp, Glycine max
  Peptide Sequence Number=SeqID_125503
atgtctgcatttgaaaaaatgtgctttgcggatatttttgcacaaagaaccaagttgtacaagtgggcaattgggggcacgtattcaatggtgactagtcattactcattaggtttcttaggagaaattctgcatcacactctaacgcaagttggttactgcaagagggtccaaaaaggccttgggtgtccagatcgttcgtga

SEQ ID NO: 33819 - DNA, 234 bp, Glycine max
  Peptide Sequence Number=SeqID_125504
atggcacatgtgttaggagaagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 33820 - DNA, 427 bp, Glycine max
  Peptide Sequence Number=SeqID_125505
gataggaggcagaacaatcaactggttttcacgatggaaggaaggaaaagagggagttctcttctcatgtggggactacccaaacatcccgttgatagggacgaggggttgtattaactactatcccgcgcttgctataagacagttagggaaagataaaggacttaggggcatccataatggtatcatcggtggttatcatgaatggctgaaagttcgtacacgagggttagattggctctccaagttgaaaattatcaatgaggagaacttcaaagctccggaagaggatgaagaattacgagaagaaaatgcagctaccgcaagagcccttgaacaagaaaccaagagggcttgcaaggaagagcatggccaagacacacctcgtggagctttgtgggacagcaacaatgagctcaagctttga

SEQ ID NO: 33821 - DNA, 672 bp, Glycine max
  Peptide Sequence Number=SeqID_125506
atgatagatgctgccagtggtggagcccttggagacatgactcctgctgaagccagaaatttaattgagaagatggcctccaactctcagcagtttagcgccagaaatgatgccatagtcattagaggagtgcatgaggtagctacaaactcagctgcatcatctgagactaagaagcttgaaggcaaactggatgcattggttaacttggtaacccagctgaccttgaatcagaaatccgtacctgttgcaaggcaacctggagcaatcgagcagcctgaagcttatgctgcaaatatttacaatagacctcctcaacctcagcagcaaaatcaaccacagcagaacaattatgacctctccagcaacagatacaaccctggatggaggaatcaccctaacctcagatggtccagccctcaacaacaacaacagcagcttgctccttccttccaaaatgctggctggcccaagcagaccatacattcctccaccaatccaacaacagcaacaacccagaaacaaccaacagttgaggcccctccacaaccttccctcgaagaacttgtgagacaaatgactatggcaaaacatgcagtttcaacaagagactcgcgggatgcgtgttccacgaaaggaatacgcgcggagtcgccaccaacgtttatttga

SEQ ID NO: 33822 - DNA, 264 bp, Glycine max
  Peptide Sequence Number=SeqID_125507
atgacccatgatcaagagctttttagagagttggacaaagcacacgtatcaaaagttagaatttgcaatggtgatcttatcattgttgaagaaaaagaagttgtagccattgaaagttgtgcaactattgaggagcaatgcacaattttactcgaccattatgcaatgaatgctttaaataatgtagattctgccatgaagagaacactatcaatgtattcaaaagaaatggaccaatggctttcatcctctaaagccttgaag

SEQ ID NO: 33823 - DNA, 258 bp, Glycine max
  Peptide Sequence Number=SeqID_125508
atgttccttagaactggagacaggggacttatatttgcttttgtggagaggtggcataaggaaactaatagtttccatctttcggtagagagccaaacaggaagctacgcatggggagctactgcactcgttcatatgtatgagaatttgaatgatgcgttaaagagaagcgctcgacaacttgcaggatatatcacacttttacagtggttggatctacgaacattttcctactgttgcttcttctattgttgctga

SEQ ID NO: 33824 - DNA, 498 bp, Glycine max
  Peptide Sequence Number=SeqID_125509
atgacaagcagagaccaagtttggtcattctgcacccatgatacgcggagataccttatggttattcgcacccttttgtcatccagaggcggcgggcccgatgacaagcagagaccaaagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggaaatacccgagtgaggctgacatagtcttctgcaccttttgttcctccgggaacaacaactcatttacatgcggaaatttcatggtcgcccgcgactctcgtcaaccgagaggagcgaaattagtgtcatacgctaattttcggggacctttgcttgatgacatgcgaccattctttggtccttgtgag

SEQ ID NO: 33825 - DNA, 534 bp, Glycine max
  Peptide Sequence Number=SeqID_125510
atggcagaaccatcaaagaagcgaaagggttcttcgagtcgaagccaacagcatttcgagactcaagaaactcagattccttcctccatttcctcttcctcattgttctcattcgaagaacaatggatacggaacacaaatctcttcttttctcgttccattattgatccaaaattcattgatatggatttcttttcaaatgagagtttggaatgcattcaggcattcgaaaactccaatcttattcctttcatgtctttaaaattgcttgtttactctgatttagttaaagccttctattcaaacctagaaattcaagaaggcactttaatttctgaagtttatgggattaaaatggtcatccaatccctattctatgacttgacccaattatccagtgaaggtgtaccatttgaaggtacactgattgatgattggaaatatgaattctctgtgcatgatgtccgtcggttggtttgcaccaaccaagcggatatgaccggaaggcttattgccggttcattggctttttaa

SEQ ID NO: 33826 - DNA, 638 bp, Glycine max
  Peptide Sequence Number=SeqID_125511
tacacgtcctcgccaacgtagggctacacgccctcacctttagaggactacacgtcctcgccaacagagggctgcacgccctcacctttagaggactacacatcctcgccttcagaggactccacgtcctcaccttgagaggactacacgtcctcgccttgagaggactacacgtcctcgccttgagaggactacacgtcctcgccttgagaggactacatgtcctcaccatcagagggctgcacgccctcacctccagaggactacacgtcctcgccttgagagggctacccgccctcgccttggggctacatgccctcacctttagaggactacacatcctcgccttcagaggactgcacgtcctcaccttgagaggactaaacgtcctcgccttgagaggactacatgtcctcaccatcagagggctgcatgccctcacctccagaggactacacgtcctcgccttgagaggactacatgtcctcaccatcagagggctgcacgccctcacctccagaggactacacgtcctcgccttgagagggctactcgcccttgccttgggtactagttaccctcaccttcagaggactacatgtcctcaccttcgtagggctacacgccctcacctttag

SEQ ID NO: 33827 - DNA, 375 bp, Glycine max
  Peptide Sequence Number=SeqID_125512
atgaaaagagaaaaacatgcctcctatagtagtcataactcttgcaaaagcctaagtgaagaacttcgtgactattacgaaggaaggcatcggtcacatcttagacctcactcccatagaagagaaaaggaaagaaagcctcaagaggctaacattaaactctcatacttccatgggaaggacaatgtagaggctaacttagattgggaaataaggaaaagcaatcctgtcgcaacctaccctgcagcggaagggcaacgtgtgactcacgggggcgtcttccatgaaaggaatacgcgcggattcgccaccaacgtttattcgaggaaaacatcggaaaaactagaaaagacgtggtctacgaactttaagtga

SEQ ID NO: 33828 - DNA, 421 bp, Glycine max
  Peptide Sequence Number=SeqID_125513
atggtggaaccatcgaagaagcgcaagggttcttcaagtagaagccaacgacactctaaggctcaggatactccaattccttcctccatttcctcatcctcattgttctcatcggaagaacaacatatacggtacagaaacctcttctcctctcattctatcattgaccctaagttcatagatatggatttcttttctgatgagagttttgaatgcattcaagcatttcaaaactcaaatctcattccctttatgtctttaaaactgcctgtgtattctgaattggtaaaagctttttattctaaccttgaaattcaggaaagtaccttgatttctgaggtctatgggataaagatggtcattgaccaatccctcttctatgatttgacccaattgtctagtgatggtgtaccatttgaag

SEQ ID NO: 33829 - DNA, 687 bp, Glycine max
  Peptide Sequence Number=SeqID_125514
atgactggccctctcgatgagtcgatctcttgctttctcataagggtggacctttgggtactagtacttatcacctttagaggactacacgccctcaccttcaaaggactacatgtcctcacctttagagggttgcacgtcctcgccttcagagggctgtacaccctctcctttagtgggctagacgccctcgccttcaaagggggttgtgcccacaagacacccaatggaccggagaagtccaacaaggctctggggtttccagttctagttatgggcctctgtcggtcctacagggtgcccgtttccccccagcaagggattgtgcccgcaagacacccagtggacccgaagaaggccaacaaggacttggagttgccagctctaattacgggcctctgtcagttctacggggtgcctgtcgcccccagcaagaagtactgcgccccaaggcaggcgcagggcgcaacaccccagcagcttagggatggccgacagcgggcaatagacgcactgccgccacctccaaagaacctcagctcatccacaaaaaagttagtgcgttgcctacgacccatggccgaccagcaggcgaccaagtacaaagccaaagataagaaaagtactaggtctgtgaccgacaagtcatcaagcgtccaactcaagacgttaaagaagcgctactag

SEQ ID NO: 33830 - DNA, 237 bp, Glycine max
  Peptide Sequence Number=SeqID_125515
atgtaccctctcttgttctcagttacaacaacccaagtagatgtaccctctacttgtaccacaaaggatgtaccctccaatgtgttaagacaaaggaaagggaagaatcaaaagattctcagactatgtcattttgaattctttgacaagggagaaaggagacacaaaagaattcaggcggttagtccttcgttcttttggaaaggagaagagagacacaaaaacaattcaaggccg

SEQ ID NO: 33831 - DNA, 224 bp, Glycine max
  Peptide Sequence Number=SeqID_125516
atggtggcacgggtgatgctcaagcacggttatgagcccggaatgggtctgggcaaggacagcctcgggaatgccgatgtggttgacattaggggaaacccgtacaaatatgggttggggtatgaatctgggatgccgggaaggaggaatgcgctgtcaagactcagggcagataaggcatggcccggccatgttagccagtgtttcaccagtgccgggataat

SEQ ID NO: 33832 - DNA, 339 bp, Glycine max
  Peptide Sequence Number=SeqID_125517
atgcgagcacaaccagaggaggaggctatcgcccaactactatgcataccggggcaagattttgcccagaccgctgccgggagacgagtgtggatcatgtgcaccaacacatggatgatgtttctacttagcaacattctgcccaacgaccacaactttgatctccccctgccgaagtgtcagctggattttgcccccaagacacctagtggacccagagaagtccaacagggccctggggtttccagatctgattatgggcctctgtcagttctacggagtggccgtcttgttggatcaagtggcctcggaataattaagatgagggggttgaattaa

SEQ ID NO: 33833 - DNA, 370 bp, Glycine max
  Peptide Sequence Number=SeqID_125518
gatccccaaggccagatacgggtggagtgacaaaagctttagttcactgcttcaagttgtgcacgatatgcttctagaggaaaacacattgcctaaaagttactatcagaaattccgaaatgccctaggtgtgaagtatcacggtaccaagtcaaggatgatgaggagtgtacttgatgaggacatgaccaagagcaagggcaaggatccacttgaaggacttggaggacctatgacaatggctagagcaaggaaagccaaggaagctcttcaacaagttctgtccatactatttgaatacaagcccaagtttcaaggagaaaagtccaaggttgtgagttgtatcatggcccaaatggaggaggactaa

SEQ ID NO: 33834 - DNA, 248 bp, Glycine max
  Peptide Sequence Number=SeqID_125519
atatagaagaggatgctgacattcctctcattcttggccgtccattcatgtctactgcaagctgcaaggtggacatgggatggaagatactgcagatgggcatagaagaccagaagatcaattttgatttgttccatgaggacaaagatccaccttgccaaaatgtctgtctgaaagtgcatgtgatggaggaaaagagacctgagaagaaggtccttgaagtaggaactctcttggatcctggataa

SEQ ID NO: 33835 - DNA, 291 bp, Glycine max
  Peptide Sequence Number=SeqID_125520
atgggaacaaatcaaaccggcaagaggttctaccaagtcaaggttaaaagcctagataccaccagcatcaaggaattagggcggttgatggaacctctccaaatgcaagccttccgcaagacttacggaaagatcttagagttgaccatagcagaggtgtccatagaagccattgcatcactcacccaatactacgaccagcctttgaggtgcttcacattcggagacttccaattagtaccaaccattgaagaaagccatacctttcctccgggtgtctcccctctttga

SEQ ID NO: 33836 - DNA, 279 bp, Glycine max
  Peptide Sequence Number=SeqID_125521
atgcaagagaaggccctaggcactaaatttcatgctcttctctccctctccctccattcatcttctcttaccttcaagctcttatccaaggcttcctatggtggtgagcttcttctagactcatcttctactttaagtggcatctccattcatctttctcctttccattctgctgcaatcagacctcaagaagcaaaggaatctattgatgaagaagatccaaggcctacaagctctacatggagctacatcatgtggtatcagagcatcttcatctag

SEQ ID NO: 33837 - DNA, 423 bp, Glycine max
  Peptide Sequence Number=SeqID_125522
atggcttccaactcccagcagtttagcgccagaaatgatgctatagtcattagaggagtgcatgaggtagctacaaactcagctgcatcatctgaaactaagaagcttgaaggcaaactagatgcattggttaacttggtaacccaactggccttgaaccagaaatctgtacctgttgcaagggtctgtggtttgtgctcctctactgaccaccatacagacctttgcccttccatgcagcaacctggagcaattgagcagcccgaagcttatgctgctaatatttacaatagacctccccaacctcagcagcaaaatcaaccacagcagaacaattatgacctctccagcaacagatacaaccctggatggaggaatcaccctaatctcagatggtctagccctcagcaacaacaacaatag

SEQ ID NO: 33838 - DNA, 372 bp, Glycine max
  Peptide Sequence Number=SeqID_125523
atgatgataacaaaagatgaggacaaaggtgatgaaaaaaagctcaacgaccaatcaaagtacaactcaagtaaatcaataagaattcaagactcaagaagaaagtttagagtcaagaatcaagattcaaggttcaagatctcaagaatcaagatcaagattcaagaatcaagagaaggcttaatcaagataaggtacatcctttgtggtacaagtagagggtacatctacttgggtttgactgagaacaagagagggtacatctcttgtggatcagttctagtggagggtacatccactaggttcaaagagaacaagggagggtacatcccttgtggatctttgcttgtaaaaggttttttacaaggttga

SEQ ID NO: 33839 - DNA, 48 bp, Glycine max
  Peptide Sequence Number=SeqID_125524
atggcgagttgctcatggcgccagtcaaactggcgacttacgtattag

SEQ ID NO: 33840 - DNA, 297 bp, Glycine max
  Peptide Sequence Number=SeqID_125525
atggaggaatctctaggaaaatttgatgcaaaagttgatgaggcaatttttcttggttattcattggaaagcaaggtggtatatagagtgtttaataggagaacattatgtgtggaagaatctgtacatgttgtgtgtgatgaaactaactctcttattcaagaaaatgctttggaagatgaagatacaggttttcaggataaggacattgcacttgaagatgaaaccaaggttaaggatcttgaacaaaataaagaaatcacaaccacacctcctaaagacctcccaaaggaatga

SEQ ID NO: 33841 - DNA, 360 bp, Glycine max
  Peptide Sequence Number=SeqID_125526
atgggtgaagtagaggaggtgcaagagaagatgaaggccgacatggaggccatgaaagagaaaatggccacaatgatggaggccatgataaagcatgaagaagataatggaagccaatgcggttgcaactgccgctaccagcactcgtacactcccagtgagaatgtcaataactccactcccatactcattgagagccgacaaccccaaactgatcatgcacatgtctctcaacccatgggtgagacacatgaaatgccccaccacaatctagccgacttcgagccttgcctcggatatgccactgaagggcaggcaattagtggtgtacccctacaaaaccctttggagggcccttag

SEQ ID NO: 33842 - DNA, 258 bp, Glycine max
  Peptide Sequence Number=SeqID_125527
atggcttcagaatcatcagctgactcaacgaagacaagtaccagttctgattcatcatcagctacaagcaagattcaatatccaattcacacaaaaccattaatcctacaattcactgcagtattccgcaatgatatggacatgatagaagtgtcctctttttactaccaacaatgggcactagaataccctgagtttatgaattttagatatgatggaataacataccaaatcaggctaaggcagcatcaggcaaaa

SEQ ID NO: 33843 - DNA, 273 bp, Glycine max
  Peptide Sequence Number=SeqID_125528
atgggtgagggttatttcattagtgagactgtcgcaacctacccttcggcgggagggcaacgcctggctcgcgggatgcgtgttccacgaaaggaatatgcgcggagtcgccaccaacgtttatttgaggaaaacgtcggaaaaaccggaaaggacgcgatctacgaacttttaagtgaaaggttcgggagttgtatttacgcacggggaagggtgtttccctttgctcctacgtattcctcaatttgcgatgaggaaatcagacctacgtag

SEQ ID NO: 33844 - DNA, 621 bp, Glycine max
  Peptide Sequence Number=SeqID_125529
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagcgcgatcggtgcgggcctcttcgctattacgccagctggcgaaagggggatgtgctgcaaggcgattaagttgggtaacgccagggttttcccagtcacgacgttgtcgactctagaggatcccccttcttcttcttctgtcacttcctccacatcctccaacagaaccatagtgtttggcgtcaatcccagcgactccaaaaaagacccttccttcttcgacgaaaatggcgccgtcaacgacatggaaggttacctcaaccacctctccctcgaatacgactctgtctgggacactaaaccctcttggtcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 33845 - DNA, 470 bp, Glycine max
  Peptide Sequence Number=SeqID_125530
atgactaggggcaatccaggtgatttacaaccctttgatcctgaaatagatagaacctttcatagattagttaggcatggtgtgcatcctgatcattctgtgcattttgagcattatgagtattctattgctagtgattctgcatattttgattttgagcattcggctgttaattttcatactgagaggactcttagggagatggctgcacctaatttcacttatgaaagcttgtgcattcaatatcctgatgagggtgttccatatgttctcaagactggactaatacatttgctgcccaagtttcatggtcttgcaggtgaagatcctcataagcatcttaaggagttccatatcgtttgttccaccatgaagccctctgatgtcctagaagatcatacctttctaaaggcttttcctcattctctggagggagtggcaaaagattggctatactaccttgctcccag

SEQ ID NO: 33846 - DNA, 567 bp, Glycine max
  Peptide Sequence Number=SeqID_125531
atgacctcactggctcagacttggagtgttcttccttactccaacttgatccctacctcccacacttctgacatcacactagaccgggccaagttgatttatggcattatcatgaagatggacatgaatctgggctacctcatctcccaccagatttctatcattgcccagcatgactcctctaggcttggatttccagccttaatcgtagctttgtgtaaagctagaggagtcgcaccagattccaaatctttggagagtcttagccctgccattaacttggcatatataaagaataactgttggaatctagatgatccaacagtggcatttagagggccaaggaaggccaggggtaagagatctgaggcttctcctacttcagtagcaccagatacttctgctccttcttcatctactttaccagatcctttagcaccatccacttcgactccacatcttccacagtttccagttcagctcccagcttcttctgctcctgcatcagatttattgtttactccagagatgcttcactccatgatgcagagcctccacagaggacag

SEQ ID NO: 33847 - DNA, 294 bp, Glycine max
  Peptide Sequence Number=SeqID_125532
atggcttcctcttcaagctcagttctctgccagtcttcacacagcaaaagctctcaaaacactctggaacttagacctttctctctctataaatctctaaacatgcagaagcttcgagaaatgcccaaactcccctcttcatttctgatttcaggcttaaataggtggccttctcatccttcttcaagattcttcctcgtgctcagccgcaagagtggtgtgctcagcggatggctcgctaagccgatagattggcttgatcaagatcagcacttcacaaacttgcctaattaa

SEQ ID NO: 33848 - DNA, 549 bp, Glycine max
  misc_feature (529)..(529): n is a, c, g, or t
  Peptide Sequence Number=SeqID_125533
atgtttggaagcaaaggcgagaaccttggcaagtcaagaagaatgggccccgttcatggacatcctggtgctcctgatcttcggagtggtcctctttccaaatcaagcaaagaaggagcatctgtcaattggttcccccgatggaaagaaggaagaaccgggattcttatttcatgcagaggatttccatatgttcccttgatggggacgaggggttgcattaattacaatcccgtcctcgccataagacaacttggctaccctatgagaggggaaccattagaggaaggcctcacaccttttattgcgcgaggtttcaatagcaccagcgcgagggtgcttcatagggtccacaaggcatgggaaatggtgcaaaagaaggacgaggaacttaggggcagtagcaacgggcccatcggcggttaccataggtggttgagagcctacgcacaaggtctgcattggctcccgaatttgagaaccactaaagaggtggagggtgaagctctggaagacacgaagaggtacngccctcaaaatagagcatga

SEQ ID NO: 33849 - DNA, 168 bp, Glycine max
  Peptide Sequence Number=SeqID_125534
ttggttttctggctggatgacccagccagggttggtgacccagaagaagttgaggatgattttttagtggacaactctggtagagccagcctagatccttttcctgtacctcgacctcctcgcaaggaggctcctgatgccttaggaggcattaccgtttttctgtaa

SEQ ID NO: 33850 - DNA, 581 bp, Glycine max
  Peptide Sequence Number=SeqID_125535
atgtgcagcgccaccgattacaaaataaaatcaatcggaggtatgtgcatcttaatccaattgtgggcatgggaacgctgcacgactttggctccaaagagaactccttctataatagaaaacaaaccactcggacacaggtggctgcgacgtggaaaccaacatattggcaatgatgatctaatagttttccgtcgcaaattggatatcatgaaacgacatgagtttctgtgggagccttacacagcaactgttatgtcgatgttgcctcccatttgtttggttggcaagtggcaccaaccggatagagtgttgcgacaatttggaatgcaacaacctattccggagtctccttcgcaaccatggaatgtccacgggctaacactgaaaggcaaaatggatgaaaattggttccagctgttggccccatttatcagtcagtggaataatcgagctgagtttagggtcgacgtttatgctcgacaagagggcctattgagttttaactcggattacatggtgtggtataggcgcaaaacaaaaatgtttatcgacccaaacaatgcaacacggctacattg

SEQ ID NO: 33851 - DNA, 291 bp, Glycine max
  Peptide Sequence Number=SeqID_125536
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgtcgggaagggcgatcggtgcgggcctcttcgctattacgccagctggcgaaagggggatgtcctgcaaggcgattaagttcggtaacgtcagggccatcccagtcacgacgttgttaaacgacggccagtga

SEQ ID NO: 33852 - DNA, 586 bp, Glycine max
  Peptide Sequence Number=SeqID_125537
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccaatatgaatatcactaagcacgctatatttatatcccccagctcgcacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 33853 - DNA, 237 bp, Glycine max
  Peptide Sequence Number=SeqID_125538
atgggtattattaggcaccaaattcctaaaataagtgatatgatgaatgtgttgagtgttgcaaccctattttgtaaaatcactcatgcacccaacatcttcatgattcatgtacttagggactcatttggtgtcgagggaaggagccgagagtatgaagaaccttgggatttgaggtcaaatcctttccaagctggagggaatgatgcaatcctaccccgcaagggcattggatag

SEQ ID NO: 33854 - DNA, 264 bp, Glycine max
  Peptide Sequence Number=SeqID_125539
atgccctcctggtttccgactaggaaattggcgagtggaggagcggccggacatttacgcgacaagcataatgtaaccctttgtggctttcaaactctacgatccgacgacgagtccctcgaaggtactaatacctgggacccgaccatcgatttcaagcaagaaacagatcagacggaggatgaagaggacaaagatgtgggacttcccccggagttggagaaggtagtcgcccatgaggaccaagagatagggcctcattaa

SEQ ID NO: 33855 - DNA, 156 bp, Glycine max
  Peptide Sequence Number=SeqID_125540
atgttagccatcatcagcaagtaccaagaggaactaagtctagccacgacccacgagcatagactgccggacgagtatgcccaagtgtacgcggcaaaggaggctagaggaaggaaaccgctaggaagcttgtatggtcgctcaaatcttgactag

SEQ ID NO: 33856 - DNA, 423 bp, Glycine max
  Peptide Sequence Number=SeqID_125541
atgcctacactacccagctctcctccgcctcctccttctactggtgcagcattgcattcaccgccaacattgaagcggactagaaaggcctcatgcctaagatcattggcgactagaccagttggggcagagagacccctggtccatatggatcctgctaccgacaaagcagacggtccccacaacaagaaattaagaacatatttggggatcgtcgctcatgataaggctgaatttgatatccctgaagaatctgatgtaaggacaaaaaagaaaatacttaagactgtggggaagcggtggagacaatttatgtctgatttgacgtcgaaatgggcacttgcaaaaagatgtgcgaaaaaaggcacaggctatccagaagcaaaacattgcccctcacgtgttgtctcatgggggttatga

SEQ ID NO: 33857 - DNA, 570 bp, Glycine max
  Peptide Sequence Number=SeqID_125542
atgaggggcatcgtgcatgagcctcaataccctcatcttcggaggactacacgtcctcaccttcagagggcttcacgtcctcgccttcatagggctacatgccctcaccttcagaggacttcacgtcctcgccttcatagggctacatgccctcaccttcagagggcttcacgtcctcgccttcatagggctacatgccctcaccttcagagggctacacgtcctcgccatcagagggctgcacgccctaaccttcaaagggttgcacaccctcgccttcagagggttacatcccctcaccttcagaggacttcatgtcctcgccttcataggactacacgtcctcaccttcggaggactaaacgtcctcgccttgagagggctacacgtcctcgccatcagagagctgcatgccctaaccttcagagggttgcacaccctcgccttcagagggttacatcccctcaccttcagaggacttcacgtcctcgccttcatagggctacatgccctcaccttcagagggctacacaccctcgccttcgtagggcgacatgccttcacctttag

SEQ ID NO: 33858 - DNA, 516 bp, Glycine max
  Peptide Sequence Number=SeqID_125543
atgcttatcttgagttctgttggaaccctagcttttaccttttgcaaacccccaacaagaaagaaccacaaattaggaaccaacatgagtcataattcatctagtgttaatggtgagggtactagtcataaggaccctctatctagaatcttagatgagttgagatccctcaagttatgcaaagaaaaacaagaaagaaaagaaaatggaaaagagagggtagaaataaatcaagatgagagggaacaaataagtgaagaagaaagaaggaaaatactaaaagaattaagaaaagaaaacatgtctcttatagtaaagcaaccccctaagcccaaagatgataaggggaagacaatagaaaagcaacccctcaaggctagtatgaaagagaagactaactctataaagaggggccaagatatttatagtagccaagatgaggctactacttcaccttcctctagtgaaagtaaagaagcaaaaggggaagaatctagtgaagaaatctatccctaa

SEQ ID NO: 33859 - DNA, 285 bp, Glycine max
  Peptide Sequence Number=SeqID_125544
atggctctgaaacggtggcctcaaatgatgcatcctctacatgttatggtacctgggctgtgggaccttcatcttccctgtgaagagaaggttgggccccaggccaggagctacagatgtggaaggaagctcagctggcctcgcccttgccttcctagcccctcggatagaaattgtcagatcatcaagattccaacaattcttcctaatgtaggccaagttaatgatcgggctcaggcgctcaaaagtgaggctgtcaaagacaacccctctggctctacataa

SEQ ID NO: 33860 - DNA, 693 bp, Glycine max
  Peptide Sequence Number=SeqID_125545
atggcgagccaagagaagtggggcccggttgtcctctttccgaacgttgacggtttggtagacttagccaccattgatgccttcctcgcatatcaccatagcaaggaaagtccagtggtggctatcttggcagatttatttgacacctttgaccggaggtgtgagaaaaacagtgcacggattgtctgttgtttacccgctctctgtgtgtggttgatttcacacctattccaacaagacacaagacacctgtgtccgcttcaaagttatcgctcatgcgccgaaaaaggaagagtcgattgggaccaacatttggcggggatagggggcagcgcaatcaattggtttcctcgttggaaggaaggcaaggaaggagttcttttctcgtgtggggactaccctaatgttccattgataggaactagggggtgtattaattataatcccgcactcaccataagacagctagggtaccccatgaggggagcaccaacggaagggagtctctcacctttccttgtgaaagatttaggcgcgcaaggtctcaaggttatacaaaggatccacaaggcgtggaggagtccgtcgaggaaagacaaggagcttaggggcatccgtaatggcatcatcggaggttatcatggatggctaagaattcacatgcgagggttagattggctctccaagttgaaa

SEQ ID NO: 33861 - DNA, 402 bp, Glycine max
  Peptide Sequence Number=SeqID_125546
atgactttaattgagggcgtaaataatccagcagcaccgctgtcacaggcatttgctcaagataggcccttcatggatatggatattgaaataccggattctaataaatctattattatcggtgttagcttaggactagcagttgccatcttatttacatttgggattaacccatgctgcggagaagttatactatctaaggatatacgttatgtacatgattaccttaaagcagagaatctaatacctagtattacacctttccaattgtctatcattctacaaaaaattgaaaacagttcttacaaggttggcccgctagagtaccttacttgtttagatgaagatatgaataagcttttaaaagatatattacctgattatccggatattcatatacat

SEQ ID NO: 33862 - DNA, 296 bp, Glycine max
  Peptide Sequence Number=SeqID_125547
atggtggagggcgccaacttggacgagtttggggacgaggtggccggagacgtgaagggcgacgagagactcgaggccgccgacggagtcgccgccgatgaagacggcggggatggggttgcggtggttgttgtcgggaaaggggagggcggcgatctcgtggtcgtccaattcgatgacgggtgctccgagatcaggcgctggatgcgggcctccgttgattcgtccacgtcgatggagagagaacaagaagaggtggtggtggtggtggtggtggtggtggttggggtggagag

SEQ ID NO: 33863 - DNA, 1011 bp, Glycine max
  Peptide Sequence Number=SeqID_125548
atgcatatattgttggtgagtgtgtttgatacttgtgaagaacgattctatgcgttgaaggatgtggtgtatgacaatggtactaaaactgctaaggaatttactgatctgaacaagtggagttattttgaagtttttggtattgtgaaggacttaaaatgtgatattgaagttagactatggtggacaaacgatggtcctaagtctattgctggatatagagccatcaatgttgagggtgcaattggttctcaaactacccaaggtggtgggagtgacaagggtactactgaagttaaggtctttgaaaatgatggtctagttaggagtgagtctgatgatagtgatgaggcaaatgatgtataccttgatgatagtgaggatgaaagggatctggaaattattgagaagttgagtaatagtttgcaagttgatcctacattcactaaagacatggaccaatttgactatgaaagtgaagaattgaccaattttgatggttcaagtgttgaagaggaaagagacaagaatgataaatttcctaagttcttaaaagaagaattagaaatcaacttcaaatttcaattgagaatggagtttagcatgttggctgaatttaaagatgcaataaggagttgtccatttaaggcattggtcagtcaagtggatgacaccaccacattcaaaatgaagacattttataggaagcacacgtgtgggagggtcttcaataacaagactacaaattcaaagtggatggctaagaaggttgctaaaaaagcaaagaaaatggttgaagatgagattgaaggagacgcaacaaagcagtatagcttgttgtggaggtacaatcagaaccctaatttccaacattatccaactgcctttgttgtggttgagactgagaccaaggactcttggagatggtttcttacatgcatgttggaggacattggtatagaaaaaaagggcctagccaatgtgtgtcaagagatgtttgacaatgtctaa

SEQ ID NO: 33864 - DNA, 363 bp, Glycine max
  Peptide Sequence Number=SeqID_125549
atggcaccaaagagaagtgaagttgttgtgattccaggaattaactttgaagaagaggccaagaatgtctttcccttgggctctttcatccctagacgacgggtgaacttccaaaccctagaagaagaaggtttccccatcaaaggtctttttgatcgtgttgtatggaccaacatccttaagaacttcagtttaatgcattatggtccatatgccttgttatggggaactgcaagacaaaatcgtgcaagcataagaggaactattagagggaaggaagtggtgatctcctcatcaactattggtgttgtgtctggttgcgctaaagaagagtctttgatgaagactgggagaaggaaataa

SEQ ID NO: 33865 - DNA, 1368 bp, Glycine max
  Peptide Sequence Number=SeqID_125550
atggagaatgcagacatccctgagaatgccaacgagcattgcccaggtcctcagtctgaatctgctggaaaatccgatgcatgtgaagggtgcccgaatcagcaaatttgtgccactgcccccaaaggccctgaccctgtaaataatccttacgatctatataagcatgctgtgatgccacagctaatgattctagaatttgggactgtttctcaggaagtgagcaaatcatttcctccacagtcaagatgtttgcagcactgcattgaagagcattctgcaactgctctgcatccaagtgtggctcagtatgttccattatttcttgagtgtctcaacagtactgatctggttgccattgcagaaagaatggctactgtgaaacataagatattggtcttatcaggaaaagggggagttggcaagagcacgttctctgcccagctggcatttgctttagcagcaagggattttcaggtaggtcttcttgacgttgatatctgtggtccaagcattccaaagatgcttggcctagaaggtcaagagatacatcagagcaaccttggttggtcccctgtctatgtggagtccaaccttggggtcatgtcagttgggttcatgcttcccaatccagatgaagctgttatatggagaggtcctcgcaaaaatggacttatcaagcagtttctaaaagatgtctactggggtgaacttgattttctaattgtggatgctccaccgggaacctcagatgaacacatttcccttgttcaatgccttgatgccactggaatagatggtgcaatcatagtcactactcctcaacaaatctctcttattgatgtgagaaaagaagtgaatttttgcaagaaagttggcgtgaaagttcttggggttgtagagaatatgagtggcctgtgcctgcccatcacagatttcaagtttatgaagttgactgataatggtgagcagaaagatgttacacagtgggtttgggaatacatgagagaaaaagcgccagaaatgctgaatttgcttgcttgcactgaagtatttgatagtagtggtggtggagcagtgaaaatgtgcaatgatatgggggtaacctttcttggtaaagttcctttagatccacagctttgtaaggcagctgaagaggggatcccgccagtaccaatagcgggttcaagtattccgccaacaccaaaaacggcttcttcatgcatgggtcaaagtggtggaattgttgctgctgatccacgtggatccgccagttggtctggcgagatttgtgaaggaaaagaaaaaaaaactggttccgccattgaaactggcggtattggtgcaagctactccagtgtgccatga

SEQ ID NO: 33866 - DNA, 292 bp, Glycine max
  Peptide Sequence Number=SeqID_125551
aaagtattctgcttttcactatccatgttcacacattattgctgttcatggttacgtgagcatgaattattttcaatatgtagacgttgtttacacaaatgagcatatcctaaaagcttattccgtgcaatggcggcctcttgggaatgaagcggctattcctccttctgatgagccatggacacttatcccatatccaagtacaattcgtgcgaaaggtgagccaaaatcaacaaggataaggaatgagatggattggctggaagcatctgagcaccgacaaaaaatgtag

SEQ ID NO: 33867 - DNA, 309 bp, Glycine max
  Peptide Sequence Number=SeqID_125552
atggagaagagtccagaaactacagaagaagaagctctaaccaaaaagcttcaggagcttttatctgaatcagacaatgaagaaactgagaattttaattgccaagaagaaaaggtagaagagatgatgcaagacttgtacaaagagaaaaccttctctacttgccatatatgtagcacctcatcgatgatgcaaagaatgggagctttcgagctcaaaatcaacttaagatggcggggattgagattgttagttccggtgatggctgagaaagagggtagtagcaaaacatacattgtatgggtttaa

SEQ ID NO: 33868 - DNA, 453 bp, Glycine max
  Peptide Sequence Number=SeqID_125553
atggctcttgtcacccgaaccagacccacgtggtgcctccctcgacgactacttttcgcgtccctccgcagcaattccaccggcgccaccgctccccctagttactgtgcgccgccgtcgatgatagcaaattcttcccctgtgggccactcaaagccggtagagttcgtgatctcgaaggtggactcactcttgaattgggcccactcaaggtccatctggcctatgatgtttgggttggcctactgcgacatggagatgatgcacacaggcgcgacctactacgatctggaccgctttagaatcatctttaggcctagcccgcatcagtccaattgcatgatcgttgctggaacactcaccaacaagatggcccatgtttatgatcaaatgcctgagcaaaggtgggtgatctcaatgggaagttgtgctaatggaggtggatattgttag

SEQ ID NO: 33869 - DNA, 624 bp, Glycine max
  Peptide Sequence Number=SeqID_125554
atggctctcgtcacccgaatcggactcacgtggcgcctccctcagcggctagtttccgcgtctctccacagcaattccactggcaccaccgctcccactagttactgtgcgttgccgcagccaacagcgaattcttcccccgtgggcctctcgaagccggcggaattcgtgatctcgaaggtggactccctcttgaactgggcccgcacagggtccatctggcccatgacgtttgggctggcctgttgcgctgtggagatgatgcacacgggcggggcccgttatgatctagaccgctttggaatcatttttaggcctagcccgcgtcaatccgattgcatgatcgttgctggcacactcaccaacaagatggcccctgctcttcgcaaggtttatgatcaaatgcctgagccaaggtgggtgatctcaatgggaagctgtgctaatggaggtggatattaccactattcatacgctgttgttagaggatgtgacagaatagttcctgttgacatatacgttccaggttgtcctccaactgcagaggctttgctatatggcctcctccagctgcagaagaagatcaataggcgcaaggacttcctctggtggtggaccaggtga

SEQ ID NO: 33870 - DNA, 367 bp, Glycine max
  Peptide Sequence Number=SeqID_125555
atggttgagaggacacttttctatttacctggagccaagagaaattgtctagacgggagggtgtgcttctgctggagtaactcggttatatctcgaaccagtacgaatcgtcatagaaatccagcaatgtctggtggttattctcagcaaggttaccaagctcggccacccactagctggggtccccctgctgctcctatgcaacaatctggttatggctatgtgcagccaggagcatactctggtccaccccagtataacatgcctcagcaacaatatgcaggctatcctccccagtcatctggtggatattctgccaccaactgggatcagtccactgccccacagcagcagtcacccatgcagg

SEQ ID NO: 33871 - DNA, 939 bp, Glycine max
  Peptide Sequence Number=SeqID_125556
atgggtacccaaaagtcaagtattgcatttattatgtgcataatattccctcccgttttccctgcaccatccacaaaacctagggtttatctctttctcccttcaaatccgtcacttcccgtcaccgtcaccgtcactgtcaccggtcattcctcttccattgattctccgaaaatgaacctcaaccattaccaccaccacgttcccccttacgagcacatgctgaaggaatccatcaaccgcttcttcgccgaacaccgccgcggcgccaccgacttcgccgacttcacctccatcttctcccgcatgatccacgctacccccgaaccccccatcccactcctctggttctacgccgccctcgaattccgcgccacacgcgatccttctagaagagccagagacctgttccacttactcgtctcctgttccggtgcgcgcgggtccacgaaacaaatcgctgcactcgcaccgttactcttcgtcttacaccgcttagcacttcttcaacaaggggaattgttgaaaaccgagctgaatgggttggtggaaggggttgtgagttactgcagcatctgttgcggtagcgaaatttgccgcgacgatgacgtggcggtgttggagtttggggatttgattaaggtttggatggtggatgatcatgaccatgacggtggggttttagggtttttcccttttgtgagtggtgaatttaagaaggggattgagaagggttgcgaggttggggtgttggctgggattgttatgtgggaagcgcttttgctaaagctctgtttggcgttcgagaaagggattggcagggcggagcaggagaagaagctcatggcctccgccgttcagaccatcacagggtttcggagctttggcttcttggtcttgagacatgttctgggtctaatgagtttgggacctagctaa

SEQ ID NO: 33872 - DNA, 759 bp, Glycine max
  Peptide Sequence Number=SeqID_125557
atgggtatatgcatatccgttgcagaaggagttaacgatgataatgtgacaatatttcaagcaagaaaggtcccgaatgagagtcagagactttgctctgtttactcccaacagggtagcaaaggactcaaccaagatgctgcctctgttcacgagggttatgggatggaagatggaacattttttggagtttatgatgagcatggagggaatggacacaaagtgagcaaaatagtaagcagtcgtttatcttccctcatactggaccaaaagaatgttcttgaaaagattgatgcaatagagaatggaatcggctgcaagaaatggaaagaagcaattttaagtgctttcaaggtgatggacaaggaggtgaagcttcaaaagaatttagattgctctagcagtggaaccactgctggtgaaggtcttgtcattgctaatctgggtgactcaagagcagtattgggaacaatctgtgatgaaaaaactcatggccattcaattgaccacagatttgaagccggaattacctccaaggttcttaaattacttgcgacagaagccacagtaatgagctatatggtgtgggatgtactaagcaacaatgaggttgcatcaattgtgtggggtgtagacagtgaagaggcagtagtggaagcagccactgctgcatggaacgagaagtatccttcctatatggcagatgactgcactgtggtttgcctcatcctgcacaagaaatcacaacttggggcatga

SEQ ID NO: 33873 - DNA, 942 bp, Glycine max
  Peptide Sequence Number=SeqID_125558
atggataaagagtctcatcaaggcaatagcgttagagaaagagacaaagttggaggggatagtagtagtggtggggccgggtcgttgttgctgaggggtagctccgatggaatgagacaagcagcaacgacgtcggatttggggctgcagtggggtaacaggaagagactaaggtgcatgaaggtgcaggtcaaacacgacccttcttcttcaaacaacccggttcagaggacaacaacaacaacaacaacggttcgggtggatcggagagtggttagaaacgataaagattcttcttcaaatcttagtattagtagatccttacccactactgctaccctcactaataacaacaataacaatcatattagccttcataataataataatattaatcagagtaacgggtatctgaatctccgtcaacgcccaccttccccgcagcaacctcctccgcgaattctcaggaattcggagacttcaagtgctatgagaggaggccaaagcaacgggagtgttaggggaattgcctcaccggacaggggtgcgcacgataagagggggacccaaaacaaccaccttaatgacaataataacaagtctgtggtctcatcagacaccgcgcacgatagcaagaagggcggtggtgggtcgccgtccggcagtggtgacgcggctccgccggtgtggccgccaaagttcgtgattgccttgacaaacaaggagaaggaagaagattttctgctcttgaagggttcaaagcttccccagagacccaagaagagagccaaattcatacaacgaaccctcaatctcgttagtccaggtacatggctgtgcgatcttactctggaacgatatgaagtaagggagaagaagatatccaaaaagagaccaagagggttgaaagcaatgggcaacatggactccgactctgaatag

SEQ ID NO: 33874 - DNA, 828 bp, Glycine max
  Peptide Sequence Number=SeqID_125559
atgggatccacaatcttcattctcatggtagtttcagtttacggttttgtggaccatggtagctctttgtcaagacacaagattttggaagttgagagaaaattaaatcatcttagaagacactccttaaaaactatccagagtgaagatggggatgtcattgattgcattgacattaataagcaaccagcttttgatcatcctgcattgaaaggtcacaagatccagatggctcccacttacaattcagctaagaaggacaaaacagtagggaccagaactagaaataatgcaaagagtggcaaaatgatgaagcaaaggactgaaggtgctattcaatgcaacaacagaagtcttatatctcctgatggagtagttgggttccgctacttgagagccaaaggagacatcaaagtgtgcaacccttctgttgacaaggatgatgagtacagcacttcccaagtatctctcttaacagggccatacaaagactttgagtgtgttgaagctggttgggcggtcaatcccagtgtgtatggagataggcaaactcggttatttgtatactggacagctgatgcttcaaacaaaacgggttgctttgatctgacttgtcctggatttgttcagattagcaattgccctgggtgcagcaatttatcccatatcaattcctggtgggcttcaaaatacataataattatttacatctataaggatccctataccaataattggtgggtgcaatatggtgagaagacaaacataggttattggccacctgagaaacaatacgttacaatgcggaatgtgtggagtggggggtga

SEQ ID NO: 33875 - DNA, 405 bp, Glycine max
  Peptide Sequence Number=SeqID_125560
atgattgaaagttttcaacaacaacaagaaatgggtgtcattgaattgtgcgttgaagtagatgttgtcggtgcttctgcatcgaatgtgacaaattcgctattatcatatgaagattctgacaatgacgattacataatatctaattcatatgttgaggactcgctagatgaggagaaagatatcgatgatatatctgacacagataaagaaggtggaagtgagactgcattttgggaatctgcttctaattatagtaacattaattggagtcatcccggtgaagaagacatttgtggtttcaatatgggatcaaccttcaatattggccaagaattatttgttggcatggaatttgaaagcaaaaatgcagtaaaaaaaatgcactgcaacaatatgttatga

SEQ ID NO: 33876 - DNA, 207 bp, Glycine max
  Peptide Sequence Number=SeqID_125561
atgtcgttccctcactttcctcacttgcagcaaacacccccctattccagaaacttccttcttcacatgtatttgatatggcaagttcatcatcctcctcatccagttttgatgtggtatgtggaccacgtgaaaatgatgtgttgtggatgcaaaagcaacatgagtcctaacatacttggaacggggatgcagataaaaaattaa

SEQ ID NO: 33877 - DNA, 900 bp, Glycine max
  Peptide Sequence Number=SeqID_125562
atggatttcaatacattggtaagtcacactttgacctttctcattggttaccttttcactaatggccaagcacttcaccttttcatcttcccactagctctaagcgccagaggctactctaatgatgccatagccactgggaatgaggataagttcaagagagatgaacatgacacattagagtatgtgaatggtgaatactgcatttgggaagggggaggtttggtttgtccagagattaacaaggatgtgttggacatgtgcaacttaggtattgcttatcctaacaaagatgatcatgtatattttgaacatgtggtggatgatatgccaaagatactaagtgatgatgagttggttgatgttgttattgaccaagttgctgaagaagttaaagaacaaaatggtattgattcaaagattgaggctgttaatgaagaaggtattggacaagtgtcttcaattgaggaattgattcaaatgtgtgataatttaaatcaagtttctattgatgcacaggaacatgaagtggttgcaaatggtgatcttaaaaaagtgactaaaattgatgatggaatagtgtctgaaaatgttaatgcaccacaatttgttgatgttgatgacaatgataatgaagaaaggtcttttgatggtgaagacaatgactttgattatgtgatgatggataatctagcacatgaacacatgaaagtagattatggtgtgcacatagatgagaggaagattttcaagactttgaaagaggctaggttgatggttgaggatagtatcaaacaacattatgccaagttgtgggactatgctattgaattgactagaaccaataaagggataatagttgttatagatatcgtttctatctctcgagaaccaccttaa

SEQ ID NO: 33878 - DNA, 729 bp, Glycine max
  Peptide Sequence Number=SeqID_125563
atggcttcttcttctccttctcctccatcttatctcacacaccttcctcttcatccctctcaccaaggtgagagtgagaagcgcgtggaggacgatgaatcgcgcgttccgattcacatcgtgaccgcggcgacgcaacttcccgtcgaatttctggaaccctcgcctcaatccaagctcgtcatcggctttgactgcgagggcgttgacctgtgtcgcaaaggcactctctgcgtaatgcagcttgcatttccggatgctgtgtacttggttgatgcgattgaagggggagaggagcttatcatagcgtgtaagcctgcacttgagtctaattacatcacaaaagtgattcatgattgcaaacgggacagcattatactttcagtttggcatcaagttgaacaacgtagtggatacccagccatcagtccagattggcctgtctcctccttttcagccaatccccagccagaatttgcaacagttcaactttcccagtgtgtgagagctcctctcaatgctgatctctccacgcaccactccagcttcaccattcaactctggctcagatatccagtgtgtcaagattcatgggcagggtggagattcagctctctgggatatcaacatgatcaggtgttgatgatggagaaatgggcactccatcctttttctgctgtagccatagttggagaaacattaagatgcctaaaaaatgtactaagatga

SEQ ID NO: 33879 - DNA, 1731 bp, Glycine max
  Peptide Sequence Number=SeqID_125564
atgaagatcattccagaactactattatttgtgatagttccttttctgctgaacagtggaaatggaattgaaacatccacacatagcatcaataatagaacacctgaaaaacaaccttaccgaacttcttatcactttcagccccgacagaattggatgaatgatccaaatgggcctatgtactacaaaggtgtttatcaccttttctaccagcataatcctgaagcagcaacctttggtgataggattgtatggggtcactcagtatcctatgatctcatcaattggattcatctaaataatgctattgaaccaagtggaccatatgataataatagctgctggtcaggctcagccactataatcccagggaaagaacaaccagtaattttgtacacaggaattgatgataagaaacatcaagttcagaacttggctatgccaaggaatctatcagaccccttcttaagggaatggatcaaacaccctcagaaccctgtcatgagtccaccaagtggagttgaagtgaataacttcagagacccttcaactgcttggcagggaaaggatggaaaatggagggtagtaattggtgctcaaaatggtgatgaagggaagacaattctctaccaaagtgaggactttgttaattggaaagtggatcctaatcccttctacgcatcagataatactggagtttgtgagtgtccagacttcttccctgttaacatcagtggcagcaaaaatggggtggatacatctgtgcaaaatccaagtgttagacatgtcttgaagataagctatctaagaaagcagcatgattactattttcttggtaaatatgtatctgatcaggaaaacttcattcctgatgttaggtttacaggaactagttcagacttaaggtatgactatggtaaattctatgcttccaagtcattttttgactatgccaaaaacaggaggatattgtgggggtgggtgaacgagtctgactccacacaagatgacattgaaaaaggatgggctggtctacagtcaattcctaggcaagtttggcttgataaaagtgggaagcgattggtgcaatggccaattgaagaggtagagaaactacgtgataaacacataagtataatgggagagaaactcgtctatggatcaaatcttgaagtctcaggtatcactgcatcccaggccgatgtagaagtgttgtttgagctacctgagctacaaagtgccgagtttcttgatcccgatggagttgatccccaactactctgtagccaagaagatgcatcaagaagtggcataatagggccatttggtttgttagctttagcttcaaaggatctcaaagagcatactgcaatcttcttcaaaatatatagagcccccaatagatatgttggtctaatgtgcaatgaccaaagaaggtcctcatttcgccatgatcttgacaaaactgcatatggaactatctttgacatagatcctaatctcaaaaatatttcactaagaagcttgattgaccactccattattgagagttttggggatgaagggagagtttgtatcactagtagagtttatccatcgttggctatagacaaagatgcccatctttatgcatttaacaatggaagccagagtgtggtggtctcaaaactgaatgcttggagcatgaagcaagcggagattggccgtgagggaaacataagctatacctaa

SEQ ID NO: 33880 - DNA, 525 bp, Glycine max
  Peptide Sequence Number=SeqID_125565
atggtgatgatgatggtgttagtagcgatgacattagagatactagtggttgttgtgatggcactaacagaagaggcgacaccgatggtgccaatggtgtcggcagttataatggtggtggtaatgacatccaatggtggcaatagaggtgctagcagtagtggtggtggtgacaatgatgacggtggcggtagtgataataatgtcgctagtggtggaggtgacagaggtggtggtagcagcaacatggtggcaaagatgatggcggtgacaattgttgtagcggtgttagtgttggcagtcaacggtggtgatgacgaaggtagtattaattgtggtgacaatgacaatgttaatgacggtaacaacgacactaatagtgacattgacgatagttatgatggtggtagtggtggtgacaaaaaaaagtgtgatggtcaaatatgggaaatgcctcttgaaactaaaccaaattttacaaaatcttttttcttggttttgaaaatcaacgtaaaagtgttttaa

SEQ ID NO: 33881 - DNA, 1080 bp, Glycine max
  Peptide Sequence Number=SeqID_125566
atggatgacgacacgtggttatcaagtcaggggaccaaattgtcatggaaatgtttgcctttaaacctcataagcttaccattcattgttgcagagaaggccaaggtcgttcattcttcctgtgttctacaaagctattggcaaatggtgatgatgtctttgcaaacaatcagctattggtcgtgtgaagacgagagacaacgatggattaggaaaaaattagtcaaaattgtgcattctttgtttgatgttccacttgattattttgtcttaatgttgaagaaggatatatgttgggaaaataatgaagatgttggggaggatgatgatgttgaagaagaaggtgatgaatcttctatgatggtgatgatgatagcacttaatgtgctgcaagctccatcgtcgttcggcactcccaaggtctccatagctagcggattccccttcactccgttgtggccattattgtttccaggtggctctggccttcatttagacattgggagcctagaaaaactgattgcttctcttggaccatttgtcactagaaacacttttgatccagaagagctccttgagacttcagttgaaaagagtgtcttaccaggcattcttcaaggggacaagttagactccctcttgtacgactttgttgacaatggaaagaaaatttgttggaatgaatattttcattctaaggtgttagaggctgccaaacgccttcatttgaaggaagatttagtccttgatagatctgaaaatcttttcaaattagctgcaccaatggaatgcaagggcattgttgttggtgatgaccgggtaattccttatgatgccaactatactgtacctggttctcgattttgtatcttgaggccagaattaattactgcccattgccgggcccaagcagcagagatattgaaatctaaggagaagaatcctcaagaggcagacaatttggtcactgattcccaaaatgctgctgaagctgatcacctggtaaatgattcccaaaatgctgctgatgctgaccaactagtaaatgattcccagttattggtttaccattgcttttaa

SEQ ID NO: 33882 - DNA, 693 bp, Glycine max
  Peptide Sequence Number=SeqID_125567
atggagttaaaacctggagattcagctgcaaaaaaggagctttctcaactattgcaagctcaaagtgctctagaaacaactcactccctatatgatttgggcaacttctcaaaatctttggaatatattgataaagttgttcttgttttttcttcagcttgcaataaggctaagcttcttatagtgaaggtgttaattgttgataaagagtatgagagtgctattgttgagtctgggtttcttctcaaggaagatgaaaataatttagaggcattcataagagtaaaatcaaactttaattatggaccaactagcttcatcttcaaaattctagagcagattaagattgaacctacaaccaatcaaacttatggtgaactcttgaaaaatctcacacagatcaagacatttgcttcaggaattcttgttcccaagggctatatatggcctgtagactcagacctttatctacaaccacatacccctcttgtctcaaatgctcatagagaagggctacaagtttttgtatcagacgttgtcaatgatgttccatttagctacgactccagttatgatcctctggatgaacgtctatccttcattgatggtggtgatttctctgttgatggtgtgttgtttgacttcccaactactgcatctacagtcataagtaagtttgtttcctttgtgtag

SEQ ID NO: 33883 - DNA, 267 bp, Glycine max
  Peptide Sequence Number=SeqID_125568
atggagaacttcataatgaactcagacctgtcaagtcaagcacaactggcacactttcaacttctgcaagaagttgttgcagagctaagtgccttacttccaacaactattttcttgggggagaacccatggaaagtgggtatgcctggagagacagagaatacttggattgtctctcccatgaccatgtgtaatgtcgtggttaaggttgattacttctcaagagtgaggagagttttggggagagggacatttagtaagaggtga

SEQ ID NO: 33884 - DNA, 984 bp, Glycine max
  Peptide Sequence Number=SeqID_125569
atggtgcttcctgtaaattacaatggtatgggcggaatgcgtaagaatatacctttcgagtcgctggaagtatttaccattgagaatgtcaaagaaggatcaaagtggctttgggttcattgtcttgcactatacatcataacattatcagcttgtgctcttctttactttgaatataagagtattactaatttgaggctactacatattattggatcacctccaaatccaagtcattttacaattcttgtccgatcaattccctggtcttcagaagaatcatactgtgaaaccgtgaaaaaattcttctcatattaccatgcatcaacatatttgtcacaccaaatgatttataagtctggtaaagttcaaaaactgaagggacaagagaagaaaaagtgggtgtggcaaaaaaaagagcatgttaagatgcgtggacacacaagaaaagacgagatatgttatgtggatgatgctgaacatatatgtaaggtaattagagatgcttcattggaaaagacttgtaagcctagttttacgaaatgttgctgttatggagcaccaacattttcttttaagaagatttctactgaaacgggtagtacacatgggagaacatgcaacaatgacttgcatttagatacaggaaaaaagtattattatcatgatttgttatgccaggaatgtcccgctgcttttgtgttctttaaaagtcggtatgctgctcttacggctgcacaggtactgcagacatcaaaccctatgttatgggtgacagacgtagctcctgaaccacatgatgtatattggtccaatatttgcataccatataggcaactttggatccgtaagatagctacccttgtggcctcggttgccttcatgcttgtgttccttatccctgttacatttgtacaaggcttgactcaactagacaaacttcagaaaatgttcccttttctgacagggatacttaaagagtaa

SEQ ID NO: 33885 - DNA, 423 bp, Glycine max
  Peptide Sequence Number=SeqID_125570
atgggcttttttgtggtatctgttgggaagttggaaaaggggattgagaagtttgtgaaacttgatgccaagcgactctgcatacttgtgcatagtgctctcatcgaatcctccataacttgcagctggattgggttattgagtaagaatgttgttgccaatgtgatgggtatggtttggatttcaaatgtctttcttctcggaaaacaacccagcaatgttaatgtgtactttggaaggagactagcctctcagcattcaagacgcattgatctctgcttggaaagatttgttccctcccctagctggatattgaaagcatgggaaacatctgaggatgagatactggccattggtggcttggatgctgtggttttcgtgaggatacttgtgttcaggttgttcaatccttccaagatttga

SEQ ID NO: 33886 - DNA, 384 bp, Glycine max
  Peptide Sequence Number=SeqID_125571
cctagttctttgaggaggaaacaattgctcagagagtgccacattctctccaacatcgaggctaaggaaatcaaggttaaagggaaggcagccattgatgttgtgggcaacccattgggggaagtctggagcccaccaaaccagtctcagaaaaacgacgatctcgaacctgttcaccgttggatcgtcgtgaaatttgagtatcatgttcgcaacacaattctgagcattctcaccgttgggaatttcgatatcatggagaaaaaggaatcgcatgaagacagtataagtggaggtttcaatctcttctccgtctctctaacgtttgagaattttatcggagcagtcggagaaataactgaaagaatttcagggaaccgctag

SEQ ID NO: 33887 - DNA, 408 bp, Glycine max
  Peptide Sequence Number=SeqID_125572
atggggatagttgtgaaaagcttccaaaaggattccaggcctgtgaattttggcattaaccgtggcatcacaatgcttccatcgataaacttaacaattgctatgcctgctgttatcaccacaaatacaatagccaaccccactgacaatgctgaggtgtatctcagtgaatctgatacagtggaggattttgacgcacgtgtgaaccgcacgagcatggaaatggaggattccgttaacatggcacacaaaataatcatgactaagcctggaattagccccagttgcttgacggcggccggaagagccatgatgccggcaccgacgatggtggtcgagaggttgaacaccgcgccggagaacgacgagccgcattggatggcggcatcggaaatgaggttttggtga

SEQ ID NO: 33888 - DNA, 225 bp, Glycine max
  Peptide Sequence Number=SeqID_125573
atgggggagatttatccaagtattatctcgattttcaaatttaaccaacagacaccaccaccaccgacggtggtggcaatgacatcgatgaaggtcatgttggtggcgatgatcatggtggtagtgacaataataacgacaacaattgtgttggtgatgacaacgatcataatggttgttgcagtggagaccatgtcacttgtggtagaaacattatcacgatga

SEQ ID NO: 33889 - DNA, 2082 bp, Glycine max
  Peptide Sequence Number=SeqID_125574
atgtccaattcagtgacagaggaaaaaactgtaggtggtctttctgctttaagaagtttgggaaaatcaaccaaagacaatactattggaactgctagtaatccaatccatatggtggctagagaaggtgggaatataaaagatcagctatggcgtacatttaggttcattgtggtgtcctttttcatgatttctggtgtaggagcactcattgaagataaaggaattagtaaaggacttggtataaatgaagaagttcaacctagcatggaatcaagtacaaaatttagtgatgtaaaaggtgtcgatgaggcaaaggaagagctggaagaaattgttcactaccttcgagatcctaagcgctttactcgtcttggtggtaagcttccaaaaggagttttgcttgttggtccacctggcactggaaaaactatgttagcaagagctattgctggagaggctggggttccattcttctccagcagtggtagtgaatttgaagagatgtatgttggtgttggtgcacgaagggtgagggatcttttttctgctgcaaggaagcgagcacctgctataatattcattgatgagatagatgctattggaggaaaacgaaatgcaaaggaccaaatgtacatgaagatgacgttaaatcagttactggttgagctagatggattcaagcaaaatgagggcataattgtgattggcgctactaattttccacaatcattggataacgcattggtgagacctgggcggtttgatcgccatgttgttgttcccaatcctgatgtaaaaggaagacagcagattttggaatcacacatgtcaaagaatactaccaaacataattgtcccataacacccccatcttccctacataactttaaaggggaagtagtacatacttcagcaaaaatttccattgttcttatgcaaaatgttccctttaaaccacaccagattacagaaattacagcaatttcttgctgtctcaaagctcagaaactcctagcaagattgaattggatggcatatgacgcctttttcagagttatatgcttctttctttgggctatgattggctatccattggatacttttgtgtatgagctcacccccatttactttgaagtttacgttctgaaggctgatgatgttgatctaatgatcattgcccgagtaacacctgggttctctggtgctgaccttgcaaacttgattaacattgctgctatcaaggcggcaatggatggtgctaaagctgtgagcatggctgatttagagcatgcaagagacaagatccggatgggaagtgaacgcaagtcagctgtcatatctgaggagtcacggaagttgactgctttccacgagggtggccatgcccttgtggccatacatactgatggggccctccctgttcacaaggcaactatagttccccgtggaatggctcttggcatggttactcaattgcctgacaaggacgagaccagcatttcccgtaaacagatgcttgctaggcttgatgttctcatgggaggtcgtgtcgctgaagagctaattttcggagagaacaaagtcacatctggtgcatcctcagatctcaagaaagcaactagtctggcaagggagatggttaccgagtatggcatgggcaatgaagttggactagtcactcacgactacgaagatgatggtaggagcatgagctcagagactaggcttcttattgagaaagaggtgaagcaattcctggagagggcctacaacaatgcaaaaactattctgaccactcacaacaaggagcttcatgcacttgcgaatgcccttctggagcatgaaaccctttcaggaactcagataaaggcattgcttgcccaagttagatctcagatgcagcagcagcagccccaaacacttgaagctcagaacagttcacaatccaacacagtgcctccatcatctagcaacccggcatctgctgctgcttctgcagcagctgccgccgccaccacagccgcagctacagctactgctgctgctgccaaggctaaaagtgctccagtgggatcttag

SEQ ID NO: 33890 - DNA, 297 bp, Glycine max
  Peptide Sequence Number=SeqID_125575
atggcaagaatagtttctaccggtattagtggtgcaagctactacactggaactttcaatactgtcaatcgctctccggatggaagccattctggctgccacgtaatagagcagttgccagaagaatctagaacatgcgatggagagctgatggtgaaatttttgcttgatggagaggtcactattgacacaatgacagatgatgtggaattcacagaacatgattctgaccggattgagttcttgaagctctctaacagaatagagtacacaattcgaacttggtatcttctataa

SEQ ID NO: 33891 - DNA, 1740 bp, Glycine max
  Peptide Sequence Number=SeqID_125576
atggggtttcaacatggaaatgagagcattctgacttgtccaacttccggtctcagtggtgcaaatgttaatgtttcagaaatggctattagttctgtgtctatagccaagccttcagatgtagttaacccttttattgcttcttccgcttgggatccacttgtttcattgagtcaggttcaatcttttggaggctcttcaatggtttctcatagtgagtttgccaattccaactcatcttaccctcttgttttggataaccaagggataagcaacacgtctcacctggttcaatacatgtctgactcaaatcttgggggcatggtccccaaggttcactcctatgcaagtgggggattctcagaaatggttggtgctggctctttttgccaacataggtctgctgatatggctaacacagggtatccaatacattataatccgatcaaggaggctccaattaatggtgaacaatctcaggttgaggactcaattcctgaagaggaagcaccaggatctgcacctagtgggaatagaagaaagagagggcttgatcataattccaccttcagtccaaataagggtgatgctgtgaatgattctcctgggaaggcctctaatggtccaaaagaacatgaaaagagaccaaaaggggagcagaataatggtgcagatgtgcgtggtaagcaatcagtgaagcaagctaaagacaacaattctcaaagtggagaagctcccaaagaaaatttcattcacgtgagagctagaagaggtcaggccacaaatagccacagccttgcagaaagagtgagaagagaaaagattagtgagcgaatgaggttgcttcaagaacttgttccaggatgcaacaagataactggcaaagctgtaatgcttgatgagataataaactacgtgcaatcacttcagcaacaggttgagtttttgtccatgaaacttgccaccgtgaacccagaactgaactttgatgtggacaggatcctatccaaggatattctccaatcacgcataggacatggaattggtgcatatggtcctggtatcaattcctctcacacatttcccaatggaagtttccatggaacattagctggcatgcctagtacatcgtcacaattccctcctttgccacagaatgttttggaccacgagttccaaagcttctatggaattggatacgattctaatacagcacttgacaacttggaacccaatgtctttgaattgtctaagcatgagttgcctataatatctgagatgtctaaggttcctgaattgtctaagcgcgagttgcctaaagtctctgaattgcttaagcccgagttacctaaagtacccaagttgcctgagatttctgaattgcctaagcccgagttgactaaagtacctgagttgcctaaggttcctgaatcgtttaagctcgagttgactaaaatacctgagttgactaaagtatctgagttgtctaaggttcctgaattgcctaaacctacgtttcctaaagtacctaagccagaattgcctatggtccttgaattgcctaagctcgaattgtcaaaaatacctaaaatacctaaggttcctgaattccttaaggttcccaggacattttcaactaccaatcttcagtttgaattattccttacgctgtcttgtcctcagatcaaaattggctgcattccagtacctaggtcatgttgtttgatagatgtgatttga

SEQ ID NO: 33892 - DNA, 231 bp, Glycine max
  Peptide Sequence Number=SeqID_125577
atggtttcccaaggtccaataaggtccaactataacattaatgactggctatggcccaagtgtaaaactaatgacctactagctcctgtaatgcttaaagtgttgctggtggtgaaggacattgatgttgctggtacaattatggtcgcactgggatggtgcgcaaacaatggagtggtgctggtggtagtgcgtcaatggcagggtgacgcagaggtgtcgcatgcatag

SEQ ID NO: 33893 - DNA, 543 bp, Glycine max
  Peptide Sequence Number=SeqID_125578
atggaaaacatcgacactaactacaaagttgtcactgacgtgactatctttaagttcgagaaggtcatttcgcttctaggccgcaccagaataggtcacgtgcgtttcaaaagagcccctagtgctccccctcctccacttgcagaatctaaagtctatcatgctacgccattgcagcaaatcctgccacccacccttcacactcatgctgttgtcactaaccactccttggtccccattgaggaccttgatcatgatgtagttgacgtagttctcgaggccaaggaggaggtcaaggttgcgaaggtcgatgttatcgtcgatggcgacgacagagaagccaaagctggtgatggagaggtcgatgttggcagtggtggtggtcttgcccacatcgcccttgccagaggggagaaggggagaatagaggcagaggaggaatgcgaagttaggagcgttggtggtgctagggagaaggtggagagagggcattgggaaggggagaaagggagagggagaagaagaagcctagtggtcaagtga

SEQ ID NO: 33894 - DNA, 417 bp, Glycine max
  Peptide Sequence Number=SeqID_125579
atggaccagcgtggccatggaatgtattacacgccaccaacattttctcagtatccttcgcagatgtatcagtatcctttcgaggatcatgacactgatatgtctgcaagcgaacattcgtttggtggtgttacggaaacacatcctcatttttcatggccgaccatgaccccttcgcagcaacatgatgtcccaatggcgacacctaatgccccattaggtccgcaatgggatgtacccagagcaatacctgatatgggtgacatattaggtgttgatttgcgtcacgagttttctgcagacgctgagcaagaagggccgagacagcgcgcaagaagaaatccggatcgtcaagctcgaaggtgggatcgaccatgtggcacatcctcgcgccatcacgaacaccataatgactga

SEQ ID NO: 33895 - DNA, 1899 bp, Glycine max
  Peptide Sequence Number=SeqID_125580
atgtccaattcagtgactgaggaaaaaactgtaggtggtctttctgctttaagaaatttgggaaaatcaacaaaagacaatactattggaactgctagtaatccaattcatatggtggctagagaaggtgggaatataaaagatcagctatggcgtacatttaggttcattgtggtgtcctttttcatgatttctggtgtaggagcactcattgaagataaaggaattagtaaaggacttggtataaatgaagaagtgcaacctagcatggaatcaagtacaaaatttagtgatgtaaaaggtgtcgatgaggcaaaggaagagctggaagaaattgttcactaccttcgagatcctaagcgctttactcgtcttggtggtaagcttccaaaaggagttttgcttgttggtccacctggcactggaaaaactatgttagcaagagctattgctggagaggctggggttccattcttctcctgcagtggtagtgaatttgaagagatgtatgttggtgttggtgcacgaagggtgagggatcttttttctgctgcaaggaagcgagcacctgctataatattcattgatgagatagatgctattggaggaaaacgaaatgcaaaggaccaaatgtacatgaagatgacgttaaatcagttactggttgagctagatggattcaagcaaaatgagggcataattgtgattggtgctactaattttccacaatcattggataacgcattggtgagacctgggcggtttgatcgccatgttgttgttcccaatcctgatgtaaaaggaagacaacagattttggaatcacacatgtcaaaggttccctttaaaccacaccagattacagaaattacagcaatttcttgctgtctcaaagctcaaaaactcctagcaagggttacctatttcttatgctggatttttgtttcccatcaaatacaggttctgaaggctgatgatgttgatctaatgatcattgcccgaggaacaccggggttctctggtgctgaccttgcaaacttgattaacattgctgctatcaaggcggcaatggatggtgctaaagctgtgagcatggctgatttagagcatgcaaaagacaagatccagatgggaagtgaacgcaagtcagctgtcatatctgaggagtcacggaagttgactgctttccacgagggtggccatgcccttgtggccatacatactgatggggccctccctgttcacaaggcaactatagttccccgtggaatggctcttggcatggttactcaattgcctgacaaggacgagaccagcatttcccgtaaacagatgcttgctacgcttgatgtttgcatgggaggtcgtgtcgctgaagagctaattttcggagagaacgaagtcacttctggtgcatcctcagatctcaggaaagcaactagtctggcaagggagatggttaccgaatatggcatgggcaatgaagttggactagtcactcacgattatgaagatgatggtaggagcatgagctcagagactaggcttcttattgagaaagaggtgaagcaattcctggagagggcctacaacaatgcaaaaactattctgaccactcacaacaaggagcttcatgcacttgcgaatgcccttctggagcatgaaaccctttcaggaactcagataaaggcattgcttgcccaagttagatctcagatgcagcagcagcagccccaaacacttgaagctcagaacagttcacaatccaacacagtgcctccatcatctagcaacccggcatctgctgctgctgctgctgcagctgccgccgccaccacagccgcagctacagctactgctgctgccgccaaggctaaaagtgctccagtgggatcttag

SEQ ID NO: 33896 - DNA, 792 bp, Glycine max
  Peptide Sequence Number=SeqID_125581
atgactaagtttgggaggtctgctccagagattgaaggccttgtggctgctagcggactaagtcctctaatcgcatgttccctagatacgggcgatcgaggactaatgtctgcttttatggaacgctggcataaggaaactagtagtttgcatttgcccgatagagaggtgactatcaccttggataatgtgacattgttgctacatctgcctatcgcagggacgttttacagattcaaacaacttcctatcaacgacgctatcgatatgttagtagaattacttgaagtcagtgttgcagaggcgagagctgagacaattcaatgtcatggctcttatgacgctgctgcacttgtgcacatgtatgataatttaaatgacgcgccaaagagcacgacgaggcagcttgcaggatatatcactttgttacagtgttggatctacgaacatttctcgtctgttggttccgccctagtttttgaggattatgacgagaggagaccacgtgcatgccgatggacctctggcaaggcactgctcatcatctcattgttttctggtcatctcagatggggtcccttaacggtcattcaccaaccaaagacggtttcaggggatcctcctagagttccatcagttcagcaatatgacacatttgttgaaccagatgtgcatcaacaatggatggcggcaacgacatctgatgaagcagacgtcgatgatggttttgtagcaattgctgttaagttggagaggctactgaacctgaggattttgtccgaaggaacataa

SEQ ID NO: 33897 - DNA, 468 bp, Glycine max
  Peptide Sequence Number=SeqID_125582
atggacaaagaacagtcgatgtatgacaatatcatgtctaaagaagttgatatgaatgttgaaaatgaggaagatggtggcgtgaaattgtttgctagtcatgatgaagttttacattgggctcgattggtgaatcatgacattggatttgttgtcatgataatgaggtcagacaccaatactggtgttagaggaagggcttcatttttgttaatagcttgcgaaaggagtggtgagtataggcctaagaagaatgatttgtcattagttgggcatccatatgcgggtcgactgacaaaggatgacaaaattgttgttgttgatatgacgaagtccatggtgaagtcaagaaatattctcttgacgttgaagaagcacgatgccaacagttatacaacaatcaaacaaatttacaatgtcagacatgcttaccattcttccataagagggagtgacaccgaaatataa

SEQ ID NO: 33898 - DNA, 696 bp, Glycine max
  Peptide Sequence Number=SeqID_125583
atgccaaagaatctatctgacccctgcttaagagacataacaattgcatggcaaggagttgatggaaaatggggagtaaatattggtgccaaaaatggtgatgatgggaaggctcttctctaccacatctacataagtggctcaaagagtggggttgatacatcagtccaaaactccagtgttaagcatgtcttggaaatgagttatcaaaacaaacaactagagtacaattttctaggtgaatattttcctgatcaggaaaagtttactcctgatgctgatgatttggaaggaactaacctgaacttattattggaccatgggatgttttatgcttccaagtcattttttaactatgccaagaacagaaggatattatggggatggtcaaaggagtgtgaatccacacaagatgattatgagaaaggatgggctggtctacagagtattccaaggcaagtttggcttcataaaagtgggaagtggttgatgcagtggccaattgaagaggtagaaaaactacgtgacaaacaagttagcataatgagagagaaactggttggagaatcaactattgaagtctctggtatccctgcatcacaagattctattgaaaacattattgatgtcaaagcggatggtaactgtggttatcgggcaatagttgtcttattgagtatggatgaagaatcatga

SEQ ID NO: 33899 - DNA, 176 bp, Glycine max
  Peptide Sequence Number=SeqID_125584
ggtacatcctttgtggcacaagtagaggatagcatctacttgggtttgactgagaacaagagagggtacatctcttgtggatcagttctagtggagggtacatccactaggatttttacaaggttgaaagaaatctcaaggatcgcaggtcgcttggggactggaggtaggcacgg

SEQ ID NO: 33900 - DNA, 504 bp, Glycine max
  Peptide Sequence Number=SeqID_125585
gagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 33901 - DNA, 201 bp, Glycine max
  Peptide Sequence Number=SeqID_125586
atggagaaatctgaaaagaaaaattttagtgaaaagaaaatgaagaaggcttacatcacatgggatgacaatgatatggaatcatttgaagattcagaaaatgaagaaataaacctctgtttaatggctaaaagttatgaaagcgatgaagagatgcatttgctgatttgcataaagagtcaatcaaacttggaaagttag

SEQ ID NO: 33902 - DNA, 349 bp, Glycine max
  Peptide Sequence Number=SeqID_125587
atggcgattgacctctacattcgggaagtggatggcctaagatttgagctatccatgaaccagtgcagtgataagttgtcagaactggcacatgaaattcaaaaggtttgtctgtttagttttgtgtttgttgatatcttccaaatgctaatgggcatagcagtcatctttgttttatatcatgtgacctctggatactgtttgtcaagaagtaatgatgaggaggatcaccatgagcactggaatggatctatgagtagaagtcagtcaaaacatcctaatcaacaagcttcaccacttccgactaaacttccagctggagctcatataccctcttgtgcttggcctg

SEQ ID NO: 33903 - DNA, 255 bp, Glycine max
  Peptide Sequence Number=SeqID_125588
atgtgggtgcaagccattggtttgtttgctcaagcgaccttcgctcttgagtttggacttccaagaccgttcaatcaaaacttactcgtgctacacttatgggcaatgaggggcaccatgcatgagcctcaagcgaacctaggggcagatccaaagttctcacccgtcgatggttttaaacaaaaaaagggggacaaatcctgggatttcaatggattgattaaacgtcaaacgactccattgtcagcactctaa

SEQ ID NO: 33904 - DNA, 393 bp, Glycine max
  Peptide Sequence Number=SeqID_125589
atgaaagataagagggacgaggaagaaaaactagaaaaacaaaagaaagaggagaatagtaaggccttggaaacatcccttagcacttccatacctcttgagcttgaggttattcctcaagtaaaggagttgttggatgagggtttggttcgtaagagcttaaatccttgtgctttgttggtgcccaaaataggtattatgaggcaccaaatccctatgataggtggtatgatgaatgtgttgactggtgtaaccctcttttgtaaaatcacccatgcatccaacatcttcatgattcacatacatagggacttattaggtagtgatcaaggggttcccacggatcctaagagaataaagttcattccagagtgcccactccaccaagtataa

SEQ ID NO: 33905 - DNA, 639 bp, Glycine max
  Peptide Sequence Number=SeqID_125590
atggtatcttatctagccaatccgggtaaggggccttcttattgggaccccccgaagaactccgcagtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcatatggcaataagaaggtctataagtacaagggaccgggtagaaatgttataactccagaatggtataaagaacagtacgccgacccttcccgaagtctgataaagaaggtaacttatcagtttcgacccgattggaaagaactctcggttaaaaagaaagagagtacaaccactcttagaactctcagtaactccaagagaatacctttctttaatgaaaaaggaaaggttttagacaaggaaaacagctattttagaaaaagagaattcggctctttctcagaaattacagaagctggaacaggaaagaggtataatagcccagcggagagtagaagaaggaaataa

SEQ ID NO: 33906 - DNA, 84 bp, Glycine max
  Peptide Sequence Number=SeqID_125591
atgacttttttgatatccttggttggaaaaggtcagggcttaaactggtacctggatagacgatgctcacagcacattgattga

SEQ ID NO: 33907 - DNA, 121 bp, Glycine max
  Peptide Sequence Number=SeqID_125592
ggcagacaactaccttaaggggataatttacagtgctttaaaaggttttgatgatgctccacagcctaaatcaaaggctccagctaggtggattgtcgtcaagataaaaaggaagtactga

SEQ ID NO: 33908 - DNA, 180 bp, Glycine max
  Peptide Sequence Number=SeqID_125593
atggttttcggggcttccgcggcttccgtaatacttccaaaaatcaagtcgaagtacttccgtaacgcttccgtaagcgattctgtggaaattcttcatcgttcttcaccgttcttcatccgttcttcgttcgttcttcgttcttcaacggtttctttcttccgttttaacgtgctttaa

SEQ ID NO: 33909 - DNA, 150 bp, Glycine max
  Peptide Sequence Number=SeqID_125594
atgacgaaagatgcatcaaagtttactcatatttctcccaagaatagtggacatgtgacttatggaggcaacaacaaagtaattgggttaccaaaactcgatttgaaaaagatagattatgtgatgcatgtcaaaaaggaaaacaagtaa

SEQ ID NO: 33910 - DNA, 420 bp, Glycine max
  Peptide Sequence Number=SeqID_125595
agacgatgcaaagactattactcaaagctagtcgctcactcacagtttaagatcacactctcaccgcaaaatcctcaggaatttaaaatccctgagacaggtccggggcatctggagtctgagcctcctcctcatctatcagatggaaaaacagggaaatcagagagagcaacagcttctccagataaggaatcagaaagatcagcagcttctctatttggggatttagggggagcagcagcttctctagatggggaatcgaagatgataatcaaaggtggagatgggggaactacttcaagctcaggagaagaagatggattcaccactggagattatggatcaactggcgctggttcaacccgtgcaggtgtgggctcaggagaagcaacctcattgggtctcaccagtggaagttga

SEQ ID NO: 33911 - DNA, 417 bp, Glycine max
  Peptide Sequence Number=SeqID_125596
atggtcgtcacagctcgaccggagagggtggtacgccagttcggttacatccagagcatccctctgccgcctgtatctgcggattacatggagtggtttttccgcatatctcacccattcatgataccgacccaggcaggtgaccagcagagggacgcaccagccgtagaccctgaggactacatacagccgcccagcccccaggttccagtagcatttgacccccctccacatgtggatgattacgagggatatgagacgattgcacagaggttggagcgtgtgctcaaccttaggatagtcactgcaggcacagagttatatgacattatgcaggattgcctgacgatcgcgagagggggacctagtgctgatgggactgtcagggctcgtcagagacaccgcacggaccattga

SEQ ID NO: 33912 - DNA, 98 bp, Glycine max
  Peptide Sequence Number=SeqID_125597
atggtgtttttccctaaaaaaccaaacgtgaggagtgggtgtccgccatcgccttggccttggctaacaagcggggaagttcttgactcccgttcaag

SEQ ID NO: 33913 - DNA, 888 bp, Glycine max
  Peptide Sequence Number=SeqID_125598
atgtctcctttccttatgagggatttcggcgcacaaaattccaagactatacaaagaatccataaggcatgggaaaccccgttaaggaaagatcaagaacttagaggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagtgagttaggaaaggcgaaattagccaaggagaagttcaagttggccgcaacacacattcggaaggagtgtgccgggtaccgggaagagaatgcaattaccgcaagagcccttgaacaagagaccaagaggctcgcaaggaagagtatggccggaataaatttcgcggagctctatggggtagcaatagtgaactcaagctgcgaagggaagagaggggaccagtcgcgagcacatagcatggttctaaaaaaggagttaattgcttgttcaaggtccgaaagaagcttgtctcaacgtttatgcgagacggagaccaacatgctagctatcatcgccaagtaccaagaagagttaggtctagccacggcccacgagcatagaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacgcctactccgcccccgaagagattcatgggcttctcggctattgtcagcatatgatagacttaatggcccacataattagaaatcgttag

SEQ ID NO: 33914 - DNA, 339 bp, Glycine max
  Peptide Sequence Number=SeqID_125599
atgtatcagtatccattcgaagctcatcaaagtgatacttttgcaagcgaacattcattaggtggtgttgcagagacatatctgaatttttcatggcctactatgaccccttcacaacaacatgatgctctaactgaaacacctaatgccccattaggtactcaatggaatgtgttgatttgcgtcaccaattttctcttgaggctgactagcatgaagaggggggccatcgtgacagaagaaatcctgatagacaaacacgaagatgggatcgtccatgcggcacatcctcacgtcatcatcgacatcaaaacgattgattttctttttagtatttaa

SEQ ID NO: 33915 - DNA, 757 bp, Glycine max
  Peptide Sequence Number=SeqID_125600
gatcccgagtagcgcccttaccgacagaggactatgcgtcctccccttcagagggctacacgccctcgcctttagaggactacacatccacaccttcagaggactacacgtccttgccatcagagggctgcacgccctcaccttcagaggattgcacgtcctcaccttcagaggactacacgtcctcaccttcagaagactacatgtcctcatcttcaaaggactgcacgtcctcgccatcagagggctgcacgccctcacctttagaggactgcacgtcctcaccttcaaaggactacatgtcttcaccttcagaggactgcatgtccttatcttcagaggactgcacgtcctcaccatccgagggccacacatcctcaccttcagagggctacacgccctcaccttcagaggacgacacgtccttgccatcagaggattacacaagactgcacgtcctcaccttcagaggactgcacgtgctcaccttcagaggactgcacgtcctcgcctacagaggacttgcacaccctcaccttcagagggctacacgccctcaccattagaggactgtacgcccccgccttcagaggactgcacgtcctcacctttagaggctgcacgtcctcgccttcagaggactacacgtcctcaccttcagaggactgcacgtcctcaccttcagaggactgcacgtcctcaccttcagagggctacatgccctcaccttcagaggactatacatcctcccctttag

SEQ ID NO: 33916 - DNA, 249 bp, Glycine max
  Peptide Sequence Number=SeqID_125601
atgatgcaatcctacccccaagggtatcggatagaagactccatgaagattgggccagagatgcaagagaaggccctagggtttgtagaagcaaagcttcatggtgaatcaaaggtaatcaattacctgatgcaatcctatcccgcaagggcattgggtagaagactccaagtagatagggctagagatccaagggaaggttctagggttctcatgagccttagggtagatttcgagcccatgagctaa

SEQ ID NO: 33917 - DNA, 483 bp, Glycine max
  Peptide Sequence Number=SeqID_125602
atgtgggcttttctcatcggtcgtcagatcgactgggcccatttggttcggtaccgaatgcttaaggcattacgggccaatgcacctctaccttacccacagttgataactttgtttttgcgtcattttcaaattccgcttgatgatgaaccatttgttcaagtcaagcgttcctttgcaattggtgttggtgcagtgacttcctttggttaccgtaaggatcggaatggtcaatggctgaagaaagacgcactccctcctcaagatgagcgtactccttcacctcctcctcagcgcgatgattccgcactcatgaatgaagtccttaccgaattacgaggtcttcgttcttatgttggtgaacgtttcgactcattggatacacgttttgccggcatggatattcgcctcacacaacttgaagaggatgtgggttacatttgtcagagttttgatcttccaccaccacctccaccttcttag

SEQ ID NO: 33918 - DNA, 390 bp, Glycine max
  Peptide Sequence Number=SeqID_125603
atggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatgacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 33919 - DNA, 588 bp, Glycine max
  Peptide Sequence Number=SeqID_125604
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccagatgggggagttgggtccaccttagcaactgcattggtagcggtaactgcagcagcattgacctccattatcttcttcatgctcatcatggcttccatcattgtggccatttgctctttcatggcctccatgttggccttcatccgcactcattactctggctctagcacgcattcggtaagggtgacggggggatcctctagagtcgacctgcaggcatgcaagcttggcactggccgtcgttttacaacgtcgtga

SEQ ID NO: 33920 - DNA, 174 bp, Glycine max
  Peptide Sequence Number=SeqID_125605
atggtggtgagcttttttcttgactcatcgttctctttgaagtggcgtctccaatcatctttctcctttctccattccactgccattaatcttcaagaagcaaaggactccattgatgaagaagatcccaggcttacaagctccacaaggagctacatcatgtggttttcataa

SEQ ID NO: 33921 - DNA, 102 bp, Glycine max
  Peptide Sequence Number=SeqID_125606
atggttgtgaccgagcgattgcttaacttcgtttacaaaaaaatagacacgcgtgaatgtgtagtcaagtcagccaatgtgttgttagcaatgtgtagtcaa

SEQ ID NO: 33922 - DNA, 136 bp, Glycine max
  Peptide Sequence Number=SeqID_125607
ggaattggaaggaggattggtgccatcccttgaagaatttgagtccagaagcaaggggccaaccaccttgtcataccctaatttcgtccgggaacctttgctcgatgacgtgcgaccattctttggtcctcgtgag

SEQ ID NO: 33923 - DNA, 549 bp, Glycine max
  Peptide Sequence Number=SeqID_125608
atggcgcctaccaggcaccctctggacccagataagtccaacagggccctgggatttcccgccttgatcacaagactctgccagtcgttcggcgtccccgtcacacctagcaaggtgattcggccgcccatcacccgagcttttattgagaagtactgcacgcagagacaggtccagggtgatgcaccacaggccgcggacgcgccgctacctcatcaggctggtccagccgaatcatttgacacggagcagtatttgcggcatttggttcgccagcaagtggccaaccaccgggcacatgtacagacccatgattgtctttatcagatgagtctcagcctgcagagccagggctttacttcttttccgtgccctactccggaccagttcagggcagaggtcgcatggcctggagattggcctgaggcccaggcaggagaggcaccagtaggggcaccagcagaggctcccgacgaggcagatgaggcctgcgaggatgaagagatgaccgatttacttgatttcttaggaggtagcggggccacatga

SEQ ID NO: 33924 - DNA, 195 bp, Glycine max
  Peptide Sequence Number=SeqID_125609
atggcttctatggatacctctgctaagaagggatcaagacagaacccatatgcgatgcatatgcaaaagacgcaatacgggaatgtacatagtatgacaatattcactgaacataagcaaaaggggtatatgatacttatgcatggcagttgtgaaaaatggcacgcaacgtgtttgctccgtgcccctatttaa

SEQ ID NO: 33925 - DNA, 293 bp, Glycine max
  Peptide Sequence Number=SeqID_125610
atgactgatgtcacttggcaagacgcgggatccgcaggaccaccggccgccatgcaagagcaataccgtccagaagacatagaatcgaacgtacagcttcactggcaagagaagcagactttcaaagttaccgaagacgacagcaaggaaaagtactactgcctatccatgctgccttacccgtccggccgactgcacatgggccacgttcgtaactacactatcggcgacgtgatctcgcgctatcagcgcatgctgggcaaaaacgtgctgcagccgatcggctgggatgc

SEQ ID NO: 33926 - DNA, 755 bp, Glycine max
  Peptide Sequence Number=SeqID_125611
atgaggggagcgccaaccgaagaaagtctctcgcctttccttgtgagggatctaggcgcacaaagtctcaaggttatacaaagaatccacaaggcctggaggagtccattgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaagtccgagctctaaaattggagctagggaaggcaagacttgccaaggagaagttcaaatcagctgctacacacatccggaaagagtgcaccgagttacaagaggaaaacgcggacactgcaagagcccttgaacaagaaactaaaagggcccgcaaggaggaatatggccgagagaaattccgaggagcattatggggtagcaacagtgagctcaagctccgaaaagaggaaagagacccgtcacgggtgcatggcatgatcttaaaagaagagttagctgcgtgcgcaagatccaagaggagtttggctcaacacttggaagccacagagcaaagcatgctagctatcatagggcaatacaaggaagagttgaaccagtctgtggcccatgaacaaaagctagtggaggattttgcacaagtgtacgctaaaaaagaagcaagagggagggtgcttgatgcattgcatcaagaagcgactatgtggatggatag

SEQ ID NO: 33927 - DNA, 426 bp, Glycine max
  Peptide Sequence Number=SeqID_125612
atgtccaaatcttgtggatttgggatgaccagccctctcgatgagtcgatctcttgctttctcataagggtggacccttgggtacttgtacctatcaccttgagaggactacatgtcctcaccatcagagggctgcacgccctcacctccagaggactacatgtcctcgccttgagagggctacacgccctcaccttgggactacacgtcctcaccttgaaaggactacacgtcctcaccatcagagggctgcacgccctcacctccagaggattacatgtcctcgccttgagagggctacacgcatgggtctataccctcaccgttgagaggactacacgtcctcgccttgagaggactacactgccctcacgatcacagggctacacgccctcaccttgggtactagttaccctcaccgtttga

SEQ ID NO: 33928 - DNA, 465 bp, Glycine max
  Peptide Sequence Number=SeqID_125613
atgacggtgaaaacctctgacacatgcagctcccggagacggtcacagcttgtctgtaagcggatgccgggagcagacaagcccgtcagggcgcgtcagcgggtgttggcgggttgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccatgaggtggacaagattgttgatggaagggagagttcagagtaa

SEQ ID NO: 33929 - DNA, 414 bp, Glycine max
  Peptide Sequence Number=SeqID_125614
atggccccaaggaagcttgcctcaaagagatccaggaaagacaaagcggctgaaggaaccagttccgctcccgaatatgacagtcatcactttaggagcgctgagcaccagcagcgcttcgaggccatcaaaggatggtcattcctccaggaaagacgcgtccagctcagggacgacgagtataccgacttccaggaagagatagttcaccggcggtgggcatcgttggttacccccatggccaagttcaacccagatatagtcctcgagttttatgccaatgcttggcctacgaaggaggtggatccctttcgatgcggatgccctcagccagttcctgggatacccgttagtgttggaggagggccaagagtgcgagtatggccagaggtggaaccaggccgatggttttga

SEQ ID NO: 33930 - DNA, 167 bp, Glycine max
  Peptide Sequence Number=SeqID_125615
ggtcatcacaaaagacagcaatagatacctcaaagccctacactggggcaatgagaggcaccatggatgagcctcaagcaaacctaggggcagatcaaaaaatttcacccggtaggtcgaaaacccgaaagggtggcctaggaaaaattagggttggtaaaaaataa

SEQ ID NO: 33931 - DNA, 171 bp, Glycine max
  Peptide Sequence Number=SeqID_125616
atgccaaaagttcaaaagaaaggctttgtagcacaatccatgaagttccgtgacatgtcgggaattaagaggaagtgggtgcaaatagcaaccaggcccacttgggccttccagaaaattcctccagaaggcggttgcttatggaggaaggaacctagctcgcctgggtga

SEQ ID NO: 33932 - DNA, 984 bp, Glycine max
  Peptide Sequence Number=SeqID_125617
ccaccaccaccggcaattgcaccgtgtcatacaccgcccaacagtcccgcgccgtcggcgcccaggaacagcagcagcaacaccagcagcggcgtcctggaacgttgccggacaggcaggtgcttgacctcggcatcgggcacgcggccttcgagcgaggcaagaatgcgcgacgactgcggctcatccacggcggatgaacgccccgccagcaagctgggaatggcgggcggaggtcgcgattttttttcgtcttctgccatgcgaggttccgtgtcggcaggggcttgggataccgttgctacttctactgcccctatattttctgctcgcgatcggcgtctccgcgctgctggtgttcccgtctttcagggccgggaccgcgcggggcgcgcgcgcgttcgcacagggatacgccgccgcgtggcgcgcggcgcggggcaggcgggcggcgtggtgggcggctcggcgcaagtggtgcgcgccggcgtcggcaaggccggcaacacgttttcagcgtaccgctggcagatcgccgcggggctcgcggtggtgctgcttccgtcccttttcgctttcgtcatgcgacacaatcacacatttatttacgaggatcggatggccggtccggacccgcgcatccaggcgctgttgacgggcgaacggctggtcccgccgccaccgctgccgcccgaagtgttcaccacgcgcgaggtggaactggtgcgtcccaacctgggcggcgccagccgcgactggaatctgctggacgccgactaccgtcagcgcctgctggcggcctaccgcgtgatgcgtgaaaaacatggctatgaaatggagttgatcgacggctaccgcaaccccgagcgccaggaggaattggcgagcaaaggctcgcacgtgaccaacgtcggcgcctaccaaagctatctacattacgggctggccgccgacaacgcgttcctgcgtgacggcaacgtggtg

SEQ ID NO: 33933 - DNA, 243 bp, Glycine max
  Peptide Sequence Number=SeqID_125618
atgtgtcctccaccttcgagtttggagccatccgtagtgattgctctttgcaattctccattcataaccccttttcggagccccatgaattgcgtttttgttcatctgtcctccaccttcgagtttgaagccatgcgtagtgattgcttagtgcaattctccattctcaaccctttttcagaaccccgtgaattgcgttttcgttcaggtgtcctccaccttcgggtttggagctatgcgtag

SEQ ID NO: 33934 - DNA, 168 bp, Glycine max
  Peptide Sequence Number=SeqID_125619
gaaatgccaccgaggaagctcttcgcaaagagatccaggagggacgccgcggccgaaggaaccagcgccgctcctgagtttgatagccatcgtttcaggagcgcagagcaccagcagcatttcgaggccatcaaaggatggtcgttccaccaagagagacgcatctag

SEQ ID NO: 33935 - DNA, 406 bp, Glycine max
  Peptide Sequence Number=SeqID_125620
ggggcagcgcgatcaattggtttcctcgttggaaggaaggcaaggaaggagttcttttctcgtgtggggactaccctaatgttccactgatagggactaggggcgcgcaaggtcttaaggttatacaaagaatccacaaggcgtggaggaatccgttgaagaaagacaaggagcttaggggcatccgaaatggcgtcattggaggttatcatggatggctaagaattcatgcgcgagggttagattggctctccaaattgaaagttatcgatgaggagaatttcgaagctccggaggaagatgaagaagagaagttcaagtcagctgctacacacatccggaaggagtgcgccgagttacaagaggaaaacgcggccactgcaaaagcccttgaacaagaaaccgg

SEQ ID NO: 33936 - DNA, 270 bp, Glycine max
  Peptide Sequence Number=SeqID_125621
atgtctgaagaagttgatatgaatgaacaaaatgaagacgaagctagtgtgaatgaagaacatgttgattgttctgatgcgttcaatacttctctgtcaatggtgaaaccaagaaatattctgctaactttgaaggagcacaatgccaatagttatacaacaatcaaacaaatatacaatgcaagtgcataccattcttccataagaggtagtgatattgaaatgcaacaactaatgaagcttcttgaacgagatcagtatattcattga

SEQ ID NO: 33937 - DNA, 144 bp, Glycine max
  Peptide Sequence Number=SeqID_125622
atgggagcgggctttatggctaatttaggggtggcctttgtggatgattgggtgttcttggctgatagggtggtgggtaatgagaagggccgatattggctgagtattgacattgttgagctggtggaaaatttggccatatag

SEQ ID NO: 33938 - DNA, 300 bp, Glycine max
  Peptide Sequence Number=SeqID_125623
atgttgctaagtagtaacatcatctatatctgtgaaagagtggtcatgttggtgcgcacgatccgcactcgtctctttgcagcggcacgggtgaaatcttgccccagtatgtatagtagctgcgtgatagcctccctctctggttgtgctcgcacagttggtcgccctccaatatcagggggtggcccaggaactaataaaaggaaactactggccccaagagagatttcttcttctcttcttcttatttctgaaaagggattaagagaccgtgggtctcttgttgtagaggattcctga

SEQ ID NO: 33939 - DNA, 66 bp, Glycine max
  Peptide Sequence Number=SeqID_125624
atggcgctaagcgcgccttcgaggctaagttcaacaagagacatctacgaacgaagcttagtttaa

SEQ ID NO: 33940 - DNA, 177 bp, Glycine max
  Peptide Sequence Number=SeqID_125625
atgatgaaaatgttcaaaaagcagggaaatgaaaatcctgatcctgtcaatgatcttgtgcatgctcattcaggtccagtgctggtgcagatgatggatcctgagaaagaggcaggctctaaagtgaatggctcaggaggtgtaggctctgcagcctctggaatgtccttctgctga

SEQ ID NO: 33941 - DNA, 328 bp, Glycine max
  Peptide Sequence Number=SeqID_125626
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagtaccctgctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 33942 - DNA, 390 bp, Glycine max
  Peptide Sequence Number=SeqID_125627
atggacatgaacattggcggtttgatctctggacaaatgatcatgatggctcagtctaacccttctcgcttaggctttccagctttaatcacagccttttgtagatcgaggggagtgggatctgatgcacttacctcctatgaaaacttaaggccggccattgacttagcttatatcataaagagctgttggaatgcgaatgaccaaacagttaaatttccagaggcatggaagaccaagctcagagcagctgatgctccctcttcctttgcgccaataactgacatccctgcatcctctacttcagccccactcctagctttagcagacttatttgcccagagctctcagacttcagatgccaaattgcaaagcttgtttgaaggatag

SEQ ID NO: 33943 - DNA, 498 bp, Glycine max
  Peptide Sequence Number=SeqID_125628
atgtcagttttggaattgtacatagaaaaggatgtggctggtggttctatgtttcattctgcaaattctcttacatcatgcgaaaataatttatctaataatgaggcgcaaccgccaacaaatgtgagcaacttacacagtgatgatgatgatgatgattatcttgtgtctaactcatacgttgaagagtctttagacgaagatgatagtgttgacgatatatctgatacagacgatgaagtcgccgacatcattcaaccagtaagaattgttcactcagcagaaggtgtacaaggaattgaaaatccattttggaatgatgctttacattataacaatatcaactggagtcatcctgatgaggaagacatttgtggtttggagatgccatcgagttttaatgttggacaagaattatatgttgacatgaattttgataataaaaaatgcactgaaacaatatgttatgaaggtgcatcaaactttcaaagttgttga

SEQ ID NO: 33944 - DNA, 470 bp, Glycine max
  Peptide Sequence Number=SeqID_125629
gaatgtatggtctgcttgggccagcaacattttggaaggaaggagcaggctgctattgttgttgctgagggctggaccatctgagattagggtgattcctccatccagggttgtatctgttgctggagaggctgctcaattgctccaggttgctgcatggaagggcaaaggtctgtatggtgaatactctcttgaggtcatcccagctcgtgatggaccttggagcaagggtgtcgcaacatgccctttcgcgggcgagcgaaggcgaggctcacgggtgcgctttccaaaggaggaaagatgcgcggagtcgccaccaacgtttatttatggaaaacgtcgggaaaaccgaaggaaaccggtcaaaatgaaaattctaagttcgggagttgtatttacgcttgaggaaggtcgcaaaagcggggctcttgctcctacgtaccctccatcgaagaggaaatcagacctac

SEQ ID NO: 33945 - DNA, 364 bp, Glycine max
  Peptide Sequence Number=SeqID_125630
atggggacaaatcaaacctgcaagaggttttaccaagtcaaggttaaaagcctagataccaccagcatcaaggaattagggcggtttatggaacccctccaaatgcaagccttccgcaagatttacggaaagatcttagagttgaccatagcagagatatccatagaagccatagcatcactcacccaatactacgaccagcctttgagatgcttcacgttcggagacttccaattggtaccaaccattgaagaatttgaggaaattctaggatgtcctcttgggggaagaaaaccatgcctttcctctgggtgtctcccttctttgagcagaattgcaactgtggtccaggattcagcaagag

SEQ ID NO: 33946 - DNA, 261 bp, Glycine max
  Peptide Sequence Number=SeqID_125631
cagtaaggaccttcttccagttctcgtacgtgaggtccaccttatcacgcgccacaatccctaaatatgttcttaatttcttcctttggggaccgtcgtccttgccggtagtaggatcaatgtggaccactggtctgttagcaccaggtggtctggtagacaaggatcatagacgtgaggctttgcatgtccgcttcatggcagatggcgaagctgatgcgtctgaaggaggaggaggaggaggaggaggaggcgaggcag

SEQ ID NO: 33947 - DNA, 285 bp, Glycine max
  Peptide Sequence Number=SeqID_125632
atgcccattgagagccaacaaccacaatttgatcatgcacatgtctctcaacccatgggggagacacatgaagtaccccgccacactgtagccgactttgagcctcacctcaaatatgccactgagggacagtatcgcccacaaccacaacccttgcattttgcattggaaaggctgcctcctgccatggtggaaagggagaaatttgatcatatagaggaaaggctgagggctattgaaggaggcagggattatgcctttgctgacatggaagactgtgcctag

SEQ ID NO: 33948 - DNA, 498 bp, Glycine max
  Peptide Sequence Number=SeqID_125633
atgggtgatcaagaggagacacaagaacagatgaaagccgacatgtcagctttgaaagagcaaatggcttccatgatagaggccatgttaggaatgagacaaatcatggagaaaaacgtggccaccgctaccactgttagttcggctgccgaagcagacccaactctcctagctactgcacaccatcctcccccaaacacgcccgacgaggtccacgaagatcatcgagagtatgcccaaggggatgtcgatttctaccccccgatccccgtcgtggggccggcacctaacacattgcctcagcacaacctcacaacacaaccaatattcttgtccacagaagaaccacccccggcgacggaagaaaaaaggaaactcgatctcctcgaggagagattgagagctgttgatggctttggtgactatccattcgcagacatgacgaatctttgcttggtaacggatgtcgtcatccccccaaaaattcattgtacctga

SEQ ID NO: 33949 - DNA, 381 bp, Glycine max
  Peptide Sequence Number=SeqID_125634
atgccacgtcgcattccagattatccagatgcttacgctggatggaatgcccttagcagttttggctcttatatatccgtagttgggattcgtcgtttcttcgtggtcgtaacaatcacttcaagcagtggaaataacataacaagggcgaacattccttgggctgtggaacaaaattcaaccacactggaatggctggtacaaagtcctccagcttttcatacttttggagaacttccagctatcaaggagacgaaaagctatttaggaaagcaagctcagttcagaatggctacttaccaacagaggatagcgaggtactacaaggccagagttaaatttggaaattggatcgagctgagccggagctgctcctactga

SEQ ID NO: 33950 - DNA, 132 bp, Glycine max
  Peptide Sequence Number=SeqID_125635
atgctccaaccatatgggatcaacataggcttaaaggagcactcaaacccggtggcccccaaggcctacactctgaagagtccgtcaaggcctctccctcctgattcagacaagtggcctcagatatcttaa

SEQ ID NO: 33951 - DNA, 534 bp, Glycine max
  misc_feature (223)..(223): n is a, c, g, or t
  Peptide Sequence Number=SeqID_125636
atggtcaaaggactacacgtcctcgccaacagagggctgcacgccctcaccttaagaggactgcgtgtcctcactttcagaggactgcatgtcctcaccttcagagggctacacgccctcgccatcagaggacatgccctcaccttcagagggctacacgccctcgccatcagaggactgcatgtcctcaccttcagaggactgcatgtcctcaccttcgtanggctacacgccctcacctttagaggaccacatgtcctcaccttcagagggctacacgccctcgccatcagaggactgcgtgtcctcaccttcagagggctgcatgccctcgccatcagaggactgcatgtcctcaccttcgtagggctacacgccctcaccttgagaggactacacgtcctcgccaacagagggctgcacgccctcaccttgaagaggactacacgtcctcgccaacagagggctgcacgccctcacctccagaggactatacatccttgccttgcgagggctgcacgcccttacctttag

SEQ ID NO: 33952 - DNA, 525 bp, Glycine max
  Peptide Sequence Number=SeqID_125637
atggattccaactcccaacaatttagtgcaagaaatgttgttattgttcttagaggagtccatgaggtggccacggattcatcttcatctactgaaaataaaaagcttgaaggaaaacttgatgccttggtcaacctaatctttgtcctactttccagcaatctggagtcaatgagcaacctgaagcttatgctgcaaacatttataatagacctccacagcagcaaaaccaacaacagcaaaatacttatgacctttcaagcaacagatacaatccagaatgttgctggtccaagcaagccatatgttcctcctccaatgcagcaacaacaacaacaacaacaacaacagtcacaacaaagacaacaagcaactgaggctcctcctcaaccttccttagaagagttagtgaggcaaatgaccatccagaatatgcaatttcagcaagagacaagagcctccattcagagtttgacaaatcagatggggctgatggctactcagatgaaccaagctcagtcctaa

SEQ ID NO: 33953 - DNA, 861 bp, Glycine max
  Peptide Sequence Number=SeqID_125638
atgctggcgcgccagcgccgccgcgtgcccgacagcatcaccgtgctgggctggcacgacagcggcaagcgcgcggtgacggcgcaggcgctggtcaatccggccagcggccaggacgacgccgccgggctggattggtacgaggtcgccggccacggcggtttcgccgatgaagcgcaggcgcggcgccaggccaatctggcgaccgaagccctgcgcgcccgcgccgagaccttcgtcggcctgggggtggtgcgcaccttccgttccggcacgcgctttacgttgcgggatctgtcgccgctggggccggccggggaaggcggcttcgaaccggagttcgcgctcgatcgcgtcgaacacgtgggcatcaacaacctgccgcctgaaacgcgggcctcgctggcccagcgcctgggagggctggatgcgcacctggtgctggacggcgacgcgctggccgcgcccggcgccgaaccgcatgaagccgtgtcgctgcgcgtggacccggcggtgctggccaaggcgcgcgaggtcggctacgccaaccgcttcgaggccgtgcgctgcgaccgcccctggcggccgccgttgccaagcgcccgcggcgcgcggctggcgggcgcgccttcggtgcacggcgtgcataccgccgtcgtgacggatgccgaaggcggcacccagccgaaggagcaggacgagatcctgcgcaacaagcgcggcgacgtgcgcatccgcttccattggcaagggagcggcgccgatggcgaagcccgcagccgctgggtacgggtggcgcagcgccagtcgggcgccggcatgggcatcagtttcgtgccgcgcatcggccaggaagtgctg

SEQ ID NO: 33954 - DNA, 309 bp, Glycine max
  Peptide Sequence Number=SeqID_125639
atggctgaggcacactctatctctgctcgtatggttgcaaactgcaaactgtccaaacatggagctgacctatttcatgatccaactctctataggtcagtatatatggctaatccattggattctcattgggctgtggtcaaaaggatattaagatatctcaagggtactatatttcatggtttattccttcaacctgcttctgtttcaaaacctatggcactcgatgctttctggctgattgggcatcagatattgatgacagacgttccacatcaggagcagctatctttcttggctcaaacatga

SEQ ID NO: 33955 - DNA, 201 bp, Glycine max
  Peptide Sequence Number=SeqID_125640
atgaccaaacttggtctctgcttgtcatctgctctggatgacaaaagggtgcggataaccggtgcggataaccgtaaggtatctccgcgggctaccagctcttgggtcatggcaacaaaaggcggtgtggtcgacaaaagcgaggctcttgctcctacgtatcctccaatgaggaactcagacctacgtagttctggataa

SEQ ID NO: 33956 - DNA, 210 bp, Glycine max
  Peptide Sequence Number=SeqID_125641
ctaccctcaccgttgagaggactacacgtcctcgccttgagaggactacagcgtcctcaccatcagagggctgcacgccctcaccatcagaggactacacgtccttgccttgagagggtacacgccctcaccttgggtactagttaccctcattttcagtgtgaggactcagtccacaccttaaagaatttaagggtcctctacccttaa

SEQ ID NO: 33957 - DNA, 186 bp, Glycine max
  misc_feature (112)..(112): n is a, c, g, or t
  Peptide Sequence Number=SeqID_125642
atggagctggtgaaccgtataggcggtttcaccgtcctttgtgatgtgagctgcattaatgaatcggccaacgcgcggggagaggcggtttgcgtattgggcgctcttccgnttcctcgctcactgactcgctgcgctcggtcgttcggctgcggcgagcggtatcagctcactcaaaggcggtaa

SEQ ID NO: 33958 - DNA, 234 bp, Glycine max
  Peptide Sequence Number=SeqID_125643
atgccaaacaactaccttaaaggaataattaacagtgctttgaaaggacttgatgatactccacaacctaaatccaaggctggtgctagacaaaaaggaagcactgagtgtgactattacgtgatgcactggatgtccactataatcttaggaagtttcaggaataattgggaaacgtattttaatgatgttagacaattggaagcagagagattgaaggcgcttcgtatctag

SEQ ID NO: 33959 - DNA, 225 bp, Glycine max
  Peptide Sequence Number=SeqID_125644
atggagaaaaatgaagaaataacaatagaagagaaggtaaagcaaaaaattaatggagcttcaatgaggtcctttaatggtgattttccaccatggagatgcagtagaagacaaaggagaagaggtgagaggaggtgccaaccactagggaataagccatggaagaaggagcttcaccaccaagatgagccttggataagaagcttggagaggatgcttcaatag

SEQ ID NO: 33960 - DNA, 240 bp, Glycine max
  Peptide Sequence Number=SeqID_125645
atggctccggataggatgcaactatcgaacatgtgtaaaaatgagcacaaatctttcaaggaatacacccaaaggtggagggatctggcaacccaagtggcacccccaatgacggaaaaggagatgataacaatgatagtagatgttggatttcccctgcagttactttttggtctactttttctttatacaaatatgtttaagggaaatctgcctaagttactaaacctcgatccctag

SEQ ID NO: 33961 - DNA, 534 bp, Glycine max
  Peptide Sequence Number=SeqID_125646
atggcatctaagaataggaaagcaccctttacacctatccaagctagatttgatagatctaggttcacatccctagaggcttgggagagatatacagacattgtggtgcctcgcaagcttttaccagaaaggaatgtggtagtttattatatagagtttgatgagttcaaggaggaactcgagagacgccattgggatgagaagctggctgatttttctgacagcagcatagacatcgccattgtaaaggagttttatgagaacctctatgaccccgatgataaatcacctaagcaggtgagggtgagaggtcatttagtgaagtttgatgaggataccttcatcacattttttaagacccctatagtgctggaagagggggaaaacttgtgtacatattctagatttgcactcctgaggcctgatcctcaagagttggctactaagctttgtatcccagggaggggatttgagcttattgctgatgggcagcctttgaagattctgaggaagaacatgactactctagcttag

SEQ ID NO: 33962 - DNA, 315 bp, Glycine max
  Peptide Sequence Number=SeqID_125647
atgaaaacagcccgaaccaagatagatgtttatgctggcacattttctatggaatttggtgatattgttgttcattttaacattcttgatgccatgaaacatccatctgaggatcattctatttttcttgctgagataattgatcagattgttgatgattatatgtttgattttgattctgttcttcatggtgttgtacctcttgatgttgattttttagagtctgaatgcactaaccatgttgcaggaagtacatatatttttgacttgctttatgaggtacaggctagggaatcttcttcttctcataccctg

SEQ ID NO: 33963 - DNA, 315 bp, Glycine max
  Peptide Sequence Number=SeqID_125648
atgcttaacacatgcaagtccgaaccgttgttttcggggagctgggcagaaggaaaagaggctcctagcgtgaaggttgcttgtctcgcccaggaggtgggaacagttgaaaacaaagtggcgaacgggtgcgtaatgcgtgggaatctgccgaacagttcgggccaaatcctgaagaaagctaaaaagcgctgtttgatgagcctgcgtagtattagccacactgggactgagacacggcccggactcccacggggggcagcagtggggaatcttggacaatgggcgaaagcccgatccagcaatatcgcgtga

SEQ ID NO: 33964 - DNA, 211 bp, Glycine max
  Peptide Sequence Number=SeqID_125649
gatccccggaagtgcgcgtagcgcaccagctgaaaaagccctttccccttactctaacaaattgggttgctggatacgggatcctcgtagtaggctggaccaacatccagccgagagagggcagcctttagaagcaacaagcgagaaatggcttgatgaaccgttccgttcgccacgcaccggccccattcacttgcttatcgtagaggct

SEQ ID NO: 33965 - DNA, 277 bp, Glycine max
  Peptide Sequence Number=SeqID_125650
atgtcagttctagaattgtacgtagaaaaagaagttgctggtggttctatgtttcatgctgcaaattctgttacgtcatgtggacataatgaatctcatcatgagtcggaacttccaagaaatataagcaatttacatgatgatgatgattatcttgcgtctaactcatacgttgaagagtctttcgatgaagatgatagtgttgatggaatatctgatacagacgatgaagtcaccgacatcattgaaccagtttcaattgttcacccaactgaag

SEQ ID NO: 33966 - DNA, 630 bp, Glycine max
  Peptide Sequence Number=SeqID_125651
atgttttccttttcggtggaaaaacccagtggaccgttcggtcctgccaatctttttcggagccccatgaattgcgttttcgttcatgtgtcctccaccttcgactttggagccatgcgtagtgattgcttagtgcaattctccattctcaccctttttcggagccccatgaattgcgttttcgttcatgtgtcctccaccttcgagtttggagctatgcgtagtgattgcttagtgcaattctccattctcacccttttccggagccccatgaattgcgttttcgttcatgtgtcctccaccttcgagtttggagccatgcgtagtgattgcttagtgcaattctccattctcaccctttttcggagccccatgaattgcgttttcgttcatgtgtcctccactttcgagtttggagccatgcgtagtgattgcttagtgcaattctccattctcaatctttttcagagtcccatgaattgcgttttcgttcatgtgtcctccacctttgagtttggagccatgcgtagtgattgcttagtgacattctccattctcaccctttccggagcccatgaattgcgtttttgttcatgcgtcctccaccttcgagtttggagccatgcgtag

SEQ ID NO: 33967 - DNA, 402 bp, Glycine max
  Peptide Sequence Number=SeqID_125652
atggcatccgggaagaggaaaagcactgcttccaaacctcaggctcaatatgataccaggcgattccattctttggacacttggaatagatacaccgataacattctcggccggaatatccttccgaagagaaatgcgcagatttatcatactgagtttgacgagtttaaagtagaattggagaggcgtaatctacacgaatgcctcaccaatctccaagatggatgcatagatgtagttgtggtgaaggagttttatgctaatttatacaccacagaggagttgaggactaatcctcaggagattgatgctaggctctgtattccccacaaggggtttgttttgaatgctgagggccagccatggaagcttctcagaaaagatttgatgacactagcctag

SEQ ID NO: 33968 - DNA, 264 bp, Glycine max
  Peptide Sequence Number=SeqID_125653
atgtcaggacttacacgcgattctcctcaaattccaggcagcccgcatcaattagaccttgcaccttacgcttcaaggcactacaatgctcaatggaacaccccggggcttctccatgacaagcacaccttgtgtttgagtcgtattctcggagaaatggaggttgatgaaccttggctggggttatggctaccattgaattatcaagtagatatgggagtggtgttcgtcattggaagtgcggtagacaggctttatggttga

SEQ ID NO: 33969 - DNA, 300 bp, Glycine max
  Peptide Sequence Number=SeqID_125654
tgtggggttgcaacggagaacaacggcggtttgtggtggctaatggtggctttgggtgaagtagaaagtgcttgggacattagaaatggctttggaagaaagaaggaagaagaaatggtgtttctcctaagctacacgaaggccaaggctgaaaacgctcaagtgagaaatggtctcggacacagaaacgtcgcgcacactccagatatcttctcaacaatcccaacggcagctcatgtagcttcctcaagaagcttcattaagaggcttcctcaagaagcttcctcgtggcttctttga

SEQ ID NO: 33970 - DNA, 851 bp, Glycine max
  Peptide Sequence Number=SeqID_125655
cccgtgaaggccgcgcctcgcaagacggcgaccgcgtcacgctggacttcgccggcaccatcgacggcgtgccgttcgacggcggcaaggccgaagacttccccttcgtgctcggccagggccgcatgctgccggaattcgaagaagccgcccgcggcctgaaggctggcgaaagcaaggtcttcccgctcaagttccccgatgactaccaaggcaaggaagtcgccggcaagaccgccgaattcaccatcaccgtcaaggaagtggccgaaggcgtcctgcccgaactgaacgccgaattcgccaagtcgctcggccaggccgaaggcgacatcgaaaagctcaaggccgacatccgcagcaacatcgaacgcgaagtcaaggtgcgctcgcaaggccgcaccaaggccagcgtgatggacgccctggtcgaagccggcaagttcgacgtgccgaaggcgctggtcgacaacgacgtgcaaagccgcatcgccgccgcccgcgaagagctcaagcagcgtggcgtgccgaacgccgagtccgtgccgatcccggccgaggccttctcgaccgaatccgagcgccgcgtgcgcctggggctgctggtgtccgaactggtcaagcaagcccagctgcaggccaagccggaacaggtccgcgcccgcatcgaggaattcgcggaaaactacgaacaacccgcccaggttgtcagctattacctggccgaccgccagcgtcgtgctgaaatcgaggcgatcgtgctcgaagacaacgtcgtcgcgcacgttctggaaaaggccaaggtcaccgacgaaaaggtgcctttcgatcagttgatggggatggcgtaa

SEQ ID NO: 33971 - DNA, 378 bp, Glycine max
  Peptide Sequence Number=SeqID_125656
atggcattagcgcgtgacttttgtaaggaaacaacccatggggcattttggtttgtacatagtttctatttttggaacatgtattcattcccgaaaaaggctagagtattagaaataccaagaggtgcacatgtgaaatttttggtaccccaaaatgctttgagtatgcatgaatggccccgaggaagcttgcctcaaagaggtccaggaaggacaaggcggccgaaggaactagttccgctccggagtacgacagtcaccgctttaggagcgctgtacaccagcagcgcttcgaagccatcaagggatggtcgtttctccgggagcgacgcgtccagctcagggacgacgagtatactgattttcaggaggaaatag

SEQ ID NO: 33972 - DNA, 336 bp, Glycine max
  Peptide Sequence Number=SeqID_125657
ggctgagaggagaaggaaacttctgcaagacagagcagttgcatccattcttgaggaagagactcatttctctgacttattatcacctgattcaccatcatcaagggaatccaacactcaattacctgaagtcattactgtggcagaagagcataaccagaggattacccttgaggattactcaaggaaattatttcaaggattacctaatgaagaaccctatgcacacttggcaatgttcattgaaatatgcaacactgttaagattgccagtgtaccagacgaagctattaggctcagccttttctcattctcattggcaggagaagccaagag

SEQ ID NO: 33973 - DNA, 240 bp, Glycine max
  misc_feature (53)..(53): n is a, c, g, or t
  Peptide Sequence Number=SeqID_125658
ttctacggagtgcctgtcacccccagcaaggtcatcaggcctcctgctaaccngagctttcatcaagaagtgtgcccccaggcaggcacagggcgagacaccacaacagtctggggatggccgacagcgggcaatagacgcaccgccgccacctccagagcccctcagctcatctaaaaaggttggagcgtggcctacgacccgtggccgaccaacaggtgaccaagtccaaagccaaag

SEQ ID NO: 33974 - DNA, 160 bp, Glycine max
  Peptide Sequence Number=SeqID_125659
gattcgaccatctaaggttgggatgattcctctatccgggattgtacctgttgctggagagcataagcttcaggctgttcaattgcttcagattgttgcacagaagggcaaaggtgatggaagcttgcttgtggagcttctatggaggctggatctttga

SEQ ID NO: 33975 - DNA, 318 bp, Glycine max
  Peptide Sequence Number=SeqID_125660
atgactgagacaagtatgcaagcggggaataccgatgtgtatggattcctcgagccacagtctatccagagatctggccaatcgcaatttgaatcagaaagttacattaagaactggatgcaaaattcaaaatgggatgtgtacctgtatggtgcatattggcaaatggtcgtcattttgcctaaggaaaatgttgtcatttggttttgttccttgcataataagccagacaactacctcaaaggcataattaacagtgttttgaaagaacttgatgatactcaacaaatactgtgtagactaaggggatctctctag

SEQ ID NO: 33976 - DNA, 450 bp, Glycine max
  Peptide Sequence Number=SeqID_125661
atgtttcctttcgactcccgacatgttgcagaacttaacggattgcctaacgatgggtgtcaagttcctcgaagtggtcaagtgaagggaaaggcaatcaattcatggggctccagatatgatggtggaggatgcatgaacagcgctaggcaatcaattcatggggctccggactcgatggcaatcaattcatcaggctccggacttgatggtggagggtgcatgaatagcgctaggcaatcaattcacggggctccagacttgatggtggaggatgcacgaacagcgcaaggtaatcaattcatgggaatccggactcaatggtggaggatgcatgaacaacgcttggcaatcaattcatggggctccagactcgatggtggaggatgcatgaacagcgctaggcaatcaattcatggggctccggacttgatggtggagaatgcatga

SEQ ID NO: 33977 - DNA, 177 bp, Glycine max
  Peptide Sequence Number=SeqID_125662
atggttttcggggcttccgcggcttccgtaaaatttccgaaaaccttggaaaaatcaaagtcgaagtacttccgtaacgcttccgtaagcgattatgtggaaattcttcatcgttcttcgtcgttcttcaccgttcttcatccattcttcgttcgttcttcgttcttcaacgggtaa

SEQ ID NO: 33978 - DNA, 108 bp, Glycine max
  Peptide Sequence Number=SeqID_125663
atgagactcctcgctcgtcagatggctctgcgtcgagtctgcgcgtcgcgacgtttcgagtggggtcggcgtcatctccgtcggatgagggagagcggccggatttga

SEQ ID NO: 33979 - DNA, 306 bp, Glycine max
  Peptide Sequence Number=SeqID_125664
atgccgtcccttgggacggacgtgtggggtgctgataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggtttggaaaaatgatgatttggaaacttcatgcaaaactggtcatgcatgcacctatgtggacactcaagtgtcaaacttttatggtcatgtga

SEQ ID NO: 33980 - DNA, 393 bp, Glycine max
  Peptide Sequence Number=SeqID_125665
ggtccttataatcaacaaggacagtggaggtcgcaccctggtaatcagttcaacaaagactacggtggaccttcgaacaggccaatccaacaagggcctaacatctttcaaaggactactaagctggaggaaactttgactcattttatgcagcaaataactgacaagtcatccaacagttttgtggcaaatacaaaaaggaatcccaaggaggaatgcaaagttgtgatgacaaggagtaaaaggtttgtggaggctgaggatgaggagagtggtatgcataagaagaaagctgctgaaaagaaaggtgttgagggaaagagaaaggatgttagaggtgaaagcaatcaagaaaaagagaaacaaagaatggtcaagaaaaaaagaatttaa

SEQ ID NO: 33981 - DNA, 159 bp, Glycine max
  Peptide Sequence Number=SeqID_125666
gattgtcatcatcaaaaagggggagattgtggaagcaatgccttccaagattattttcatgatgccaaagaatcaagagttaatcaagtttcaagaatcaagattcaagaacaatcaagatcaagattcaagaatcaagagaagactcaatcaagataa

SEQ ID NO: 33982 - DNA, 405 bp, Glycine max
  Peptide Sequence Number=SeqID_125667
atggaggccataaaagagcaaatggccacaatgatgaaggccatgatgagcatgaagaagataatggaagccaatgcggttatagttgccgctattagcgctgtcgctaaggtgaacccgatgctcccatctagcctcaaggaaatgaatcatccaacctcaaatatggtaggcaaagatttgggaagtacggatgaccccatgatgtgcaaattcaaaacgagcacgccttcccatcatatggcttgcctctcaactatacgccacccaaagtggcgtacactcccaataagaatgtcaataactccactcctatacccattgaaagccagcaaccccaaactgatcatgcacatgtctcttaaaccgtggaagagacccatgaagttccccatcacaatctag

SEQ ID NO: 33983 - DNA, 303 bp, Glycine max
  Peptide Sequence Number=SeqID_125668
cattttcctttcccgcagaaacctagagctgtctcggtaaaactacgatccggtttcgttaaccgttggatttttatgaaatttggatatgttgttcgaaattcaatttcgcacgttttctccgttgggatttgcgagataatatttatggagggagaaaataaatcgcatggtgacagtataagtggaggcttcaatcctttctctgtctctttgacgtttaggaattctatcgaagcagctagaggaaaaaaattggaggaatctcagagaaccgctagagatgctgctatcgctggctga

SEQ ID NO: 33984 - DNA, 540 bp, Glycine max
  Peptide Sequence Number=SeqID_125669
atggtggaaggattttctcaaggatcagttcccatcattctaggcagaccttttatgaaaactgctagaactatgatagatgtatatgcatgcacactatctatggagtttggtgatataactgttcattttaatattcttgatgctatgaaacacccatctgaagatctttctatatttcatgctaaaataattgaccatattgttgatgaatacatgactgatcttcattctaatctgcatgcttgtcactcttcatgcattgaatctgaatttgtacttgatcatatgtctgaatttgatgctgagagtaaatttgaaattgatattgattacatgtttggtgatgttttacctcttgagattgattttctagtgtcagatagaactaaccatgttgcaggaagtacatatacctctgactttctttatgaggtagagactgagaaaccatctctttctaccactatccagtcatccacagcagaattgaagcctctgccatcaaatttacaatatgcttatttggatgatagctaa

SEQ ID NO: 33985 - DNA, 520 bp, Glycine max
  Peptide Sequence Number=SeqID_125670
agggctgcacgcctacgccttcagagggttgcacgccctcaccttcagaggactacatgtcctcgccttcagaggactacacgtcctcgccttcaaaggactacacgtcctcacctttagaggactacacgtcctcgccttcagaggactacacgtcctcaccttcagagggttggacgcctacgccttcagagggttgcacaccctcaccttcagaggactacacgtcctcaccatcagagggctgcacgccctcaccttcagaggactacacgtcctcgccttcagaggactagacatcctcaccttcagaggactacacgtccttccctttagaggtctacgcgccctcactttcagtgggctccatagccacaccttaagagaatttaagttcccgggccaccctctgatcctggaggagcgaccaactgtgctagcacaaccagagagggaggctatcgcacaactactatgcataccagggcaagatttcacccgtgccactgcaaagagatga

SEQ ID NO: 33986 - DNA, 587 bp, Glycine max
  Peptide Sequence Number=SeqID_125671
tttttggccttatcttgcaggtgacgacgacgtcgagttggcggcggagaaagactcggcattcagtgatatactggaggaaggtggggatgacgtcaagtccgcatggcccttatgggctgggccacacacgtgctacaatggcaattacaatgggaagcaaggctgtaaggcggagcgaatccggaaagattgcctcagttcggattgttctctgcaactcgggaacatgaagttggaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtagccgtaggggaacctgtggctggatggaatccttcgcgatggaaaagccctcttcccccaacggggctagcttgctggaatgcgggctttgggtccaaaggacaccgggggcgagtcaaaaaaatcgttccattttcccttccggtcgagcacttcgttccttcttgttcatcaatcggaaatcaagcaagacaaaccgggcactacg

SEQ ID NO: 33987 - DNA, 76 bp, Glycine max
  Peptide Sequence Number=SeqID_125672
taaaatcaattcagtaatcgacgacacaaaacttatgcactcaagcacagcagcggctgctggtggagctgactag

SEQ ID NO: 33988 - DNA, 338 bp, Glycine max
  Peptide Sequence Number=SeqID_125673
ttaaaaagctcgtagttggaccttgggttgggtcgatcggtccgcctccggtgtgcaccggtcggctcgtcccttctgccggcgatgcgctcctgtacttaactggccgggtcgtgcctccgcaagggataacaccacaggattctgatcctattgtgttggccttcgagatcggagtaatgattaacagggacagtcgggggcattcgtatttcatagtcagaggtgaaattcttggatttatgaaagacgaacaattgcgaaagcatttgccaaggatgttttcattaatcaagaacgaaagttgggggctcgaagacgatcagataccgtcctag

SEQ ID NO: 33989 - DNA, 210 bp, Glycine max
  Peptide Sequence Number=SeqID_125674
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcagcataccttcctcaaagaatgagaattgttttggatattcgtgcccagcagatgtgtatcagtatatga

SEQ ID NO: 33990 - DNA, 739 bp, Glycine max
  Peptide Sequence Number=SeqID_125675
atgtctgaagtagctgtagtgattggcggcggccaaacgttaggcgcctttttgtcccacgggctggcgcaggccggttatcgggtggcggtagccgatctgaacgccgacaatgccaatcaggtggcacagcagatcaacgaagcgtttggcgcgggcagcgcctgcggttttcaggccgacgccaccgacgagcagagcgtgatcgcgctggcggcggcggttgaccgggcgttcggccaggccaacctgctggtgtacagcgccggcatcgctaaggcggcgccgatcaccgatttcccgctgggcgacttcgatcgctcgctgcaggtgaacctggtgggttatttcctctgcgcccgcgagttctcgcgcctgatgatccgcgacggcatcgccgggcgcatcattcagatcaactccaagtccggcaaggtcggcagcaagcacaactccggctacagtgccgccaagttcggcggcgtggggctgacgcagtcgctggcactcgatctggcggagtacggcattaccgtgcattcgctgatgctcggcaacctgctgaagtcgccgatgttccagtcgctgctgccgcagtacgcgcaaaaactgggcatcgcgccggaccaggtggagcagtactacatcgacaaggtgccgctgaagcgcggctgcgactaccaggacgtgctgaacaccctgctgttctacgccagcgacaaggcctcttactgcatct

SEQ ID NO: 33991 - DNA, 276 bp, Glycine max
  Peptide Sequence Number=SeqID_125676
atgccaatcaccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtaccccccccccggcaagcaagggcatcaggccccctactgatcgagctttcatcaagaagtactgcgtccctaggcaggcgcagggcgaaacaccacagcagcattgggatggccggtag

SEQ ID NO: 33992 - DNA, 640 bp, Glycine max
  Peptide Sequence Number=SeqID_125677
atgattatcaagcaggaaggagaaagcatcatccggtttcgcgacctgggctatgccgagctcggcgctgaaaacgagcgtactgcaatcctcaatagtttgaagggaaactctgctaccatcggtgtctttgtggagccacaacgcggcgcgaatgccgtggccatagccgatgaattctacaaacgcctgcaggaactccggaaggaaatcccgaaagaatatgaactgactattggaaaagactttacagaaccaatccgggcatctatttcagaagtggaagaaacgctgttcatcgcgtttggcctcgtgatcctgatcctgtttatctttttgcgggactggcggtccaccattatccccgtcgtcgccatccccgtttcgattatctcggcgtttttcatcatgtatttcgcggggtactcgatcaacatcctcaccctgctggcgttggtactggcgatcgggctggtcgttgacgacgccatcgtcgtcctcgaaaacatctacgccaaagtagaagaaggaatgagcccgctcgaagccgccttcaaaggttcttctgaaatttatttcgcggttatctcgacgacgattaccctggcggctgtattcctcccgattctgtttctgccgg

SEQ ID NO: 33993 - DNA, 222 bp, Glycine max
  Peptide Sequence Number=SeqID_125678
atgttcgtaaggaagaaatggccccgaggaagcttgcctcaaagaggtccaggaaggataaagcggccaaaggaaccagttccgctcccgagtatgacagccaccgctttaggagcgctgaacaccagcagcgcttcgaggccatcaaggggtggtcatttctccgggagcgacgcgtccagctcagggacgatgagtataccgatttctaggaggagatag

SEQ ID NO: 33994 - DNA, 633 bp, Glycine max
  Peptide Sequence Number=SeqID_125679
atgatgttttatttaactatgagaaaagttgcctatgttttgaacactgatattccagtggtacttgaggatgctgagaaggaagtgaaggataaaatgactatggaattggctctctggaatgaaaatgattacctatgcaagaatttcattctgaatgggttagctgatgatctctatgattattatagcctatataagtctgccaaattagtttggctggctttggaaaagaagtatgatactgaggaagctgggactaaaaagtatcagagggtatcatatcagagggatttcaaaaaccttctcagacacaagaccaaagaattctctttggagtctctgatcacacgtctgcgcattgaggaagcggcacgcagacaagatcagaaagatgaagtgttggttgtgtctcacaacaacactaaaaggaagaacacaggtgcagttctgaagcctattggcaaaaactttaagaatcagaaccgcaatgtgagcaatacctccaaccgcaacaagaacccccaagggtccaacatgctagacaacatccacctgccaagaataatcccggtgagccattcctctgctacaattatggcaaaccgggacatatggcacgtaaatgcataa

SEQ ID NO: 33995 - DNA, 750 bp, Glycine max
  Peptide Sequence Number=SeqID_125680
gcagcatgcatgatctcttgcgatggaggcgaatgtgacgaatgtctgtttcatctcggggaatcacacgacatggaaacctgccctgctgtggaagagttacttcaacggctcatggactgggggcagctcgaagtgtccaagggagataaagaagaaccacagatttgcatgcagtcggcagaaaggaagattcccccaacccccaaagccctagtaatacgtttcactaggaatgtgaccggctccaggtccaagtaccccccgacagcgcctaagccaacgccgttttcctatcaaagcaataaggtcgttccatggaagtatacccatcccgctcttggagaaagagctgtaaccaaggttgactccttgtcagccaaggagaccaacaccaccacccttagtgctgtaacccgcagtgaagctgaaaagaaagaaggtcttcaaggaaaggcggtgaccttggaagaggctcatgagttccttcgtctcatccaacaaagtgagtttaaagtagttgagcaactaaataaaactctggtaaggatcttgatgcaatcctatcccgcaagggcattgggtagaagactccaagtagattgggctagagatccaagggaaggccctagggttctcatgagccttagggaggtgagcttagctattagagagcttctcaaggaagttttctcaaagaagcttctcaaggaagttttctcaagaaagcttctcaaggaagctacctag

SEQ ID NO: 33996 - DNA, 51 bp, Glycine max
  Peptide Sequence Number=SeqID_125681
atggacacccgtctccgtgtgattggtgatcccatgaatagagttcaacgg

SEQ ID NO: 33997 - DNA, 569 bp, Glycine max
  Peptide Sequence Number=SeqID_125682
ttggcctggccaacccgggcgcggaatatgcccaaacgcgccacaacgccggcgcctggtacgtcgatctgctggcccagcgccacaatcagcagttgaaagaagagagcaagttcttcggctataccgctcgtttgaacctggcgggcaacgacgtgcgcctgctggtgccgaccaccttcatgaacctgagcggcaaagcggtgctggcgatggccaacttctaccgcatcgaaccaaacgagatcctggtggcgcacgacgagctggatctgccgcccggcgtcgccaaaatcaagctcggcggcggcaacggcggccacaacggcctgaaagacatccagaacaagttcggcaacaacccgaacttctaccgcctgcgcatcggcatcggccatccgggcgacaagaacaaggtggtgggcttcgtgctcggcaaaccgccggccagcgagcagaagatgatcgacgaagcgatcgacgagtcactgcgctgcaccgagatgctgatgaaggacgggctggaaaaaaccgttcagcgcctgcacagcttcaaggcgcaggcctga

SEQ ID NO: 33998 - DNA, 155 bp, Glycine max
  Peptide Sequence Number=SeqID_125683
catcctcttcaagcttcttatccaaggcaattcttggtggtgaagctccttcttccttggcttattccctagtggatgcctccatagaagctccacaagcaagcttccatcaagtggtaatcagagcacaagagcttcaagtaggtgctccttaa

SEQ ID NO: 33999 - DNA, 366 bp, Glycine max
  Peptide Sequence Number=SeqID_125684
atggagaaggagatgataacaatgatagtagacacattaccaatgttctactatgagaagatgctgggttacacgccttcaagctttgccgatttagtttttgccggtggtgaaaggatcgaagtgggtctaaaaagaggaaaatttgatcatcctactttgatgaataagaaacatggggcaaatggagagaataagaaggagggaggaacccatgttgtgactgccattcctacatggccaaatttcccaccagctcaacaatgccaatactcagccaagaacacccaatcatccacaaaggccacccctaaatcagccacaaagcccgcctgccgcacatccgataccaaacaccacccttaa

SEQ ID NO: 34000 - DNA, 294 bp, Glycine max
  Peptide Sequence Number=SeqID_125685
atgtacaagctcattcttcctccattttcacaagctggtcaagaggaaaggagacaacatttccactcctttttaaagcttttccaagtgttcttgagcccttcttccatcaagcttagagatgtagcagagttatggaagaggattgaagaactgagtgtcgcgctcagtatgatatcctcgcttagcacttcaggaccgctcagcccaagaagtccgcttagcgcaagatgccaacctggaggccaactgcgcgcatctagcggcttagtgtgcatgcatctggcggcttag

SEQ ID NO: 34001 - DNA, 228 bp, Glycine max
  Peptide Sequence Number=SeqID_125686
atgcccatgttggatcaattccatccatgcattcatgattctattgaaaacattgtcaatgtcaaagctgatgaacttgcaaaatggtctgatgagtatatcaacctgcttggtggtatagacagatttgaggaattaaagcggtccctacttgttgatggattatccatggttaccatgaataagtggatgaatataaccgacatgggatatgtgattgcatcatag

SEQ ID NO: 34002 - DNA, 429 bp, Glycine max
  Peptide Sequence Number=SeqID_125687
atggaaaaatccgacaagatgaatttcaaagagaagaaagaaaagaaaggatatatcacttgggaagataatgtcataaattattcaagtgattcagagaagaaaatcataagtctgggtatcatgatgaaagactatgaaaatggggaagagcaaagtcgatacattgatagcaatttctccaaacacatggcatgcatcaaacaaacgaaggccacatttctccccaagaaaagtgaatatgtgatatatggagacaacaaacaaaggccacttgatcaacaaccccaacaagtaatatcaaatgataccaacagttggaagttggaagtagttattggaagttcgaaagttaaaaatggaagttggaagttggaagtggaagttactggaagttggaagttggaaatgaaagttattggaagttga

SEQ ID NO: 34003 - DNA, 381 bp, Glycine max
  Peptide Sequence Number=SeqID_125688
atgacgcgatgcacaggacaatctgttctaaggatgacattatatcaatgcaatcgcaaatcccatgtcggttatattcatccacttatgcatgaaggaaagcttctaggtgaatcaaaggtgattcaaaggtgttttgatgataacaatgatgatgacaaaggtgatgacaaaaagatcaaagatcaatcaaagaacaactcaagtgaatcaagaacaattcaagagttcaagataagaatcaagaagaattcaagaactcaagaagaaagtcaagagacaagaatcaatattcaaggttcaagatctcaagaatcaagatcaagattcaagactcaagattcaagaataaagagaagactcaatcaagataagtattaa

SEQ ID NO: 34004 - DNA, 402 bp, Glycine max
  Peptide Sequence Number=SeqID_125689
atggagaggagtatgattgatgctgccagtagtggagctcttggtgatatgacccctgctgaggctaggaatttgattgagaagatggcttccaactcccaacaattcagtgcaagaaatgatgctattatcattagaggagtccatgaggtggtcacggattcatcttcatctactaaaaataaaaagcttgaaggaaaacttgatgccttggtcaacctagatcagaaatctgcacctgttgcaagagtctgtggttggaggaatcatccaaatctgagatggacaagtcctccacaacaacaacagcctgtccctcctttcgagaatgttgttggtccaagcaagccatatgttcctcctccaatgcagcaacagcagcagcagtcacaacaaagataa

SEQ ID NO: 34005 - DNA, 198 bp, Glycine max
  Peptide Sequence Number=SeqID_125690
atggcagggcaaagacgagtaggggcggatgaagataaagaaagagaatccgctgtctgcaagaataggctgttactgactagatcaccaccaccgcttcaccttctaccctctgatttacagaagctttctcgctaccagagagtgaaggaagttataccggctatttacctggccttcaggtgcccattggactga

SEQ ID NO: 34006 - DNA, 333 bp, Glycine max
  Peptide Sequence Number=SeqID_125691
atggttgttctgcgtcttgtatcaaccgagaggaacaagtttgacagtatcgagatgatgttccgctggcaggaacgttcactagctaaaaggtgtttcgttcgaatgaaattagcgtcttatctttacttcccttttatctccaataaaagacaagtaaagaagggcaactgtcatacccaaatttcgtcccgggaccattcgttgttgggatgcgaccctcgtttgaccacttcgaggtacttggcacccatcgttaggcaattcgtgaagttccgtgacatgtcggaagtcaagagaaagcattgtagcacaatccgtgaaattccgtga

SEQ ID NO: 34007 - DNA, 747 bp, Glycine max
  Peptide Sequence Number=SeqID_125692
ggagttatatctgcttttgtcgagaggtggcacaaggaaactagtagttttcatcttcctgtaggagagttgaccatcacgctggatgatgtggcgtcactgcttcatctttcgatcataggcaccttccatagcttcgagcctctgcatgtggacgaagcggtgctgatgttggtggagttgctagaagtctcgggcccgacattggactgttacaactcgtgcgtatctcctacacttgttagtggaagctatgcatggggagctgccgccctggtgcatatgtatgatcatttgaatgatgcttgtaagagcggcggtcgacagcttgctggttacatcactttattacagtgttggatatatgatcattttcccagtgttcatgagagtgtgactgatccagagtatgatgagacgtcaccacgtgcttacggtggcttactacgaaggcttattcgaagggattcccagcatcaacgtactggacacggtgagcttagatggggtcccattgtggtcacacatcgaccagagagggtggtgcgacaatttggatacgttcagaccattcctccactacctacgggtgccagcttgtcatttgaagatattgacaacaggtggatgcattactccgaccatctagcagcagggggacagatttgtcttgtgcctggccagtgtgcaccagattacacgaactgtttcttcaggatctctcatccgttcatcacacccacatag

SEQ ID NO: 34008 - DNA, 177 bp, Glycine max
  Peptide Sequence Number=SeqID_125693
atggcctttgctcaaacctacctgattagaaagataaggcgcctttacttagctgttagcctcccaaaagaaggatctccggtttcaaaagccctagatatagatgtccgggggatcatagatctctcttttcaaacaaacaaagttggcaaagtgagaacgctggttccgcaataa

SEQ ID NO: 34009 - DNA, 198 bp, Glycine max
  Peptide Sequence Number=SeqID_125694
atggcggtggtgggaacaacaggtagctacggtgggcacgacggagaattttcgaagacaggagatgaagtgttgaatcaatatggaaacacgagtatatatagtacgaaatttacgacggtgtataagcaacaccgtctttgtatacttttatttctacgacggtgtcttccaaaagcaccgtcttcgataagttga

SEQ ID NO: 34010 - DNA, 363 bp, Glycine max
  Peptide Sequence Number=SeqID_125695
atgacagatcttgtgagcgcggaagatgacgtaaatctctgcgtgtcaacgggtttgtcggccgcgattgacgaacggcgcagaagacgatgtcagtcttcgcatgctatcaggcatttcgtcttacagacagcaaaaaagaatgtttatacggataaccactcgggtatctccgcccgtcagcgtgactcaaaaacagcaaaaaagaatgtttatacggataaccactcgggtatctccgcccgtcagcgtgactcaaaagtcagtatgatagatcctgtgagcgcggacgttgacgtaaatatccgcgtgtcaacgggcttgtcggccgcgattgacgaagggcgcagaagacgacgttag

SEQ ID NO: 34011 - DNA, 258 bp, Glycine max
  Peptide Sequence Number=SeqID_125696
atgacggtgaatacctctgacacatgcagctcccggagacggtcacagcttgtctgtaagcggatgccgggagcagacaagcccatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34012 - DNA, 480 bp, Glycine max
  Peptide Sequence Number=SeqID_125697
atggcgcctaccaggcaccctctggacccagataagtccaacagggccctgggatttcccgccttgatcacaggactctgccagtcgttcgacgtccccatcacacctagcaaggtgattcggccgcccatcacccgagcttttattgagaagtactgcacgcagagacaggttccggagcagtatttgcggcatttggttcgccagcaggcggccaaccaccgggcacatgtacagactcctgattgtctttatcagatgagtctcagcctacagagccagggctttacttcttttccgtgccctactctggaccagttcagggcagaggtcgcatggcctggagattggcctgaggcccaggcaggagaggcaccagcaggggcaccagcagaggcccccgacgaggcagatgaggcccgcgaggatgaagagatgaccgatttacttgatttcttaggagggagcagtgccacatga

SEQ ID NO: 34013 - DNA, 399 bp, Glycine max
  misc_feature (8)..(8): n is a, c, g, or t
  misc_feature (41)..(41): n is a, c, g, or t
  Peptide Sequence Number=SeqID_125698
gttatagnttgtaccatctgtggtgaggctcataaaatagnccaatgcttccagcagggtccctataatcaacaaggacagtggaggacacaccctagcaaccagttcaacaaagaccagagtgagccttcaaacaagccaatccaacaaggacctaacatattccagaggactactaagctagaggagaccttgactcagtttatgcagaatcccaaggaggaatgcaaagctgtgatgacaaggagtaaaaggtttgtggaggctgaggatgaggatagtgttgtgcatatgaagaaaactgctaacaagaaaggtactgatgacaagaaaaatgaggaaacaggaaataaccatgccctttggagaagctttgcagcagatgccactctactctaa

SEQ ID NO: 34014 - DNA, 1165 bp, Glycine max
  Peptide Sequence Number=SeqID_125699
ggatacacgccctcatttttagaggactacacgtcctcaccttcagggggctacacgccctcaccttaaagaggccacacgtcctcgccatcaggggccacacgtcctcgccatcagaggcttgcacgccctcccttcagaggactacacgtcctcgccttcagaggaatgacgacgtcctgaccttaagagggctacacgccctcatttttagaggactacacctcctcccctatagaaggctacacgcctcgccttcagaggaatggacgctcatcagaggactatatgtccacgacttcagaggactacacgtccacaccttcagaggactacacgtcctccccttcagaggactacacgtccacaccttcagaggactacacgtcctccccttcagaggactacacgtcctccccttcagaggactggacgtccagaccttaagagggctacatgccctcaccttaagaggactacacgtcctcgccatcaggggaccacacgtcctcgccatcagaggcttccacaccctcgccttcagaggactacacgtcctccgcttcagaggactacacgtcctcgccttcaaaggactggacaggactgacgtcctgaccttcagaaggctacacgccctcaccttcagaggactatacgtcctctctttaagaggaccacacgtcctcgccatcagagggctacacgccctcactttcagaggactatacgtcctccctttcagagggctacacgccctcgcctttagaaggctactcgccctcatttttagaggagaacacgtcgtcagcttcagagggctacacgtcctcgccatcagagggctgcatgccctcaccattagaggactacacatcctcgccatcagaggactacacatcctcaccatcagaggcctacacgtccttgccttcagaggactacacgtcctcgccttcagaggactacaagtcttcgcctttagaggactacacgtcctcaccattagaatgctacacgccctcgccttcagaggactatacgtcctcgccttcagatggctgtacgccttcacctttagaggactagacatcctccccctcagagggctatgtgtcctcatattcagaggaccacatgttctcgccatcagggggctgctgat

SEQ ID NO: 34015 - DNA, 333 bp, Glycine max
  Peptide Sequence Number=SeqID_125700
atggtccatgacatctctgtcaaggcgaaactggaagtgacagggacatcgacagccctaaatgtgtttggcagtagacgaagcaatgatgtaacacgatccatcttttgccccaatttttgcaagatggttactttcatgcttcaacttgactcgatgaacctttacgtaaaagcacgagcttggttcaaccccataacccagggaatggcaattttgatcgccgatacttcaacaacatttcatagggatgaaagactcgggaatacgcatgctatgcatggaaaatgtaattatgagattgagatgcccaaagaaacatccctttcttag

SEQ ID NO: 34016 - DNA, 309 bp, Glycine max
  Peptide Sequence Number=SeqID_125701
atggactcgggaaggttccaagttagtgtaccagtcccattgtacttgtcaaagtccagcaccttgaacttgggaggggtgatgatattgggttctaggaacaactttttgggtgtagttgggggtgatactgagggccttccgaagtgttttcaaggggtataccaccaactgcttgcccttcagtggcatatccgagccaaggctcgaagtcggctagattgtgatggggaatttcatatgtctcccccacggtttaagagacatgtgcatgatcagcttggggttgctggctctcaatgggtatag

SEQ ID NO: 34017 - DNA, 525 bp, Glycine max
  Peptide Sequence Number=SeqID_125702
atgtccatccgttctacaagccttgagccaaagtcccaactcaccataaaccttgccctcaaaagaaaacaaagcaaaaggagaaaattcccaatcaaagaggttaccttatggttacccacacctttcgtcaaccagggggcaaacgagcccgttgacacacggagactaacattgtctcctacaccttttatcgtcctgacccgtgaagtcagggttaccttatggttacccgcacctttcatcaaccagggggcaaacgagcccgttgacgcgaagagaccgacatcgtcttctgcaccttttgtcatccagggacagcgagtcaggtggtttttactctcgtcgtccggaaacattcaagcccaacgacgcgcgggattcttctctgctaggcagagacgatcgggtacaatggtgaaggaagtgtcgtggttgtccaactttgtcgatgccttctggtggaagcaacccagctcgcttgggcgagctgggcggcaaccacctccctcttttcccctataa

SEQ ID NO: 34018 - DNA, 354 bp, Glycine max
  Peptide Sequence Number=SeqID_125703
atgaatttcaaagagaagaaagaaaagaaaggatatatcacttgggaagataatgtcataaattattcaagtgattcagagaagaaaatcataagtttgggtgtcatgatgaaagactatgaaaatggagaagaacaaagtcgatacattgatagcaatttctccaaacacatggcatgcatcaaattggaagttgaaagttataaatggaagttggaagttggaagtagttattggaagttgaaagttataaatgaaagttggaagttggaagtggaagttactggaagttggaagttggaaatgaaagttactggaagttggaagttggaaatgaaagttactggaagttaa

SEQ ID NO: 34019 - DNA, 438 bp, Glycine max
  Peptide Sequence Number=SeqID_125704
atggtggaactacttcggaccaattccacaaatatttcccagaagaaatacggaaaaactgaaaacagcaagcaatatccaccgttacagagacacgcctttgtaaaatggtggtcacaattcgatacttcaaaggctgctccagatcaagtcaagaactggttccagagcaatcctgagttccttaaacctgctgatccggagacatctttgtttctaaatcaaaagtcgcaactagcagcattcttagcaagctcaaaatctaaagagagtcttgctcagaatctcaaagaagttctccaactacttcaacaggaagtggaagaagaaccttccaagaaggaagctgaatcatccgagactaatgatgaccaagaagatgattcattctaccagaatgaagatgactgttttggtatatcattggacgacgattaa

SEQ ID NO: 34020 - DNA, 970 bp, Glycine max
  Peptide Sequence Number=SeqID_125705
ggcaatcaattggtttcctcggtggaaggaaggcaaggagggagttcttttctcgtgtggggactaccctaatgttccattgatagggacgaggggttgtattaactataatcccgcacttgccataagacagctggggtaccccatgaggggagcaccaacaaaagaaagtctctcgcctttccttgtgagggatgtaggggcgcaaagtctcaaggtgatacaaagagtccacaaggcggggagaagtccgttaagaaaagacaaggagcttagaggcatccgaaatggcgtcatcggtggttatcatggatggctaagagttcacacgcgagggttagattggctctccaagttgaaagttatcgacgaggagaacttcgaagctccggaggaagatgaagaagtccgagctctaaaattagagctagggaaggcaagactcgccaaggagaagttcaaatcagccgctacacacatccggaaagagagcaccgagttacaagaggaaaacgcggccactgcaagagcccttgaacaagaaaccaaaagggtccgcaaggaggaacatggccgagagaaattccgaggagcattgtggggtagcaacaatgagctcaagctccgaagagagaaagagaccggtcacgggtccaagaggagtttggcccaacacttggaagccacggagcaaagcatgctagctatcatagggaagtacaaggaagagttgaaccagtctgtgacccatgaacaaaagctagcggaggattttgcacaagtgtacgccgaaaaagaagcaagagggagggtgattgatgtattgcatcaagaagcgactatgtggatggataggttcgccttgaccttgaatggaagtcaagacctcccgcgtctattagccaaagcaaaagccatggccgaaaaaccgttaggttctcttgtaacacctttgtataatcttggctag

SEQ ID NO: 34021 - DNA, 180 bp, Glycine max
  Peptide Sequence Number=SeqID_125706
atggcctcctatggtgtggtgtctcctctctctcttccttctccattcctctgtcattcatcttccaagaagcaaaggaatccattgatgaagaagatcctaggcctacaagctccaatggagcttacatcacctcagatgcaagggttgatcgctaagcgcttgagactcacggcttag

SEQ ID NO: 34022 - DNA, 249 bp, Glycine max
  Peptide Sequence Number=SeqID_125707
atggaacgccaatacttttgcaggccaaccgaagaacaaacagtgatgttaaaaattcaccatggtgggatgttcatttatcagccctttactctgtatatcaatggtcagatcgaagaagaagaatggggttgggatgtggatactatgtcttatattgacttcaagaagaagattaacttcctcgggtacaaatcattcatgtgcttatggtataaggaccccagaaaagcactgagcagagggtga

SEQ ID NO: 34023 - DNA, 123 bp, Glycine max
  Peptide Sequence Number=SeqID_125708
atgacgcattgtaatcgattacaagtattggtaatcgattacaggcccaataagccttctggctgcctattcatgtgtaatcgattacactggatggtaatcgattaccagagcctatcctag

SEQ ID NO: 34024 - DNA, 406 bp, Glycine max
  misc_feature (4)..(4): n is a, c, g, or t
  Peptide Sequence Number=SeqID_125709
gaancggaagagcgcccaatacgcaaaccgcctctccccgcgcgttggccgattcagtaatgcagctggcacgacaggtttcccgactggaaagcgggcagtgagcgcaacgcaattaatctatgaccatgattacgaattcgagctcggtacccttcattctgctctcctcgcgcacagtggaacgagttctcaagtttaccaatacttatgtggcagcaaggtctacacgttattgttttcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34025 - DNA, 297 bp, Glycine max
  Peptide Sequence Number=SeqID_125710
atgaaactggccaaatacagtctaaaggcccaagtggagaaggacgaaggcccaagtggagaaggacaaagcccccaagtggagaagggtaatccttgtggcgtctaccctgacttatcttccttcattggaagtggcgtctacccagacttatcttccttcaccggaagtggcgtctaccctgacttatcttccttcatgggaagtggcgtcatccaaatcttcgtagcctgtatcaaacgatccgctcctactcaggttcacatcagtgagtgttttgttgagaaccttaaatga

SEQ ID NO: 34026 - DNA, 1005 bp, Glycine max
  Peptide Sequence Number=SeqID_125711
atggaatcgttcgatctttatatagacggtgtgtttgagcgcggcgcagcgcgcttttcatcactcaacccagcaactgcccaaccgtgggcggagattgccgaagcgcgggaagaagaggttgatcgcgcggtagctgccgcgaaacgggcattttacgatccggcctggcgtgggttaaccgccagcgctcggggtaaactgctgatgaaactggctgatctggttgagcaaaacgccgatgagctggcgcgacttgaaacgctggacagcggaaaaatcattcgcgaaacgcgatcgcagattgcctacgtggctgaatattaccgctattatgcgggtctcgctgacaagctggaaggccgcacgctggcgattgataaggcggatactgaaacctggacgcggcgtgaagcagtgggcgtcgtcgccgcgattattccgtggaacagccagctctttttatcggcggtgaagatcggtccggcgctggcggcaggttgtactatcgtggtgaaagcggcggagagcgctcctacgccgctgctagcctttgcccgactgattgccgatgcgggattcccggcgggcgtctgcaacgtgatcactggctttgccgggacgtgcgggacgcggttaacaacccacccggacgtggaccatatcgcctttaccggcggccccgagaccgctcgccacattgtacgcaacagtgcggaaaaccttagcaaaaccacccttgagctgggcggtaagtcgccctttatcgtctttgaggatgcggatttggacagcgccgccaatgcgcaggttgcggcgatatttgccgcctccgggcagagctgcgtcgccggttcgcgcctgctggtggctgaaagcgtaaaagagcaactgctggagaaattagtcgagcgggttaaacgaattgtcatcggcagcccggacgacgcggcgacgcaattcggcccactgtgtaccgagcgccagagagctcatcgagcagtg

SEQ ID NO: 34027 - DNA, 519 bp, Glycine max
  Peptide Sequence Number=SeqID_125712
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagccccgaccgctgcgccttatccggtaactatcgtcttgagttcaacccg

SEQ ID NO: 34028 - DNA, 321 bp, Glycine max
  Peptide Sequence Number=SeqID_125713
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaagtcacgacgttgtaaacgacggccagtgccaagcttgcatgcatgcaggtcgactctag

SEQ ID NO: 34029 - DNA, 746 bp, Glycine max
  Peptide Sequence Number=SeqID_125714
atggccccgaggaaacttgcctcaaagagatccaggaaggataaagcggctgaaggaaccagttccgctcccgaatatgacagccaccgctttaggagcgctgaacaccagcagcgcttcgaggccatcaagggatggtcatttctccgggagcgacgcgtccagatcagggacgacgagtacaccaatttccaggaggagatagtttgccggcggtgggcatcgctggtcacccccatggccaagtttgatccagacatagtcctcgaattttatgccaatgcttggcctacagaggagggcgtgcgtgatatgaggtcctgggtgaggggtcagtggatcccgtttgatgcagatgcgatcagccaactcctgggatatcctttagtgctggaagagggccaggagtgcgagtatggccagaggaggaaccggtccgatgggttcgatgaggaggccatcgcccagttgctatgtataccggggcaggattttgcccggactgctgccgggagatgggtgcggatcatgcgcaccaacatgaccaccctgactcagatatggatgactttgctgctcagcaacatcctgcccagtgatcataattccgacctccccctgccgaagtgtcagctggtgtacgccatcctgacacggatgagcattcacgtggctcagctaattgctgatgccatctacacattcgaagctctggcgcctaccaggcaccctctggacccggataa

SEQ ID NO: 34030 - DNA, 523 bp, Glycine max
  Peptide Sequence Number=SeqID_125715
aggactacacgtcctcgccttgagaggactacatgtcctcgccatcagaggacttcatgtccttgccatcagagggctgcacgccctcacctccagaggactacatgtcctcgccttgagagggctacacgccctcaccttgggtactagttaccctcaccgtcagagggctgcacgccctcacctccagaggactacacgtcctcgccttgagaggactacacgtcctcaccatcagagggctgcacgcccttacctccagaggactacatgtcctcgccttgagagggctacacgccctcaccttggaggactacacgtcctcgccttcaaagggtcatgtaccttcaactttagaggactacacgtcctcgccgtcaaagggtcatgtgcccttcacctttgtagggcatgccctcaccttcagaggattgcacgtccttgccatcataggactacactccctcgccttcgaaaggcgacacgtcctgaacttcagagggctacacgccctcgcctttag

SEQ ID NO: 34031 - DNA, 618 bp, Glycine max
  Peptide Sequence Number=SeqID_125716
atgcacggcggaccattgcatttgcccgttgagcgccacccaggcgatggaggccaccagcgtggcgatgaccgcatagcgcggtgccaggcggcgcgacagcagataggtcagcagcatgaccagcaccaggggcagcgcatccctggcggcggcaaaggcctgcatgccgaagttggccagtacgcccgccaggagggcggcagcgatttccatggggatgcggttcatgacgcgctcgaaccagcctgtggctcccaccaggatgatcagccccgcgctgatgatgaaggcgccaatggcctcgcccatggaaaagcccccggcaagccctgccgtggcaaggacggctgcgcctggcgtggaccaggcgaccatgaccggcatgcgcagtatcagcgagggcagcagagagcacaggcccatgcccagtcccagcgcccagatccaggacgtgatctgctcgggcgtggcatggaaggcctgggcggcctgaaagaccagggccaccgagctggtgaagcccacgagcacggccacgaagccggctgcgaaggcagagggactcaagtcacggaaaaagcgcatcgcgcgattctgtcaccacagccgccgacc

SEQ ID NO: 34032 - DNA, 821 bp, Glycine max
  Peptide Sequence Number=SeqID_125717
tccataaggcgtgggaaagcccgttaaggaaagataaagaacttaggggcattcgtaatggcatcatcggtggttatcatgaatggctgaaagttcgtacacgagggttagattggctctccaagttaaagattatcgacgaagaaagcttcgaagctccggaagagggtgaagaagcccgagctctaaaaacagaactaggaaaagcaagacttgacaaagaaaaattcaagttggtcgctacagacgtccggaaagagtgtgccggttacgagaagaaaatgcagctaccgcaagagcccttgaacaagaaaccaagagggctcgcaaggaagagcatggccgtgacaaattttgtggagctttatggggcagcaacagtgagctcaagcttcgaagggaagagagataccaatcacgtagcacatagcatggtcttgaaagaggagttagctacttgctcaaggtccaaaagaagcttgtctcagcgtttatgtgagacagagaccaacatgttagccatcgtcagcaagtaccaagaagagctaaatctagccacggcccacgagcataaagtggcggacgattatgcccgagtgtacgcagaaaaggaggctagaggaaggggtgatcgactcgttacatcaagaggcaacaatgtggatggaccgatttgctcttactttgaatgggagtcaagaacttccccgattgctagccaaggccaaagcgatggcggacacctactccgcccccgaggagatccacggtcttatcagctattgtcagcatatgatagatttaatggcccatataattag

SEQ ID NO: 34033 - DNA, 174 bp, Glycine max
  Peptide Sequence Number=SeqID_125718
atgtggatggaccgatttgctcttactttgaatgggagtcaagaacttccccgattgctagccaaggccaaagcaatggcaaacacctactccgccctcgaggagatccacagacttctaagctattgtcagcatatgatagacttaatggcccatgaaaaacgccataactaa

SEQ ID NO: 34034 - DNA, 174 bp, Glycine max
  Peptide Sequence Number=SeqID_125719
atgaggccccatttcttggtcctcatgggcgactatcttctccaactatgggggaagtcccacatcttcgttctcttcatcctccgtctgatccgttccttactcgaaatcgatggtcgggtcccaggtattactaccttcgagggactcgtcgtcggatctggcgttttaaat

SEQ ID NO: 34035 - DNA, 111 bp, Glycine max
  Peptide Sequence Number=SeqID_125720
atggaaggaggtcaagaggttctgaaggtccatgacgctaagcgccagtcatggcagctaagcgagattcattgtggcaatgtgagcgctaagcgagtacatctcagctaa

SEQ ID NO: 34036 - DNA, 305 bp, Glycine max
  Peptide Sequence Number=SeqID_125721
gggcaagcgagcccgttgatgcgaagagactgacatcatcttttgcaccttttgccatccagggacagcgagtcaggtggcaggcgaagataccttatggtcatccgtttttactctcgtcatccggaaacattcaggcccaacgacgcgcgagattcttctctgctgggcagggacgatcgagtccgatggcgaagggaagtgtcgtggatgttccaaagaaggcaatgccttctggtggaagcaacccagcttgcttggccgagctgagcggcaaccacctccctcttttctcctataaatag

SEQ ID NO: 34037 - DNA, 213 bp, Glycine max
  Peptide Sequence Number=SeqID_125722
atgtgggccatcatcgaccagtacaaggaaaagctaagcctagcagtggctcatgagcaaaggctagaggaagagtacgccaaggttcgcctttactttgaatgggagtcaagagcttcctcgactgctagccaaggccaagccaatggtggatgtgtactcggctcccgaggaggttcacgggctcctcaattattgccaacacacgattga

SEQ ID NO: 34038 - DNA, 657 bp, Glycine max
  Peptide Sequence Number=SeqID_125723
atggataagaagatccgcagtattgtgagtagcattctgaaagatgcttctgtgcctgatgctgagaaagatgtcccaacatcgtccaacacaaatgtttctgtgcctgatgtcaagaaagatgttccaacatcttccggtccaaatgctgaagtactctcttcccccagcaaagagagatcaacagaggaagatgatcaagcgacaaaggagacccctgcaccaagggcaccagaacctgctccaggtgacctcattgacctggaagaagtagaatctgacgaggaacccattgccaacagattggcaccaggcgttgcagaacgattacaaagccgaaaagggaaaactcccatcaagaggtctggacgaatcaaaacaatggcacagaagaagagtactccaatcacccctgccacatccagaagaagcaaggttgctatcccctccaagaaaaggaaagaaatttcctcatccgattctgatgaggatgtcgaactagatgtctcgacatctaagagggccagaaatctggaagaaagacttgcggttgaaagagaactgggaagaactgccttggattgcaaaggagatcatggacctcatcaaggctgctggactactgaagacagtcaccaagttgggagactgttatga

SEQ ID NO: 34039 - DNA, 264 bp, Glycine max
  Peptide Sequence Number=SeqID_125724
atgaagtcaggtggcaggcagagatacccgagtggttatccgtacaaaaattttccgttaatcctgacccgtgaagtcaggcgacaggcggagatacccaagtggtggagatacccaagtggttatctgtacaaacgatttattttaatcctgacccgtgaagtcaggtggcaggcgaagatacccgagtggttatccgtacaaagacgacttctgttaatcctgacccgtgaagtcaggaggcaggcagagatacccgagtag

SEQ ID NO: 34040 - DNA, 195 bp, Glycine max
  Peptide Sequence Number=SeqID_125725
atggagaaaaaaatgaaaaaacaacaatggaagagaagcggaagacaaaggagaagaggtgagaggaggcgccatccactagggaataagccatggaagaaggagcttcaccaccaagatgagccttggataagaagcttagaaggatgcttcaatggaggaaaagaaagagagaaggggggagcacgaaattga

SEQ ID NO: 34041 - DNA, 612 bp, Glycine max
  Peptide Sequence Number=SeqID_125726
atgatagatgctgccagtggtggagcccttggagacatgactcctgctgaagccagaaatttaattgagaagatggcttccaactcccagcagtttagcgccagaaatgatgctatagtcattagaggagtgcgtgaggtagctacaaactcagttgcatcatctgaaactaagaagcttgaaggcaaactggatgcattggttaacttggtaacccagttggctttgaaccagaaatttgtacctgttgcaagggtctatggtttgtgctcctctgctgaccaccatacagaccttagcccttccatgcagcaacctggagcaattgagcagcccgaagcttatgctgctaatatttacaatagacctcctcaacctcacaacagatacaaccctggatggaggaatcaccctaatctcagatggtctagccctcagcaacaacaacagcagcctgctccttccttccaaaatgttgctggcccaagcagaccatacattcctccactaatccaacaacagcaacagccccagaaacagccaacagttgaggctcctccacaaccttccctcgaagaacttgtgaggcaaatgactatgcagaacatgtag

SEQ ID NO: 34042 - DNA, 390 bp, Glycine max
  Peptide Sequence Number=SeqID_125727
atgggttctccacctgcctccactcctcctcctcctcctcctcctccttcttctccttctcctcctcgtcctactcatatttcggacgcttcggcttcgacgtctgccgtgaagcgaacacacaaagcctcacgtctacgatcgttgtccactagaccacctggtgttgagagaccagtggtgcatgttgatcctactaccgggaaggccgacggtccccacaggaagaaattaagaacatatttggggattgtggcacatgataaggtggacatcacctacgagaactggaaggaggtccctactactcaaaaggacctgatttgggaggatattcaggacgaaaaggaagttactacaggccgtgggggagagatggaggcagtttaa

SEQ ID NO: 34043 - DNA, 698 bp, Glycine max
  Peptide Sequence Number=SeqID_125728
ttatcgatgaggagaactttgaagctccggaggaagatgaagaagtccgagctctaaagttagagctagggaaggcgagactcgccaaggagaagttcaaatcagctgctacacacatccggaaggagtgcactgagttacaagaggaaaacgcgaccactgcaagagctcttgaacaagaaaccaaaagggcccgcaaggaggaacatggccgagagaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagctacggagcaaagcatgctagccatcatagggcaatacaaggaagaattgaatcaatccatggcccatgaacaaaagttaatcgaggattttgcacaagtgtatgccaaaaaagaagcaagagggagggtgattgatgcgctgcatcaagaagcgactatgtggatagataggttcgccttgaccttgaatggaagtcaagacctcccgcgtctcttagccaaagcaaaagccatggccgaagtgtgtactgcccccgaggagattcatgggctaatcaattactgtcagcacatgatagatttgatggcccatataattaggaatcgttag

SEQ ID NO: 34044 - DNA, 684 bp, Glycine max
  Peptide Sequence Number=SeqID_125729
atggactccggcgtggcgacgcgcccgatcgaagacttcgacgcttacgtcgagaagctggcggagttcgtctacaaaaccaacctgttcatgaaaccgatcttctcgcaggcgcgcaaagaggtgaagcgggtggtgctggcggaaggcgaggaagagcgcgtgctgcacgccacgcaggaactggtgtcgcaggggctggccttcccgatcctggtcggccgcccgagcgtgatcgagatgcgcctgaaaaagctgggtctgcagctgacgccgggcaaggatttcgaagtggtaaacaacgaatcggatccgcgctttaacgaatactggggcgagtattatcagatcatgaaacgccgcggcgtctcgcaagagcaggcgcgccgcgcagtgatcggcaacccgacgctgatcgccgccatcatgctgcaccgcggcgaagcggacgcgatgatctgcggcaccatcggcagctaccacgagcattacgacgtggtgaagaacgtgttcggcttccgtgaaggcgcgcacgtcgccggtgcgatgaatgcgctgctgctgccgagcggcaacacctttatcgccgacacctacgtcaacgacgatccgacgccggagcagctggcggagatcaccctgatggcggcggaaaccgtgcgccgcttcggcattgagccgaag

SEQ ID NO: 34045 - DNA, 231 bp, Glycine max
  Peptide Sequence Number=SeqID_125730
atggatttgttatttgacatgcttttattatcaatgtttgaacattacaacaaggatttcactattgttgcttctacatatgataatctgaattcggttccagttcttaatggtgcaaattttaaggactggaaagagaacatgcaaattgttcttggctgcatggatctagaccttgcatcaaggattgagaaacccttttctcctacagattctagtacctctgaatag

SEQ ID NO: 34046 - DNA, 294 bp, Glycine max
  Peptide Sequence Number=SeqID_125731
atgtaccctctcttgttctcagtcagaaacccaagtagatgtaccctcttcttgtaccacaatggatgtaccctccaatgtgttaagacaaagatctcaggcgggagaagagagagacaaaaagaattcaagcggttagtccttggtgaattctttttggcaaagggagaagggaatgaaaagatgatagtacacgtttcaaggttagaaaaccagaaaccttttagaaagcttttggtacaagagattagaagttcaacgaagatcaagcttataaggattgtaagagattga

SEQ ID NO: 34047 - DNA, 792 bp, Glycine max
  misc_feature (503)..(503): n is a, c, g, or t
  Peptide Sequence Number=SeqID_125732
ccatttttgcgcacaccggttattaccgcccgtgatgaggcgcatctggcgcagtttcgcgagctttttgcgcagattattgaggcggggcaggcaggaggccgttatgccgaactgctggcgattaacctgcttgaacaactgctgctgcgacggatggaggcgattaacgcgtcgctgaatccgccgctggataaccgcgtacgcgatgcctgccagtacatcagtgaccatctggccgatagccagtttgatatcgccagcgttgcccagcatgtctgtctctcaccgtcgcggctgtcgcatctgtttcgtcagcagcttggcgtcagcgtgctgagctggcgtgaggatcagcggataagccaggcgaagcttctgctcagcaccacccggatgccgatcgccaccgtggggcgcaacgtaggctttgaagatcagctctatttttctcgtgtctttaaaaagtgcaccggcgccagcccgagcgaattccgcgcggngttaatcgctgattcgttttctgaccggaatagttatgcaggcattgctggaacactttattacccagtccgttatgtattcgctcatcgccgtggcgctggtggcctttctggaatcgctggcgctcgtggggttaatcctgcccggcaccgtgatgatggcagggcttggcgcgctgattggcagcggcgtggctggccgggatcgtcggctgtctgctgggcgactggatctctttctggctgggctggcgctttaagaagccgctgcaccgctggtcgttcatga

SEQ ID NO: 34048 - DNA, 378 bp, Glycine max
  Peptide Sequence Number=SeqID_125733
atggcagcgcaattaatccatgaccgagtggagatggagtgcctagagggagtttgggagaccctcgaaggcaatgcgagaggaacccgcacgcacgcttcagcgaactgtggagtggatattacctacacctactccatatcgactagtagagcccgtcaagtgatagaggtgtcgtcatctgaagaagaccctgaggaggacccagaggagttacctcctgagcctgctgtggatgctcttgactttccagagggtgatgaggacccacttcctgatgtggattctccagaggacgtcatgtcagcatctgaggcagactctacggaggagagcggcgctggagggatagcgactagtggagactcttcatcatag

SEQ ID NO: 34049 - DNA, 234 bp, Glycine max
  Peptide Sequence Number=SeqID_125734
atgggtgttaagtacctcgaagtggttaagcaaaggttgcaggctatcaaacaatggtccccggacgaaataaggaaattagacttcaaagttcagaccttattctcccgcttctctctctcaaaatttcgttcccatctttccctttccctccactcatcttctcctaccttcaagctattgcccatggctttctatggtggtaagcttgttcttgactcatcttctacttga

SEQ ID NO: 34050 - DNA, 279 bp, Glycine max
  Peptide Sequence Number=SeqID_125735
atgccgatctccccctgtggaagtatcagttgggatcacatccacaagacacccagagaagtccaacaaggccttggggtttccagctctggttacgggcctctgttagtcctacagggtgcccgttccccccagcaagggatcgcgcctgcaagacacctagtggacccggagaagtccaacagggtcttggggtttctagctctgattacggaccttttccagttctacggagtgcctgtcgcccccagtaaggtcatcaggccccctactaattga

SEQ ID NO: 34051 - DNA, 738 bp, Glycine max
  Peptide Sequence Number=SeqID_125736
atggggacgaggggttgcatcagctacaatctcgttcttgctacaagacaacttggctacccgatgagaggggcaccactagaggaagagctcgcacctgtcatttcacgaggtttcaataagaccaacatggagacacttcagaaggtctgcaaggcatgggaggtggtacaaaagaaggacaaagagctcagaggcagtaacaatgggcccattggaggtgccctcccaagtctgagaaccgctaaaagggaggaagttgaggcagcggaggaagacgaagaggtgcaggctcttaggacagaactcgagcaagctcaaacagtcaaagaaaggttcaaatcagtggctcttaggatccgaaaagagaaggtcgaactgagggatgtaaatgtagctaccaccaaggccttggaacaagagaccaagagggctcgtagggaagagcacggccggaacaagttccgaggggctctatggggtagtaacaatgagcttaaactccggagggaggaaagggaccaatcgcgggtagacagtttgatcttgaaggatgagttgaaggcttgctcgaggtccaagagaagtttgtctcagcgtttatgcgagacggagaccaacatgttagccatcatcagcaagtaccaagaggaactaagtctagccacggcccacgagcatagggtggcagacgagtatgcccaagtgtaccggaaaaggaggctagaggaagggtga

SEQ ID NO: 34052 - DNA, 729 bp, Glycine max
  Peptide Sequence Number=SeqID_125737
gtcgccagcctgcagctggtattgcctgagcaactgttcgatacgccgggccaggtgtgggtggcgcagctgcgcgccggcgaggttgatcgacagcgggccgaagggttcgtagtgctgcttccaggcctgtatctggcggcaggcctgctccagtacccagtcgccaagctgcagaatggtgccgttttcttccgccaggtggatgaaatgttccggcggcacttcaccaaaggtcgggtggctccagcggatcaatgcttcggcacccaccaggctctgggtcctgaggctgagcttgggctggaagcacaggctcatttcgttgcgctcgatggcgcggcgcagctcgtgctccagggcaatgcgttcactggcttgggcagtgaggtcgagggtataggcttcgacacggttgcggcctttggccttggaacggtacatcgccgcgtcggcgttgcgaatcaatgtggaaacgtcggtgccgtcctgtggataaaggctgatgccgatgctggcgctggtgaagaactcatgctcgccggcctggaacggcgcgttgaagcaggccagcagcttgttggcgatggtgctggcgtcgctgggtttgtgcaggcccggcagcaggatgatgaattcgtcaccgcccaggcgggccacggtgtcgacgtcgcgtacctgctccttcaggcgttgggcgatgcccttgagcagcaggtcgccgaccgg

SEQ ID NO: 34053 - DNA, 135 bp, Glycine max
  Peptide Sequence Number=SeqID_125738
atgcagttatccgcatgctcgatgagtgataaacgcgcagagacaaattttgtgccctttatcattcaggagcagcgagccgagtggttccgctggcagggagttcactggccaaatggtgtttcgctcgaatga

SEQ ID NO: 34054 - DNA, 341 bp, Glycine max
  Peptide Sequence Number=SeqID_125739
atggcaccagctaatgtagaggacactggggcagacattcctgcagacacaggcgcgcaggctgctcaggatgagcatgagggatttccgggtggtccgagcaacccatccgtgctgacccagtatgcggatcacgttgcttgcagtgtatggacgggagaggagtgtcctgagttcaagttatcctctcatgggaggaaggtccatagtttaggcaggcctgtccctgccattgagggactagttgttgggacaggactaagtcctctgatcgcgtgttcgatagacactggcgatcggggacttttgtcctcatttgttaagcggtggcatcgagagac

SEQ ID NO: 34055 - DNA, 521 bp, Glycine max
  misc_feature (382)..(382): n is a, c, g, or t
  Peptide Sequence Number=SeqID_125740
gccaaggataggagggctttcagggactgggacgggtggattatagagctaggggcggatcagaggtccaggattcgagtcaaatcgaccttccctctcatctcaggtgaggcaagggcagagcctcaccttgctgtaggaaggtcttcgttgctgggacgggttcaaactggactgaagggaggaggaatgaaagactccgatcttactggggattcatcactggctagggcgaatcaaagcatgggcatctgcaagagtaggacattccataaaaatctttctgatccgctagccgtcactccttgccctattcggtcaagcagcttcactcctctcaaatcctattttttcatcgacagggagaaagaatgggcacagncccacgcccgcgttttcgacccgaaaggaattgacaatgaaacaagaatctgtgttcactatctatggagcggagtgactatccttaatctcctcttccctatctcccccttgcctttttttctttttctcgccggcag

SEQ ID NO: 34056 - DNA, 399 bp, Glycine max
  Peptide Sequence Number=SeqID_125741
atggcagcacaattaatccatgatcgcgtggagatggagtgcctagagggagtttgggagaccctcgaaggcaatgagaggtgccgatttcgtggcacgattcgactcactgctacttcattgcgaactgtggagtggatactacctgcacctactccatatcgactagtggagccagtccaagtgatagaggtgtcgtactctgaagaagaccctgaggaggacccagaggagttacctcctgagcctgctatggatgctcttgactttccagaggatgatgaggacccactccctgatgtggattctccagaggatgtcatgtcagcatctgaggcagactctacggaggagagcggccctggagggacggcgaatagtggagactcttcatcatag

SEQ ID NO: 34057 - DNA, 327 bp, Glycine max
  Peptide Sequence Number=SeqID_125742
atgaatttattggctagcgctcttcatgtgtcctccaccttcgagtctggaaccccgcgaagttattgcgtagcactgttcgccaattctccattctccactttattcggagaccccatgaatttattgcctagcgctgttcatgcatcctccaccaacgagtctggagtcccgcgaagttattgcgtagcgctgttcgccaattctccattctccactttattcggagaccccatgaatttattgcctagcgctgttcatgcatcctccaccaacgagtctggagtcccgcgaagttattacgtagcgctgttcgccaattcttga

SEQ ID NO: 34058 - DNA, 237 bp, Glycine max
  Peptide Sequence Number=SeqID_125743
atgatagttaaaaaggacttcatggttgggcaaaaagtgttattgtataattctaggcttggactcatgagtgttgagatcaaaagcgactccacaaacaagagcttcaaggtcaacggacatcgacttaagccattcctcacgaacccttctttagtggacgtagtggtggaagagacttccttactccaccctacttttcctacctccttctttgcttttattacacttgtctga

SEQ ID NO: 34059 - DNA, 315 bp, Glycine max
  Peptide Sequence Number=SeqID_125744
atgcatagcctaaagtatgcccgagtcattcgtccctatgaaatgttgttgaaccaagctcatgcttttacgaaaagaaaagaacatgctttacggtgcccttaccgaacccgtgctagagctagagtaatgggtgaagtagaggaggtgcaagagcaaatgaaggccgacatggaggccatgaaagagaaaatggccacaatggtggaggccatgatgagcatgaagaagataatggaagccaatacggttgcagttgccgctaccagcgctgttgctaaggtgaacccgatgcccccatctgatctcaactaa

SEQ ID NO: 34060 - DNA, 126 bp, Glycine max
  Peptide Sequence Number=SeqID_125745
atggcctttgtcgataactgggcggtgggtaaggagaagcatgatgatcagatttgcctctttagacccactttgatcctttcgtcggtgaagaccatatcatcaaagcttgaaggtgccacttga

SEQ ID NO: 34061 - DNA, 1857 bp, Glycine max
  Peptide Sequence Number=SeqID_125746
atgatcaacaccaaaactgctttgggtattgctgctagtgtggcgttagccttgccagtcatggcctttgctgctgcagaccaagaagctgcgatgaaagatgccaacaactgggttcacccacgtggtcaacataataaccaaggttacagctcgctggctcaaatcaacaagggcaacatcaaaaacctgaaaatggcctggacattcgctaccggtgttaaccgtggccaagaaggttctccaattgtgatgggcaacatgatgtatatcgtgactgctttcccaaacaacgtttacgcactggacctgaacgacagccagaaaatcgtttggtcctatttcccaaaacaagacccgagcgttcaagccgtcctgtgctgtgataacgtgacacgtggcctgggttttggcgacggcaagattttcctgcaacagaatgatggcttactggttgcgctggatgctaaagacggcaaaaaaatctgggaagttaaaaacacggatcctaaagtaggtgccactaacactaacgccccacacgtgatcaaagacaaagtcttgactggttgttcaggtgctgagttcggtgttcgctgctttatcgctgcatataacctgaaagacggttctttggcatggaaagcctactcaacaggtccagattcagaaacactgcatgacgcaaacaccaacaaagataatccactttacaacgcactgtctgtttaccaggatgtaaacggtggtaacaaagaaggtggttctttcaagcgtctgtcagctgaccagatcaaaggtggcgaaaaagagctgggtacacgtacctggttgaaaccacaagcaatcaaagacggctggcaacatggtggtggttccgtatggggctggtggccatatgatgcacgtacaaacctggtttactacggtgcaggtaacccatctgtttggaacccagacgtacgtccaggcgacaacaaatggtctatgactgtgactgctcgtgatttggacactggtgtggctaaatgggcaatgcaaatgacaccacacgatgagtgggactacgatggtgttaacgaggtgatcctgttcgacaaaggtggcaaaacatacgcatggcaccatgaccgtaacggttttgcttacacatggaatgcggtgacgggtacattgatcgctgctgaaaaagtacacccattcgttaactgggcaagtgatgttgacctgaaaacaggtgtgccaaataaagatggccggtactctactcaccaggattacaatgccaagggtatttgcccggcggctctgggtactaaagaccaacagccagctgcttactcaccaaaaactggtttgatgtattccccactgaaccacgtttgtatgacatacgagccagttgagtccaaatacgttgctggtcagccatgggttggtgctacattgaccatgtttgctggtccagacggcgtgatgggtggtttcggtgcttacgacccaatgaccaacaaaaaagtgtggtacaacaaagagaaattctctgcctggagcggtgcgctgacaacagcttctgacctggtgttctacggtactttggatcgttggttcaaagctgttgatgccaaaaccggtaaagaactgtggaaattccaagtgggttccggtgcgattggtaatgcattcacctacggtaacaaaggcaagcaatatgttggtatcttgtctggtatcggcggttgggcgggtgttgcgatgaacttgggtatgacgactgacactgacgcactgggtgctgctggtggttacaaagagttgaccaagtacaacgctgcgccaggcggcggtgcattgaac

SEQ ID NO: 34062 - DNA, 243 bp, Glycine max
  Peptide Sequence Number=SeqID_125747
atgacgtgccgggaatcaaaagaaaatattgatgcacaatccgtatggttccgtgacacaccggaaatcaaaaggaagcatcgttgcacaaatagtgaggtccgtaacactccgcccacttgggccctccagaagattcctccagaaggcggttgcttctggaggaagcaaccctgctcgcctgggcgagctgagctcgcctgggcgagctgggcggcaaccacctcccctattttgctataa

SEQ ID NO: 34063 - DNA, 213 bp, Glycine max
  Peptide Sequence Number=SeqID_125748
atggaacttcaacgtctcaaccaaaatgaagagacagacaaaaggaaaagaagaatagcactcaaagtctccttttcaatgcaagaagaagaagaagaagaagaatttgatgatgaagaggacttctcactctttgtgaagaagtttcataaattcgtcaaaaatagaagtatggagagaagccataacttcaacaatgggaagagatctcaa

SEQ ID NO: 34064 - DNA, 159 bp, Glycine max
  Peptide Sequence Number=SeqID_125749
atgcatgaaggaatgcatatgacacagatgcaatttaggaatgcgggggcccgaggaattgcctccttcttagatacaacgtctaggggtagcaaagtgccccaacaggggatcaagacggaacccacgtgtgatgcatatgcgaaaggcgcaacatag

SEQ ID NO: 34065 - DNA, 736 bp, Glycine max
  Peptide Sequence Number=SeqID_125750
atgaattcatcctccatttatattcttgtctttgtccagctttggttgttgagcttaccatgcagagagagtgtgtgcatcccaagtgagcgtgagacacttttgaagtttaagaataatctgaatgatccttccaataggctttggtcttggaatcctaataataccaactgttgccactggtatggagtcctctgccacaacgtcacttcccatcttcttcagcttcacctcaactctgctttctatgagaaatcccagtttggtggagagataagtccttgtttggctgatttaaagcatttgaattacttggacttgagcggcaatggatttcttggagaaggtatgtcaattccttctttccttgggacaatgacttccttgactcacctcaacctctctcttactggattcagggggaagattcctcctcagattgggaatctctcaaatttggtgtatcttgacctgagatatgttgcctacggaacagtaccctctcagatcgggaatctctctaagcttcgatatcttgacttgagcgacaattattttgaaggtatggcaattccttctttcctttgtgcaatgacctccttgactcacctcgacctctcttatgctggattcatggggaagattccatctcagattgggaatctctccaatttggtctatcttggccttggaggtagttatgatctgttagctgaaaatgtagaatgggtatcaa

SEQ ID NO: 34066 - DNA, 216 bp, Glycine max
  Peptide Sequence Number=SeqID_125751
gacagtctaacgacggtgctgaaggttacgaggctttgctcatggaagagttgggataggctactaaagaataaagacaacgtggaaaaacacattaaaattgtgatttttatctcaaaaacttcatgggttcagagaaggtggaaaaacacattaaagttgcgatttttatctcaaaaacttcatgggtttaggttcgtaaacacaaaggcttaa

SEQ ID NO: 34067 - DNA, 564 bp, Glycine max
  Peptide Sequence Number=SeqID_125752
atggctaaagttcatacacgagggttagattggctctccaagttgaaaattatcaacgaggagaacttcgaagctccgaaagaggatgaagaagtccaagctctaaaattagagttaggaaaggcaagactcgctaaagaaaaattcaagttagtcgctacagacgtccgaaaagtgagtgccgagttacgagaagaaaatgcagctaccgcaagagcccttgaacaagaaaccaagagggctcgcaaggaaaagcatggccgagacaaattccatggagctttgtggggcagcaacaaggaactcaagcttcaaagggaagagagagaccaatcacgagtacatagcatgatcttaaaggagaagttagctgcttgctcaagatccaagaggagtttggcccaacacttagaagacacggagcaaagcatgctagctataatagggcagtacaaagaggagttaaaccagtctttggctcatgagcaaaagctagtagaagacttcgcacaagcatacgccgagaaggaggcaagaggaagggtgattgatgcattgcattaa

SEQ ID NO: 34068 - DNA, 567 bp, Glycine max
  Peptide Sequence Number=SeqID_125753
atgccaaaggtgaagcattttagaaatccacaaaaatcagcacctcaaccacaatgttcctcaccaagtgattccacacaagctcctgaagtcccaactggtaatgtccctctttctcatctatcaacatctgaagttccaacaatgaatcctgaaatttctttcccaccaagtgattccacacaagctcctgaagtcccaactggtaatgtccctttttctcatgtatcaacatctgaagttccacaagaagatgaaacaactagacgtcatgttgggcgtgagtctacacactgttggactgttgaggcaatagactctgaagaaacgatcaagaagattaaggtgaaagttagggtagtcaatagcttacctagggagttacgcatcattgtgaattttgatgaccaaggccaagcaattggtgaagcacaagccttgcttgcaagatttcttggaacactagcagctgattgcaaattatttcctatggattatgatagatggtctggaccttcaggcgtacctaaagcttattttgatgattgctttgaaacaattttaaag

SEQ ID NO: 34069 - DNA, 450 bp, Glycine max
  Peptide Sequence Number=SeqID_125754
atggctccaaaaaagctttccaccaaaaggtctaggagagccgccgtggcggaagtgtccagtgccgcccccgagtttgatagccaccgtttccggagcgttgagcactggcagcacttcgaggccatcaaaggatggtcgttgcacagagagaggcgcgtccaactcagggaggatgaatatacagattttcaggaagagatagctcgcaggcattggacatcgctagtgactcccatggccaagttagaccctgaggagggagtgcgagacatgcgttcatgggtgaggggtcagtggattccctttgacgcagatgctctcagccagttcctgggtgacccgctagttttggaggaaggccagcagtgcgagttcagtcagaggagaaacaaggccgatgagttcgacgaggaggccattgcccaactgttatgcacaccggggtag

SEQ ID NO: 34070 - DNA, 166 bp, Glycine max
  Peptide Sequence Number=SeqID_125755
aagcaatgccttccaaggttattttgatgatgccaaagaatcaagagttaagccaattccaaagattcaagaatcaagattcaagaatattcaagaatcaagattcaagaataatcaagatcaagattcaagaatcaagaaaagattcaatcaagataagtactaa

SEQ ID NO: 34071 - DNA, 219 bp, Glycine max
  Peptide Sequence Number=SeqID_125756
aaggcggttgcttctggaggaagcaaccctgctcgcctgggcgagctgggcggcaaccacctcccctattttgctataaataggggaggaaagcaagaaggaaaggccgaggcgcttccgaaacgtttccgtaacgttttccgtgaggaatctcgcaaagctttcaaccgttcttcgacgttcttcattcgttcttcatcgttcttcgatcttcaacgg

SEQ ID NO: 34072 - DNA, 316 bp, Glycine max
  Peptide Sequence Number=SeqID_125757
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcacccttttatccagaggcggcgggcccgatgacaagcagagaccaagtttggtcattctgcacccttgtatcatccagaggcggcgggcccgatgatacgcggaaatacccgagtggttatccgtataaacattcttttgctatct

SEQ ID NO: 34073 - DNA, 294 bp, Glycine max
  Peptide Sequence Number=SeqID_125758
atgcctcttttcgattcccgacatgtcgcgaaacttgacggattgcctaacgatgggcttcaagttcctcgaagcgatcatgcgaaggtcgcatcccaccaaacagatggtcctcgaatgaaattagggtatgacactcgacataagcgttgcttaccacttccaaagcttggaaggatgtctctaaggattcttttgtggcttccacatatgggattacccggactgagtgaatccaaggtcggcctaaaaggcagctataggacgggtggatatccatcacttggaaagtga

SEQ ID NO: 34074 - DNA, 1356 bp, Glycine max
  Peptide Sequence Number=SeqID_125759
atggtggaggcatctgttaattggttcccccgatggaaggaaggaagagttggagttctgtcctcatgtgaggggttctcaaacatccccttgatgggaacgaggggctgtatcaattataatctcgtccttgccataagacaacttggctaccccatgagaggagcgctgtcggaagaaagtatcatgcccttcatcgcacggggtttcagtgaccccaaagcaaggatatttcaaggggtccgaaaggcatggagcgtggtgaaaagaaaggataaggaacttaggggaagcagcaatgggatcatcggaagctatcacaagtggctgaaagctcggacgcaagagttagtttggctcccgaagctaaaggcatcaagtgaggaagaggctgaaacccctgaggagagtaaggaggtgcaagccttgaaggcagaacttgaaagggcgcaagcaatcaaggaaaagttcaagatgatagctatcaaggtctggaaagaatatgatgaactgagagacatcaatgtggccaccgctgaagcattggagcgggaaacaaagagggcacgaaaggaagaaccagtcaagagtcgaaggcatgatattggaggacaagttgaaggcttgccaaaggccatcatcgaccaatataaagagaagctaagtctagccgcaacccatgaacaaaggctacaggacgagtatgcaaagagaagcaatgacgtggatggatggttcgctttcaccttgaatgggagtcaagagcttccaagactactagccaaagctaaggcaataaacaccataactgaacacgctttaaggcacccctatcgaacccgttccaaaactagagtcatgggtgacatagaagaggtgcaagaacaaatgaaggccgatatggaggccatgaaggatcaagtggcttccatgatggaagccatgttaagcatgaagagaatgaaggaaagaaacacggccgcaattgtcgcctccagcaccgccactgaggcgaatcctacccatccctctgccataaaccaagcgaaccaacccgccccggacatggtgggacaaggaggggaagtgttgggtagtaccagtggtccacacatggggtataataggaatgcttatgcctatggcttacccccaaattatacgccgcccaccatgcacatgcctaacgagaacattaatcatgtcgttcccgttacctttgaagtggaagggagagagaaacttgatctcatcgaagagagactaagggttgtcgaagggttcggtgattaccctttcgctgacatgacagaattgtgtttggtacctgatgttgtcatccctccaaagttcaag

SEQ ID NO: 34075 - DNA, 624 bp, Glycine max
  Peptide Sequence Number=SeqID_125760
gacatgaccaagagcaagggcaaggatccaattgaaggacttggaggacctatgacaagggctagatcaaggaaagcaaaggaagctcttcaacaagtgttgtccatactatttgaatacaagcccaagtttcaaggagaaaagtccaagggaactcagcctcctccaatgaagaaatcaagcaaatctgccatgtctccatcatcctcagctccaccttcgtccccttgggccacgggtaagggttggggtcatggcaatgctagtgcagtgtatactaatagaagctgtcattcaactgcatctggcccctatggtttgcttcctgttgatcaaccaaatgttgtatgtatgcatgcatctggagctccatcctttgcatgtgagctgagatggactctagagatggtgactaatgtggaggcggtggtggtgcgtctgcggccggttgctgttgctggtcttgccccggctgctaattggaagagacctgtaatcaatgccgaaaaccctagtgccctattggacttctctaggtccactggaccaactgacaatttgggtagcgtgagatcaaagttatggtcactgggaaggatgttaccgagcaggaatgtcatctag

SEQ ID NO: 34076 - DNA, 129 bp, Glycine max
  Peptide Sequence Number=SeqID_125761
atgagggtagtttatgttgtgagcttggacttctggacattcgatgctgccatgataacgacttctggtaaatatgtcacggattcccttgatgatggtgagtcagatgatgtagaatcagaaaaatga

SEQ ID NO: 34077 - DNA, 309 bp, Glycine max
  Peptide Sequence Number=SeqID_125762
atgaatttgttgcctagcgctgttcatgtgtcctccaccatcgagtctggagccccgcgaattcattgcctagcgatgttcgccaattctccattctccacttttattcggagacccatgaattcattgcctagcgctattcatgtgtcctccaccatcgaatctggagccccgcgaattgattgcctagcgctgttcgccaattctccattctccaaccttattcggagacctatgaattcattgcctagcgctgttcatttttcctccgttatcaagcacggagcctctgaaaaaaagaaggagtag

SEQ ID NO: 34078 - DNA, 1062 bp, Glycine max
  Peptide Sequence Number=SeqID_125763
atgtggccgcacgtgcagggcgcttacacctacatggagcagctgcgcgccagcgagcgcaccgaagagaaccgcgcgcgcaacccggcgttctacgggatgatgccggcctcgatcagccacgaaggctattcggccaagccgatgcactcgtactgggacaacttctgggcgttgcgcggctacaaggacgcggcgctgctggcgacccagctgggtaaggtcgaggcgatgcagattgccgaatcgcgcgatcagttcagggatgacctgcaggcctcgctgttgtcggcgatgcagcagcacagcatcgactacctgccgggctcggccgagctgggtgacttcgacgcgacgtcgaccaccatcgcactggccccgggcggcgagcagggcaggctgccgcagcaggcgctggaggcgaccttcgaacgctactggaacgagttcgtcgcgcggcgcgatggcaagcgcgagtggaaggactacaccccgtacgaatggcgcaacgtggccgcgttcgtgcgcctgggctggcgcgaccgcgcctggcaggccaccgagttcttcttcaaggaccgcgcaccgcaggcctggaaccagtgggccgaagtggtctcgcgcacgccgcgcaagccgttcttcgtcggtgacctgccgcatgcctgggtggcctcggacttcgtgcgctcggccttggacatgttcgcctacaaccgtgacatggacgatgcgctggtgctggccgccggcgtaccgagcgcgtggctgcagggtgagggtgtcgcggtgcagggcctgcgtacgccacagggccagctcaattaccgcctgcagcgcagcgacaagcagctggtgctggaggtgcagccgggcctggtgccgccggtggggggcgtggtgctgccatggccgtacgcgggtgatccgggcggaggtgacggtcaacggcgaagccgccgagtgggatcaacaaggaactgcacgtgcaccagctgccgggcgcggatcgagatcgaagtgccgaggcgcggtgccgccgccgccggagcgcaagggaca

SEQ ID NO: 34079 - DNA, 342 bp, Glycine max
  Peptide Sequence Number=SeqID_125764
atgtcattccaccacttatcgtgtaacatcacatctcaacactacacgtctcacacgttttcacatcattcacgtactcaaggatcaaaacacagtatcactcaatcaatcactatcgatcaatacacaagcgttatgcaacaatatactaagactcaatcatatatgcaatgtggtaccatgttaataaaaaatctcgtcggatgctcaggagtacatgacaagacagaccacacattgcacatgcttcaaggaacattcaaaccgagtgtatttacccccaaggcctacattccgaagaatccgtcagagtctttccctcttgattcaggtccaacctaa

SEQ ID NO: 34080 - DNA, 210 bp, Glycine max
  Peptide Sequence Number=SeqID_125765
caccaaacaaaaggaaaccatttcctaactacagtgttaggggtcacgtgcaactccttgagtggagctaggtcaccctacgagactgtggtggcaactacagaatctccaagagaagcaatgacaaaaaaagatgcaaagataatggcggatagggtacctgggaatggccactttgatgacggcgacggaggacatcagtgtaggtga

SEQ ID NO: 34081 - DNA, 450 bp, Glycine max
  Peptide Sequence Number=SeqID_125766
atggacaagatcagaaatggtcaagataaaggtaagcatattacaaccaatgttcgagcagccttggacgaaaattggggttctatagattttctaaacaagagttccactgccaagacaaaagagtttcaaagaccaccaactgcttgggaggtgatagagaaaactaagaaattgaagtcgggagaatgggtcaatgataagtcccgcgaatttgttgataaatatcaacatcgtcgagatgaaatcttacaacatttgacaaacgaaggcacatctacacaggattcccctaacactgctacttctgttaatgataatgaaatatatttgaatgttgttggaggtccaaattacaaggggaaaatgtacgggctagatactttgagcaaaaagtttagttgctcaaaatcagtttcatctacttctattgctcatgtggaagactaa

SEQ ID NO: 34082 - DNA, 500 bp, Glycine max
  Peptide Sequence Number=SeqID_125767
actctgaatggaggctcttgtttcttgctgaaattgcatattctggatggtcatttgcctcactaactcttctaaggaaggttgaggagaagcctcagttgcttgttgtctttgatgttgttgttgttgctggtgcattggaggaggaacatatggcctgcttggaccaacaacattctggaaaggagggacaggctgttaatgttgtggaggacttgtccatctcagatttggatgattcctccaacttggattctatctattgcttgaaatatcatcattattttgttgttgttggttttgctactaagggggtctactataaatgtttgaagcataagcttcagatttttgattcatggcaagtgatgcaagctccattggagcttgtaggcctaggatcttcttcatcaatggattcctttgcttcttggaagatgaatggcagcggaatggagaaaggaagagagagaggagacgccacttcaaggagaagatga

SEQ ID NO: 34083 - DNA, 198 bp, Glycine max
  Peptide Sequence Number=SeqID_125768
atgactctattttgcacacaacttcctatcgaatcaaagatcaaacgtggggtgggatatcgccagtcgagaacgactttgaatggcaatctgaagggaagagacaccaaaaatgggtttcctttgccggcagtcacttaccctgccgaaaatttatctggtctgaagaatttctatcctctctcttccattgattga

SEQ ID NO: 34084 - DNA, 1107 bp, Glycine max
  Peptide Sequence Number=SeqID_125769
atgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaaccttatatttgcccaatggatacaatctgctcatgtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcggtacttgcgatatttcggcttgggacgcattttatttggcagttttctggatgttaaataccattgggtgggttactttttattggcattggaaacacattacactatggcagggtaatgtttcacagtttaatgaatcttctacctatttgatgggatggttaagagattatctatggttgaactcttcacaacttatcaacggatataacccttttggtatgaatagtttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattggttggactagcccacttttccgtaggttatatatttacttatgcaaccttcttaattgcctcgacttcgggcaaatttggttaa

SEQ ID NO: 34085 - DNA, 213 bp, Glycine max
  Peptide Sequence Number=SeqID_125770
atggagcaagttagcataggacaccagaattggggtgaattctacaggctttttgctgcaaaattccttccttggttggtgggttttgttgttgatttagggatggcctttatggataaatgggtggtgggaatggtagtcacagcatgggtttctcccaccttctcatcctcttcatttgccccagttttctcattcgtccaagcaggatga

SEQ ID NO: 34086 - DNA, 144 bp, Glycine max
  Peptide Sequence Number=SeqID_125771
atggaggttgaggaaccttggctagggttatggctaccattgaattatcaagtagatatgggagcaaggtggtgtttggcaacgaatatgcggcaggcagactttgaggctgatttagggatgacctttgtggatgattgggtg

SEQ ID NO: 34087 - DNA, 1260 bp, Glycine max
  Peptide Sequence Number=SeqID_125772
atgggatcaagtcaaacaccttcgcttaaaaagaggttctatcaagtcaaggtcaagagcctagggaccaccagtctaaaggagttaaggcagttaatgggtcagctccagcggcaagcttttcgcaaagtttacggtaaaatctgggacttagccatggtagaagtctccacagaggccattgcctccctcgcccagtattatgatcagccgttgaggtgcttcacctttggggacttccagctatcacccatggtggaagaatttgaagagatcctaggatgtcctctagggggaaggagaccatacctcttctcagggttctatccctcattagctagaatttctaagatagtccaaatctcggcgcatgaattagaccatagaaagcaagttgaaaatagggtggttggaataccaagaaaatatttggaggcaaaagcaagaatcttggcaagtaaaggcgaatgggccccgttcatagacattctcgcgctgttgatcttcggaggagtcctctttccaaatgtggatgggttggtggacctagcaacaatcgatgcttttctcgcctatcataaccacaaggaaagcccggttgtcgctatatgtgagaagagcagtacgaggattgtttgctgtactccagctctttatgtatcgttggtttcacacctttttcaccagtacaaggattgtttgcagtacgaggaccgttcatgcacagagaaaggaggcacaaattgtgaccaactcttagcaaacaaagaaggagcgtctatcaactggttccctcgatggaaagaaggaagaaccagagttcttattttgtgcggaggatttccgaatgttcccttgatggggacgaggggttgcatcaattacaatctcgttcttgctataagacaacttggctaccctatgagaggggcaccactagaggaagagatcgcgcccgtcatttcacgaggtttcaataagaccaacgtggaaacgcttcagaaggtccgcaaggcatgggaggtggtgcaaaagaaggacaaagaactcaagggcagtaacaatgggcccatcggtggctaccgtaagtggttgaaagcccacatgcaaggtttggattggctcccaagtttgagaatcgctaaaagggaggaagttgaggcaccggaggaagacgaagaggtgcaggcccttaggacagaactcgagcaagctcaaacagccaaagacatgttcaaatttgcagctctaaagatctga

SEQ ID NO: 34088 - DNA, 534 bp, Glycine max
  Peptide Sequence Number=SeqID_125773
atggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtctctgagcatcaaattgccaaggaaatcactgccaagcaagtccagcattggccaaagaaagggaagctttctgcagagaagctaagtgtgaagtatgcaatcctgcataggattggcactgcaaactgggtacccaccaatcatacttccactgttgccacagaatcttttgctgtcaaattacccattgccttcccaactgtattgtgtggcattatgtggagtcaacattccaatatcttaaacaacattgactctgtgaagaagagagaatcggctcctgtctctgcattacaaactgtttga

SEQ ID NO: 34089 - DNA, 519 bp, Glycine max
  misc_feature (41)..(41): n is a, c, g, or t
  Peptide Sequence Number=SeqID_125774
gccttgtcttcaaaggccaaggggaaggaaaaagaggaaanagattcttccaagaagattgttaagaaggaaaatcattttgcaacaaaaagtgatattaaaagagcactccttcttaaacaatctttctaccttctcctatcaagggaaacatcccttagcaccgccatacctcttgagcttgaggttattcctcaagtaaaggagttgttggatgaaggtttggttcgcaagagcttaaatgcttgtgctttgttggtgcctaacataggtgttgaggaaagaatccatgagtttcaagaacctctggatttgaggtcaaatccttttcaagggggagggaatgatgcaatcctacccccaagggcattggatagaagactccaagaagattgggccaaagatgcaagagaaggccctagggttctcatgcgccttagggtagatttcgggcctaaggtaaggtacactagaaatataggatttttcagcccttgtcttttagggcacctagactag

SEQ ID NO: 34090 - DNA, 201 bp, Glycine max
  Peptide Sequence Number=SeqID_125775
atgttgctaagtagcaatgtcatacatatctgtgtaagagtggtcatgttggtgcgcacaatccgcactcgtctctttgcagcggcacgggtgaaatcttgccccgatatgcatagtagctgcgcgacagcctccctctctggttgtgctagcacagttgatcgctcctccaggatcagagggtggcccaggaacttataa

SEQ ID NO: 34091 - DNA, 456 bp, Glycine max
  Peptide Sequence Number=SeqID_125776
atgtacatgattggcggtgctttaattcctgataaatctggaaatagatttcatttaatgtatttgaacctattacatgatttgaacaacacaaaaaaatatagttcgggttgtttagcaaacctgtatagagaactatgtcgagcatcatcggaggttggtaaatctatgggtggttgtgtcatactattgctgtcatgggcttggtaccgcatgccttttattgcaccaagagtcccacgacccgaaacaacttttccactggctaaaagatggagtggtggtagattagaatatagggccacacctcatggtgacttggtcgaatataggtctcgtatagatcatatggagagccatgagctacagtttggactacaacaagatatccatgttgatcccatgaatcttgatctacttcaccaaattgacatgcgaggctatcattacacttga

SEQ ID NO: 34092 - DNA, 201 bp, Glycine max
  Peptide Sequence Number=SeqID_125777
atgtggtcatctacaccttttccggagatgtcagcatctcccggggcaaacgaaaccgttgacacgcggagacttacatcgtcttccgcgccttcagtcatcctgacccatgaagtcaggcggagatacccaagtggttatccatataaatactttttcactatccgtcaaactcagagtccggtagcatgcagagactaa

SEQ ID NO: 34093 - DNA, 150 bp, Glycine max
  Peptide Sequence Number=SeqID_125778
atggttgttgtcatgacgatggcggccgccaacaacgagcacacacgaattgatgaagatgaacaacagtttgatgaagatcagtcacggattgaagagatgaagatgagagaatttgagaggagaaatgaattgagcgtgaatgaatga

SEQ ID NO: 34094 - DNA, 711 bp, Glycine max
  Peptide Sequence Number=SeqID_125779
atggaaaatgctgaattaggcactgttacctcacacatcaagaggcaatgcaattctcctcctacacttattgttattggtgctggaatatcaggaattgctgctgcgcgttgtctccatgatgcatcttttaaggtgattgtattggagtcaagggataggataggtggcaggatttatactgattactcatttggctgtccagtagatatgggagcctcatggctacatggtgcttgcaatgagaatcccttggcaccattgatacgcgcattaggacttacactctatcatacaggtggtgataactctgtcatatttgatcatgacttggaaagctgtatgctatttaacattgatggtcatcaagtccctcaacacattatgatggaagttggagacacttacaagagaattctggcagagacagtaaaagtgagggatgagcatcctgatgacatgcctattctccaagcaatttcaattgtgttaaatagacatccagaactaaggcaacaaggacttgctcatgaagtgctgcaatggtatatatgcagaatggaagcttggtttgcttctgatgcggatatcataccattgaaaacctgggatcaggcaagtgccattatattagttgaaggacacaagatcctctttcccctaagcttctacacatgtccttttttctgtagttttatacttgagtcttga

SEQ ID NO: 34095 - DNA, 1476 bp, Glycine max
  Peptide Sequence Number=SeqID_125780
atgtctgggacattattatgggttgtttcctcccctggtttagaggtttcccattccagtgggttacttgattctattcggagtgtgaagttcttagattcctcaaaggccatgtctcgagattttgggtcgattagagcgaagctgggtaaggaaaagggatggagactgtgctctttgagtacagatatgaagtacacatgtgttggtcggtctggcttagaaagtgctagcaacttccctctgatagccaatgtgcttgtaaacccagcagcaggagaagtggctgtctcgtcagaacagaaggtctatgatgtggtgatgaagcaggcatctttggttaagaggaagttgggcgctgcgggtgaacttgatgcaaagccagatattgctctgcctgggaatttgagcttgttgaatgaagcatatgaccgttgtggagaaatttgtgcagaatatgctaaaacattttacctgggaactctcctaatgactcccgaaaggcgaagagctatctgggcaatatatgccttagctggtttgcaaaagcaatctactgttaaactctttcagtctagtgttagacatttccagatgtcaaaatctttgatgtccattttgataactgaagttggacagataaggtgtggtgtaggagaacggatgaacttgttgatggtcctaatgcttcacaaattacgccaactgcttagaaataggtgggaatcaagattggaagaacttttccaaggtcgtccatttgatatgcttgatgctgctttatcagatacagttgccaaattccctgttgatatccagccatttaaagatatgatagaaggaatgagactggatcttaagaagccaagatacaaaaactttgatgaactatatctttactgttactatgttgctgggacagttggtataatgagtgttccaatcatgggcatttcaccaaattcccaagccacaacagagagtgtatacaatgctgccttggccctaggcattgcaaatcagctaaccaacatactcagagatgttggagaggatgccagcagaggaagagtgtatcttccacaagatgagttggctcaagcagggctttccgatgaagacatttttgctggtaaggtgacagacaagtggaggaacttcatgaagagccaaattaaaagggcaagaatgttttttgatgaggcagaaaagggagtgacggagcttaatgaagctagcagatggcctggtgacccttacgtgcataagaatacacatattcctagaaagattatggtatgggcgtctttgctattgtatcgccaaatattggacgagatagaagctaatgattacaacaatttcactagaagggcttatgtgagcaaagccaagaagttactttctttgccagctgcatatgctagatctatggttcctccatcaaaaaagttatcttctgtaatgaagacataa

SEQ ID NO: 34096 - DNA, 792 bp, Glycine max
  Peptide Sequence Number=SeqID_125781
atgttggcactcacagtatccattatcctcatcatcacactctcttcttcgccattagtcacctctcactactcctctccttctctagaagcctcgccgaccttctccgaatggcgatccgcgcgcgccacctactacgccccggcggatccccgcgacgtggtgggcggcgcgtgcggctacggcgacctggtcaagggcggctatggcatggccactgtgggcctcagcgaggcgctgttcgagcgcggccagatctgcggcgcgtgcttcgaactccgctgcgtcgaggacatgcgctggtgcatccctggcacctccatcatcgtcaccgccaccaacttctgtgcccccaactacggcttcacctccgacggcggcggacactgcaaccctcccaacaaacacttcgttctccccatcgaagcttttgagaagatcgccatttggaaagccggcaacatgcccgtgcagtatcgcaggataaagtgtaggaaggaaggagggatgcgatttacggttactggttctggaatcttcatctccgtgctgatcagcaatgttgctggccatggagacgtagtggaggtgaaggttaaaggctcgagaactggttggctttcaatgggtcggaattggggacaaaactggcatgtaaatgcgttgctgcaaaatcaacccctttcgtttgaggttaaagccagtgatggaaaaacggttacgtcttacaatgttgctcccaaggattggacctttggacaaaccttcgaaggcaagcaatttgagacttga

SEQ ID NO: 34097 - DNA, 681 bp, Glycine max
  Peptide Sequence Number=SeqID_125782
atgaatttgttctctggacctttgtttttcacattctgctttcttaataccgttgcactcgcctataacgccaccgcagcgcttccgttcggaacaattgtggttattttcctcatatggactcttgtaacctcacctttactagtactgggtgggattgctggtaagaatagccaatcagggtttcaagctccttgccgcaccaataagtatcctagggagatcccaaaactaccttggtaccgtacaactcttgctcaaatggctatggcaggttttctgccattcagtgccatttacattgaactctactacatttttgctagtgtctggggtcaccaaatttacaccatatacagcattctgtttattgtcttcatcatcctcttgattgtcactgcttttgtcactgtggcattgacatactttcagcttgctactgaggaccatgagtggtggtggaggtctttcctctgtggtggatcaactgggttgttcatatatgggtactgcctgtattactattatgcaagatcagatatgtctggcttcatgcaaacctctttcttttttggctacatggcttgcgtttgttatggtttctttctcatgcttggaactgtggggtttccgtgctgctttgatctttgtccgtcacatatatcattctatcaaatgtga

SEQ ID NO: 34098 - DNA, 798 bp, Glycine max
  Peptide Sequence Number=SeqID_125783
atgttcggagtagttttcccgaaccggagcttccccatggacatctcaaccttcgctcaaatcgacaccttccactgggtcctcgacatgaacaccttcgtaggcgaggcgtacgaccaggtccgcgagctctgcatcttcctcctcaacggcttcacgctgccgccggagaaggcgctcgccgtctacatccagtcgccggggtcgccgttcgtgttctgcggcgccgtcacggtggcgcggccctccgccgtgctgacgctggcgtggccggagccaggcgccggagggccgctgcagctgacggcggacgcgcagccgctgtcggcgaagatcggggtgtcggtggaggatctggcgtcgctgccgtcgctcgacatggcggcggagaagcgaatcgaggggctggcgatgaaggtcggagagaatcttttcaatttcatgcaatcgttttgcggcgtggacgggtcgaagctggttgttccgatggatatcttggagcggtggttcaagaagtttcaggaacgggccaggcgtgaccctgagtacttgaagggttttgctttgggttcatcattgtttaggatttggaagtgtgatccgtgtttagactatgaactgtcaaacaatgttgttatgctgagggtgatgagtattatggagaaacagtctctttacatatgcaagagtaaggctccgtacaacatccctcccccataccttcgcatagcgaagagcctctgggcaatgggggttggttgtagtctgcagcatgcttcagtattaggaggcttatag

SEQ ID NO: 34099 - DNA, 1395 bp, Glycine max
  Peptide Sequence Number=SeqID_125784
atgaccttggaggggattttcattgagcccacctcaaccactactgctcctgatctttctcttcacataagccccccaaccatctcttccttgaattccaattatgaaccccatgaaagtaatttcccttcaagaactactactgtgtctcaacaagcccacacagaactctctcttggaagaaatttcacttctgaaacaccaataccaacaccacacaacccttattatcaaagccaaaaccatttccatcatcttcaccaccaccaccacaacaacaacaacactagtactagtgttaatacaacaagtgttgttacaagtactaccagtactactcccttgaatcacataaactatggagtttcattgcttgatgtgtcatcatcagacaccttgaggccaatcaaggggattcctgtgtatcacaaccgttcattcccttttgtggcgaccatggaccatgctagagacaacttaaacaacaacaacaacaacaacaaggatcattaccatcaccacaagatgtgcttatataatcatcacaacatgccttcttatccctctctatcttcctccacagctactccttctccttcaccttactttgtggatcccatgtccctcttgaacaacggctccaccatggcggcgtgtagggctgccacggccacaaggtttaatgggttctccggcgatgctttcaaatctcatcatccattgcaccaatatggggtcggcccttcagaagcctcttctgggttcatgagatcaaggtttctgcagaagcttcccaacaagaggagcatgagagcccccagaatgaggtggacaagcaccctccatgcgagatttgttcatgcggttgaacttcttggtggccatgaaagagctactccaaaatcagttcttgagctcatggatgtgaaggatctaacactagctcatgtgaagagccatttgcagatgtatcgaactgttaagaccactgacaagcctgcggcatcttcaggccattcagatgggtctggagaggatgatttatctccgatggttagcaccgccgatcgtggtggtctccgacaatttcccaaccacagagggcggccggagtgggcggcacaacaagacatggactactcttccaccaccactactctatggagtaattcttcaagttgtggggagtcacggctaagacctagttctaacgacatagatggtctcagatcacctatcctccattcacaaacaatatcaggagggcatcaaattcaggagtgtgattcaatccaactcaagagcaacatgccaggttctaatttggagtgcaagatcccaagcttggaattcacattaggaagaccagattgggatggcaaagaacaagcctag

SEQ ID NO: 34100 - DNA, 72 bp, Glycine max
  Peptide Sequence Number=SeqID_125785
atggtggtcgcaaatatatttgcaaagatatgggatgaatgtggatggaaaatggaccagattcagaagtaa

SEQ ID NO: 34101 - DNA, 1779 bp, Glycine max
  Peptide Sequence Number=SeqID_125786
atggacaatgggtggcataaacccttagatgaagattcaatagacaatcagaagcatctgttgcatggagtgattcattgcaatgggtatgggcatttgctttgtgtcaatggcattgaaggaggctccaagattcttagtggcagagagatcatcgatctttgggataggatatgcacaaacctccgagcgaggaaaattgctgtggaagatgtttcttgtaagaggtctatggatcttcgcttacttcatggagttgcttatggacactcctggtttggtaggtggggttataggttttgccgtggaagctctggagtgagagagcgagaatacaatgaagcaatgacaatgcttggttccttggggcttgacatgattgtaaaagatttgagcgagacaaagtacaagacagaaatccagcaaattattcggtgctatagagatatgagtgagactcatattatctcactcagggatcttctaaggtttatgcttactgtcaagtcttctcgtgctcctgtgcctaagataacagacacttattctgctgcttctgattctacttcttcagcgttaacctcaagaaattcaaccaaacacacacttccaaacagatcaaattccatgaaggaaaaatctgtgaggtacaagaagttcagtagtgcagtgactaacatggatagcagatggcccacaaggagactagagtttgcagctcaagtgattgtggatgcactgaaagagaacaagactgtgaaactaggctcaggtgggatgacaaggcaagatgtgagagatgcagctagactacacattggggacacaggcttacttgactatgtgcttaagtcactcaacaatgtgattattggaaactacgttgttcgtcgcatggtgaatccatcaactagaatcctagagtacactattcatgatcttggcaaggggtccaaagcccctgaagagaacaagcctgaggtgatggctcatgcagatcaacaagtagtagagtcatcttggatgcttggtaatgatgtgtacagtgatgcattgtttttgtacaagaatgtgctattgggttaccctgattcggaagctgtggacacagcagttcagacaattctagacagcagatactttgtgaaggagtggccagtgagggatgaaatgaaggagcaggtattgacattcatttgccgcttgcaaccaaattttgtggacaaaaaacatgagctgaagggtctagcatgtggtgaagttgtggtggttccactgcatgcaacagttggggacttgaagagagctgctgaggctgctctgagggacacttactgcattgcagagaggcttatagtgacagacattaaggaactcatggatgtgagtgatgaggaagtgttgtttggactaatccaatctggtgtggaactttgtgtgaggggaattgctattgatttattgacccctttgaagtatcagggtgaatctgagtctgctgataactggaaggtgaggtgtgagtgtggagctcaagatgatgatggggagagaatggtggcttgtgacatttgtgaagtgtggcagcacactcggtgctatggcattgatgattctgagacagtgccaccactgtttgtgtgcactggttgctgtgactcagtactagtaccttcttcaaggactgaatcagcagcctttggtgtggattctgttgattcttttctcatttcagaagaccccactacccttttactagattacgagtatggatactaa

SEQ ID NO: 34102 - DNA, 1527 bp, Glycine max
  Peptide Sequence Number=SeqID_125787
atggagagaggtaaatatttggcattggtgggaggaggggctcttttgggctctgtctctaccttctttcttcttaggcttcttcaatctcaaaaaagaggtgtatcgcagtgcagtaagaatgttactgctgacttcaatggtgttgagggatgcactattgctggaaagaaaaatgatagggtgattaatgaagatcttctgaaagatgagattgtttcagaacagctgactaggaacgttcaattttttggctttgagtctcagcagaaagtgactgcatcatatgtagtggtcattggtcttggaggtgttggtagtcatgctgcttctatgctcttgagatcagggattggcaagcttcttcttgtagactttgaccaggtttctgtttcatcactaaatcgacatgctgttgcgacaagagcagatgttggcatctcaaaagctcagtgccttaaggagcatttcttatctatctttccagagtgccaaatagatgccaaagtgatgttatatgattcatccactgaagaagaaattctctcaggccaccctgactttgttttggattgtattgataacattgatacaaaggtggcgcttcttgctgcatgtgtacgtaggggtttgaaggttctatctgcaacaggggctggtgccagagctgatccaactagaatacgcattgccgatctaagagaatcaactaatgatccattatctcgagctgtaagacaccgtttgaggaaagattatggtattgaaggtggtatcccagttgtgttttctttagaaaaacccaaagctaagctgcttccatttaagggtccaagtggagaagaggaaaacccttcagattaccagtggtgctggctacacattctgacttcttggtcctcttgccagatagtaccaggttttagggtccgtatcatccctgtgctaggcaccatccctgcaatatttggacaattcatggcctcctatgttgtgacggagttagcaggagtgcatgttcaaactgaacctgtagtcaattttaacatggaccattaccatattctgcatcaacgccttatcgagcatgaggagtcattgtatggaacatacatggaagtgcaggtagatgttgaagaagtgatgtatattgttaaagaattatggcatggaagaagtgctagagagcagcatgtaaaagatgttgggcgaggaatgtggcgatcagttaatgaattaatgcttgtaaggtgggaccgcacaaaaccagcatctatttcaaatttgattcttctgaaattcaaagaggtggatgagcatgaatcccgaacgttggatgatataaagaaaaatgaaccagaattttacagtagagtgattgctgtgttaaaacgagctgaacttgactttggtaaggctgcgtacaatatccctcccccataccttcacatagcgaagaagcatagattgaaacaagataagatcaaaaaagtcactgtggaggaagaagaaaaaggtcttaattga

SEQ ID NO: 34103 - DNA, 351 bp, Glycine max
  Peptide Sequence Number=SeqID_125788
atggcaaagagtaaagatgatagcattgcctctttaacaaccggttttaatgaatgcacaaggtgtgggaagaggctggggtgtgagaagaagatactaggaggtgtgggaagagacggggggagtgtgacaagaagagaccggggggtggtgggaagaggctggggtgttggggggggggggggcggcggcggcgcaggcgcctggtgcaggggcgccaccagtcgcgcccagcggcagggcgctgccagacgcgcccgcgtcaggggcgctaccttgctgctccctcgtgcgccacgccggacgtgttgcgtactccatggaagcgtctgtctgggggacgctttgtaa

SEQ ID NO: 34104 - DNA, 405 bp, Glycine max
  Peptide Sequence Number=SeqID_125789
atgaaaagggtggcttcctccaaaagctccttggaattgttcatcaaagcaggacccaacctgaacatgagggtgcagaatttatctaagcatattgtctcctctaaagtgaggatatgcaccgcagaggaaagtgcaattcttcaggatgattttgcaaataacataaactgccaccgacatgatcatcaaggtgagcagcaccgatgttactattaccagagtcattcagttggggcgatggtggttgtagtcgggattaatagggtccagcgtgtggaggtgggcggaggcgggcggctgtggcggtggggacgtagtgagctgcggcatggtgatcggaaggtaaagaacgaacgaaccgtggaagaaacttccaagatgcagctcgaagaacacggatag

SEQ ID NO: 34105 - DNA, 2835 bp, Glycine max
  Peptide Sequence Number=SeqID_125790
atgccacgcagaggaggcggttctcagcggaagaagcaacccttagcttcaacctcagaaaatcaaactggggcccagcaaaactcagaaggtggaaacagatttcaatcacctagtgataatggaacactgaccgaaatatctcgagaggctgttggaaatcttatacgccgtgctaataaagttggcatttccaggaaaaagaagacgcctgagtttgagccagaacaaaatggaacccaagtcttggctccaatgctcaaacaaaagacttcagagattggacattgtggtagaaattccatggaaaacgcttctgcagaggagaaatgtggtaattcaggcctgcactgcttcgataacaaggaagaactggatgactcagattgggaagatggtacagttgccagggatgatcatcctgtgacaattgaattgaatatgaccgctcattcaactgtacagaaacaaattcgtcgagcttctgctgaagataaggacttggctgaacttgtacacaagattcatttgctttgtttacttgctcgaggaagattaatagacaatgcttgtgatgatcctcttattcaggcttctttgctttctctacttccagcacagttgctccagctatcaaatgtcacaaaactcacctcaaatgctctatatcctttaatatcatggttccacgataatttccatgttaaaaactgtacaaatagagaaacttctccgcactttggtctggcatcagctttggaatcacatgaaggtagttctgaagaggttttgagtttctcttttaataaggtttccattcaccgatgctctacttctatgattgcagctttatcagtggctctattaagagctttaaatcttacagccaggtttgtgtccattttggatgttgcccctcttaaaccagttcaagttgcaagtgggtctagtaatggcatatttaaaacttctacaccaatgatatctaagcgaaaattggattttaagtcacctcaagaatcaatatcttgtaatgagatagaaaatgtctgtgaaagttctcttgtgcattcacggaaaagtaagaaatgtcatgcgacaaaccacacggatcagtctagtgatcctcctgttgttgatgtaagaaatgatagtgttgctaactcaaaagcttcagagacacgagatagtaactcggaattgtgtctcactgacaaatctcataaatcaaagaggaaaggggatattgaatttgagatgcagttggaaatggctctttctgctacaacagttgaatgtaaggacagtaaaactgaggcaagtgcaaatcctgattcatcgagtttttcttgtccatcaaaaagagtgaaaagggttatcggtgaagactcttcaacctccccccaagtaatttctacagcaattggatcaatgaaagtaggatctcctctgtattgggcagaagtatattgcagtgaagaaaatttgactggaaagtgggtgcatgttgatgctttgaatttgattattgatggagaggacaaggttgaatccatggtagcagcatgcaaaacatctttgagatatgttgttgcttttgctgggcaaggggccaaagatgtgacccgcaggtactgtatgaagtggtacaagatagcatcacatcgagttaattcaacatggtgggattcggtgttgaaaccattgagagacttagagtctggggcaactggaggtgtggctcatttaggaacaaaccaaatcatttctacagaatccaacatgaatgattctgttgtccctacaaggagctctattgaggatattgagttggaaaccagggcattaactgaacctcttccaaccaatcagcaggcctacaaaagtcatccactttatgccatagaaaaatggcttacaaagtatcaagtacttcatccaaagggtccagttctgggcttttgttcaggtcacccagtttaccctaggacttgtgtgcaaacagttaagacaaaagagagatggctgcgggaagggctgcaggttaaacccaatgaacatcctgtgaaggatcttcaacgttccatgaagcctcaaaaagtacaagattctgaagctgatgactatggctgcactgattctattgaacaaattaaactttatgggaagtggcaactggaaccattaaatctacctcatgctgtgaatgggatagttcccaagaacgagcgaggtcaagtagacgtttggtctgagaaatgtcttccgccagggactgtacacttaaggtttccaaaggcattttctgttgccaagagacttgaaattgattatgcacctgctatggttggttttgaatttaaaaatggccgttcatatcctgtctttgatggtattgtggtgtgtgctgagttcaaggatgtactgctagaggcatatgcagaggaagaagaaaggcgacaagctgaagaaaagaaacgggatgaaacacaggcccttagtcggtggtaccagcttctttcttctatcgtaactcgtcaaaggttaaataatcgttatattaataacagtttgtcttcagacaaactaactggtgtcctatgtataaataatgatgagtcaagtgcgacagtatgcgataataatgacaagagtccgaaccaaagagaccaacaggtggacaaatgtgatactaatgttgatgtttcattaagcacttcagtaaaagatcatgagcatgtgtttttgaaagagtacgaaagctttgatgagggaacttctctattgacaaagcgatgtcaatgtggattttcagtccaagtagaagaactatag

SEQ ID NO: 34106 - DNA, 2106 bp, Glycine max
  Peptide Sequence Number=SeqID_125791
atggatttccctccatactgtcgatcccaattgcgtagcaacacttaccgtgccctcgttcacctcctctctcacatttctgcttacaacgcttcaattcttgaagcttcaactcaacccgtcaacattcccgataatggcagtggtagaatggatcaagaaaaccaggaaaaggagcctaagtgctccgaagttgttgattctgattttttggatcccaaggatcctatatgccagaaggatataccggaggtccaggaaaccattgagggggttgaagacaaggatatggattttacttctaacaagatggtcctagatgatatagaacatatgatgggaatagaggacttgtctaccctagcaaatggttttgataaggagcaaaagctaatgaatgagtttgagcaggttatgaaaggaactgaggatcttatttgtgatagtgaattaatccccttgaacttggaattggataagacacgtagtgatggtggtgaagttgagttgatggattaccaatcagaagtggaggaaggagaaatttctggagacttgggaatagatggcaatttatttgatgtggcttctgcagatgctttaatattacgacagatggaagtagatgaggttcagaagcctgaaaatgtaactggaaacatgatatatccttctaagattgagaatcaagaaaaggaaaaaggctatgactctaaatcctctttggtaaatgcatttcaagattacaataataatggacaagtggagcctagaactagtggcaagaaagggattgtatgtggagttgaagtagcaatttctaaagaaactattgaatgtcagaaggaagataaaacaaagttggataatgccagtaaaaagaataagcgtggtgggaacaaaggaaaaaagaagaaagcagatagaaagaagagagcagaaaagaacaaacaactaggtgttaaaagattgcagttacagcatgtgcagaaaccaaaagttgtctcacattgtcgtcattatctcaatggaaggtgccatgagggtgacaagtgtcagttttcacatgatgtagtgcctctaacaaaatccaagccgtgtactcactttgctcgtcactcttgcatgaaaggggatgattgcccatttgatcaccagctctcaaaatatccttgtaccaattttgtgtccaaaggctcttgttatagaggtgatgcttgcttgttttctcaccaggtatcaacgaaagaagacatccctacagcttcaaatatgtgcagaccagagttgtctccacttctgtctggaaatgcaaattccagcacaccacttaacaacaatcatggctctactcctgtccagcaaaaccacttaactaattctgcaggaattcatttttgcaccagtgttgaacataaagtgacaaacactgtacagaaacagcctacaccacctaaaggaattagtttcatcaatcttgctaaattatcacccagccttagttctctgaaacaaagcacagtaacaaccaagggaagtcctgtacaaattgggacccgtgaagatcaaagttcatttcacaaaactcaaaacaaggtggacattcctaagaaattgccagctgtgacacctaagggaataaactttctttcttttggcaaaggctctgtctgcagttttaaaagtgtgaatagggaaaacggtatcaagttgcctcagttattcaattttggtttgcctgagcaggaaaaatcctctctaaacaaagatgattacaacaaagctagtgacaccacaaaacaaaatgcaccacagactgatatattcttaactgagattttaggaaaaaatcaatctgtggcagaagaaatgaaattaaaacttccagagaaaacctccgtagatttttttatgagggatcacagccatagtaaatcagttcaagaggggaagaagtcatctgataattctcaaagttcaaagggccaaaaggcactcttatcaactctagcatttgcagctgagcatgaatctagcattaagatgaaataccctactggtggtttgccgatgtcatcagaggactcagagagaatgttttgttga

SEQ ID NO: 34107 - DNA, 246 bp, Glycine max
  Peptide Sequence Number=SeqID_125792
atggaaaaacacaggatctcaaaacaggaaagtaagcaaagaaaacaaagaggggggagggttaaaagtgtccagtcactaaccttcatcagctgcaacaacagacactgcaaaaagcagcaggagaagaaaatgcagagccatagattgagaaatctggaaagaagtctcaataatgaaagagagagaaaggaggagtgtgaaatgggacttgaagaaaatgaaaatgaaaaccagaaggagtaa

SEQ ID NO: 34108 - DNA, 1677 bp, Glycine max
  Peptide Sequence Number=SeqID_125793
atggatgagacttcagctctcatcgaagccattctcagagagcaagaggaagaagaagaagaagctcacagaagaagaaggaacctcaccacgcaaaacaccacaatcaaaagtaacaaccaatggcaaacggtgtcgtatcacaagcgcaaccgcaacaacaacaagtcttcctccaagcagcctctcgccgccgatccttcccccgatgtcttcagctctgttcagcgccattccgagcacagccgccgccgactactcgagtctcagatcgcctccgaggctgaagcagctgcagccgccgctccgagcagatcgaagcggcattccgacgacgaagacgacggcgatgcggagcatgaagccagcgccgttcaggaggtgaagaaggcgaagcagaagaaaccgaagaagccgaaggtgacggtggccgaagctgcttctagaatcagcgccgatgatctcgacgcgtttctcgctgagattaccgcttcgtatgaatcgcagcaagatattatgctgatgcgatttgctgactacttcggtcgcgcattctcgtcggtgagtgcagctcaattcccgtggctgaagacgttcaaagagtccaccgttgcgaagattgttgatatccctcttttgcatatatctgaggatatttacaaaatatcaacggattggatcagtcatcgatcatatgaagcacttggttcctttgtgctatggtcgttggacagcattctttcagaccttgccagtcatcagggagttaagaaggcagtccagcaatcatcatcgaaatctcaggagaataaaaaatatcaaggacaggataaactccctgtcattgtttgggtgataactcaggcttctcaaggagatctagttatggggttgtacttgtgggtatatcttctcttgccgatgctgagtgtgaagtctggttgcaatccacagtcaagagacttgatattacagttggttgagagaattatcacatttcctaaagctcactctatcttgctaagtggggctgtcagaaagggggagcgtgttgtgcccccatgggcacttgattctctattgagagttactttccctcttcattcagcccgggtcaaggccactgaaagatttgaagctgtttatccaacgttaagagaagttgcccttgccggttcccctggaagtaaagcaataaagcatcttgcacaacagatactaagctttgcaattaaagctgcgggaaaagctaatctggacctatcaaaggaggcaagtgacatttttatttggtgtttgactcagaaccctgaatgttacaagcaatgggatttgctttatatggataaccttgaagcaagtattgttgtattaagaatactttctggtgaatggaaggaatactttatcaaacatcctactcttgatcctttgagggaaactcttaagagcttcagtcaaaaggccttggctaaggcggatgatgctgctcgccatgcattattgaaggatgcagacaagtactgcaaagcccttttgggaagattgtcacaagaccatggatgcatgaagagcgtgacaattctttctgttgtatttgcggatgacagagttatcctgtggcttgctcggtgcttatgcccagcgtggaccacttcagccgatagtgaggagtga

SEQ ID NO: 34109 - DNA, 3870 bp, Glycine max
  Peptide Sequence Number=SeqID_125794
atgggggagatcgttgtttccatcatagcaaagattgcagaatatacagtgggtccaattttacaccatgctcgatacttgtgttgtttcaacaactttgctgggaatcttccaaatgcaaaagaagatttggaattgactcgagacagtgtaaagaaacgagtaagagaagccactaacaggactgaaaaaatcgaaccagcagttgagaagtggctgaaagatgttgagaaagtcttacaagaagtgcagacactagaaggaaggattttggaagtacgcaaaagtattttccgaagtcaatgccaatatttccttgcaaaagaaatcgcaagaaaaatagaaaaaatgactcagctcaatcgtgatagcaagtttgacccattttctagcaagactgaacttccaggcatgaaatatcattctttcgaagattttgttcctttcaaatctacagaatcgacttataatgagattttggaagagttaagtgataaaagttttattatgattggactacatggaatgggagggtcgggaaaaacaactttggtgaaagaggtgggtaagaaagttgaggagttaaaactttttgagaaggttgtgatggcagtggtctctcaaactccaaatattagaagcatccaagagcaaattgctgataagttgggtttgaaatttgaggaaaattcagaggaaggtagagcacaaagactttcaaaaagattaagtgaaggcaaaactcttctaatcttggatgatgtatgggaaaagttaaattttgaagctataggtattccattcaatgaaaacaacaagggttgtggagtacttctaacaactcgaagcagagaagtatgtacttctatgcaatgccaaagtataattgagctccatctcttaactgacgaggaagcctgggatttgttccaattttatgccaaaataactgatgactcctcagctgctttaaaaggtgtggcaacaaaaattgttaatcaatgtaagggattgcctattgctattgtgacattaggaagcacactaagggggaaaactttagaagagtgggagttggcattgttaagactggaagattctaaaccattggatattccaaaaggcttaacaagtcctcatgtttgtcttagatcaagttatgataatttgacaaatcaattagcgaaatccttattattgttgtgttctatatttccagaggatcacgaaattgatttggaagatttatttcgatttggaagaggatggggcctaattgggacttttggaactttggagaaatcaagaaaggagatgcatgtagctattaatatcctcagggattcttgtttgttgttgcataccaaaattaaagaaaaggtgaaaatgcatgacctggttcgtgatgtagccttgtggatagcatctgaaagcgatcgagaaattttggcaggtgctgcaatggatccaacaatcttggtacagggtggtaacataaaagataagaaagcaatatccttatggaattggcgaaatggtcagcttcctgatgatcaattgaattgtcccagacttgaaattctcttgcttcattctctatatgatggctttgaagtatcaaatgcgtgtcttgaaaggttgaaaatgctcaaaatcctagcattcttaggatctggttacgagtggattgcagattatgctgaaagaagtaaaactttgttactgccacagtcatttgagtcattaaaaaatcttcatactctgtgcttgagaggttataaattaggtgacatctccattttggaaagcctacaagcacttgagattcttgacttgcgttggtcttcttttgaagaattgcctaatggaattgtagcattaaagaatttgaagcttttagatttgttctgctgtaagattgagaaagataatgcttacgaggttattggggaatgtttgcagctagaggaattgtatttgtatttactccaatctaaaaagaactttccacaaaatgccatattctcaagattgcgaaggtatgttataatacaatttactaaagaatctgatcgatacttcttcttcttccagtggtcttacttttttagaaaacagagaccatcaagagttttatgcatagaaggttttaatgcctcagttcaaagttttatatcattaccaatcaaggatttctttcaaaaagcagagtaccttgaattgaggcaccttaagggaggttacaaaaatgtaatcccatccatggatccacaaggcatgaatcacttgattttcctaatcctcgaatattgtccagagataaaatgcgtctttgatggtaccacaatgcaaactgaagatgcgttctccagcctagtcattttacgcttgtatgaattggataaccttgaagaagtgtttcatgacccctcttccagatgctctctcaaaagtttagaagagctaaccctagagagttgtagacaattgtacaatatttcctttcccaagaactcaaagctatgccatctcaagtccttgagaatatataattgcccgatgctaacttgtatcttctacccatccattgtccaaactctagagctgctagaagaagtgagaatatctgaatgctatgaattgaagcagatgatagaagaagtggaagaagggagtgttgattatgttagcagtcaaagtcatacctctttgatgctcccaaaattaaggacacttactattcatggatgtcgcagcttgaaatatatattccctatgtgttatgctcatgggctagcaagtttggaaaaacttgacattggattttgtgataagttgaagtatgtatttggcagtgaaaaggaacatgatcttagagtgtaccagcaccagagtcatcctcagactaatattcacatcaatttgggagctctatggttgaatgacttgccgaatttggttgagatttggcctaaatattttgatccacatttaccaaatttgaaagagctacgatgctattattgtccaagactgcctgactcttgggtgcgtagggtgatgattattgattcagatctgcaacaagactcaactgcaacggagaaggaattactatgctcggttaccaccacattcaaccaattatccgatcaagtgctttcttctaaacttacacatcttcaattgcatggtcttggagtaaaaggtcttttccaattccaaatcagagaacatgggagcaacagagaacttgctcctttaaacttggatctaatttatgctgaattgagtgatctacctgagctcgagttcatatggaagggccccacaaattttctaagcctccatatgcttaagtggatttttgtgcttgaatgtccaaaattgaaaaccatcttctcccctaccattgttagaagcttaccaatgctgagatcactgcatataattgattgtgagaaattggaacaaatatttgattcaggtgatgcacaaagcctatatacttgttcacaacaagtgtgcttcccaaatctcgaggatatttgtgtcaaaaagtgcaacaagttgaaatacctttttcataattttgtggctggtcactttcacaatctgaccttgttggagatagcagactgctctgagttacagaaggtttttgcttttgaatgtgaaactgatgacgatggtcaagaagggattgttaagggtggagaaaatgtactactacataacctgcgaactataacactctgcagtttgccaaactttaaagagattcaccatggattcaagttaaaagatgatgttacgcgacatgacataaatgattgtcctaaatattctccaagtttatatctatactga

SEQ ID NO: 34110 - DNA, 3573 bp, Glycine max
  Peptide Sequence Number=SeqID_125795
atggaggatttcgttctttccatcgtagcaaagatggtagaatatgcagtagatccaattttacaccatgctggatacttgtgttgtttcaacaactttgctaggaatcttagaaaagccaaagaagaattggaattgacccaagacaacatgaagaaacaagttagagaagccactaaaaggaatgaaaaaattgagccaatggttgaaaagtggcttaaagatgctgagaaagtcctagaagaagtacaactgctggaaggaagaatttcagaagtaagcaagtgctatttcagtaggagatgccaatattttctagcaaaagaaatagcaagaaaaacagagaaaatgactcaactcaatggtaacatcaagtttgagccattttctaggcttaccgaacttcaaggcatgaagtactattcttccaaaaattttgttcttttcaaatctatagaatcaacttacaacaagcttttggaagcattaaaagataaaagtgtttgcatgattggactatgtggaatagggggctcgggaaaaactactttgacaaaagaggtgggtaagaaagctgaggatttacaactttttgagaaggttgtaatggtaactgtctctcaaactccaaatattagaagcatccaagaacaaattgctgatcagttagatttcaagttaagggaggactcaaacataggtaaagcacgaaggctatcagagagattaagaaaaggcacaactcttgtaatcttggatggtgtatggggaaagctagactttgaagctataggtattccactcaatgaaaacaacaaaggttgtgaagtactcctaacaactcggagcagacaagtatgcacttctatgcagtgccaaagtataattgagctcaatctcttaactggagaggaaccttgggctttgttcaaattgcatgcaaacataactgatgactcccttgatgctttgaaagtcgtggcaagaaatattgttaatgaatgtaagggattgcctattgcaattgtgacggtgggaagcacgctaagggggaaaacttttgaagagtgggagtcagcattgtcaagactagaagattcaataccattggatattccaaacggtttaacaagtcctcatgtttgtcttaaattaagttatgataatttgacaaatcaatttgccaagtccttgttgttgttgtgttctatatttcctgagaatcatgaaattgatttggaagatttatttcgatttagaaggggactggagccatttgggacttttggaacaatggagaaagtgaggagggagatgcatgtagccgttaacatcctaagagattcttgtttgctgatgcacaccagtaataaagagaaggtgaaaatgcatgatatagttcgtgatgtggccttgtggatagcatctgaaaggggtcaaccaattttggctagtactgcaacggatccaagaatgttggtagaggatgaaaccatacaagacaagaaagcaatatccttatgggatttgaaaaatggtcaacttcttgatgatcaattgaattgcccaacccttcaaattctcttacttcattcttcaaaggtcaactttgaagtatcaaatgtgtattttgaaaggatgaaaatgcttaaaatcctggcattcttaacatctagctataagttgaagttgtctaggtttgagagacggtacactttgtcactgccacagtcaattgagtcattaaaaaatctccatactctatgcttaagaggttatgaattaggtgacatctccattttggaaagactacaatcactggagattcttgacttgcgtggttcttgttttgatgagttgcctaatggaattgtagcattaaagaaattgaagcttctagatttgtacaaatgtcagattgtaaacaataatgcttacaaagttataggaggatgtttgcagctacaagaattgtatttgcatttatacccacatgtaaaggaattcccgcataatgtttctttctcaagattgcggaggtatgttataatacaacatcatgctgaatcatacccactacaccagcagactgacattttggaagagcatagacttggtagagctttatgcattgatggttttaatgcctctgctcaaagttttatatcattaccaattaaggatctctttttaagagcagagtaccttcatttggagcgccttcgcggaggttacgaaaatgtaataccatcctttagagatccagaaggcatgaatcaattgattgttctaatactcaaattttgtccagagatagaatgcatctttgacaatactatcattaccaacaccaatgtgttctcttgcctagttaccttaggcttgtatgatatggatagcctaaaagaagtgtttccaaggaactcaaagctatgttgtctcaaggtcttgagaatagaaaggtgcccaatgctaacttccctcttcatgccatccattgtccaaactctagaggtgctagagaatctagaaatatcttactgcagtgaattgatgcacataataaaagaagttgaagaagggtatgttgactatgttagcagtcaaggtcatacctctttgatgctcccaaaattaaggagacttgttatatatggatgtgacagattggaatatatactccctatgtattttgcacgaaggctagtaagtttggaagaactggggattcgagattgcaacgagttgaagcatgtatttggtagtgaaaaggaacaccatctttcagtgtaccaacaccagagtcaccatcagactaatattgacataaatttgtatactctttggttgggttcattaccaaacctcgttggaatttggtttgattactgccatacatgtttgccaaatttgaaaaggttagactgcactgagtgtccaagattgtctaattttcctatgcataaggcaatgattgattcagatctacagcaagacacaactggaatggagaatgaaatactatggctggttgccaccacattcaaccatttaggcgatcaaatgttttcctcagaacttaaagttgtcctcaaatctagataccttgatttgtctcatcttggagtaaaaggtctttttcaattccaaatggtagaacttgggatcaatggagtgcaagttcccttaaacttggatctatctattcttgacttgactaatctacctgagctcaagttcatatggaagggccccacaaattttctaagccttcaaatgcttgaaattattcgtgtgtatggatgtccaaaattgaaaaccattttctcccctgccattgttagaagcttaccaatgttaagggaactggatatattgaactgtgaggaattagaacaaatatttgattcaagtgatgcacaggaactcaaaagcctatatacttgttcccaacaagtatgcttcccaaaactctacgaagttaaagttcaagaaaagtttttgcttttgaatgtgaatatgatgattatggtcaagaaggaactagcaaggatggagaacaagtactgctag

SEQ ID NO: 34111 - DNA, 426 bp, Glycine max
  Peptide Sequence Number=SeqID_125796
atggctgagattggcagctatcatgctgccatgctccactccctaatgcccattgcaaagtgtttcacaggaaaatcaaccattcttagattgctattcagattctttgatcctcattctggaagtataaagatagatgatcaaaatattcgggaggtaacccttgagagtttgcggaagtccattggtgttgttccacaagatactgtacttttcaatgatacaatatttcataacattcactatggtcggctatcagcaacaaaagaggaggtctatgaagctgctcaacaagcagcaattcataacactatcatgaattttcctgataaatattcaactgttgtgggagagcgaggactaaagggtaagaaggggtatgggattgctaatctcaacttgctggaccagacacccccaatgtag

SEQ ID NO: 34112 - DNA, 2355 bp, Glycine max
  Peptide Sequence Number=SeqID_125797
atggaagcggtggcggaggggctatggggactcgccgagtaccacgagaagagaggggaaatagggaaagcagtgaagtgcctcgaagccatatgccaaagcgacgcgtcgtttttcccaatcgtcgaggtcaagactcgtcttcgcattgccacgcttctccttcaccattctcacaacgtcaaccacgccaagtcacacctcgaacgttctcaattgcttctgaagtctattccgtcttgcttcgaattgaagtgcagagcgtacagcttgctcagccagtgttaccatctcgtcggagctattccgccgcagaaacaggtcttgcacaagggactcgagctcgctgcatctgtaggatacgagatttcaatgaagttgtggtcttgcaactttaattcacagcttgcaaatgctttatcaattgaaggggactaccagggttcaatctctgccttagagtgtggatatgtctgtgctactgaagtatgcttcccggagttgcagatgttctttgccacttcaatattgcatgtccgcctcatgcaatgggatgatgataatttggttgagcaagctgttaatcgatgcaaccagatttgggaatcaattgctccagataaaaatgctgcacctcatgtagacaatctggatgctgccatgaagattgatatgcagcaaacacaacgtatacaagagctagtgaaggagctcaatactttagaccaaagtctctcccgatctgaccttcactacagggataggacagcattatctaaaaagcaaacaatgattcaggagcaactgcaaaacatgactggattgagttcaattgggcaggaatcactgcaaccagtatattttgggaatgtcagaaggataataggagataagcttcagttagcacctcctcctattgatggtgaatggcttcctaaaagtgctgtctatgcattagttgatctaatagtagttgtgtttgggcgcccaaaaggactttttaaggagtgtgcaaaacgcatacagtctgggatgaatataattcaagatgagttactgaagcttggaattactgatggtgttagagaagtggatttacaacactcttctatttggatggctggtgtgtacttaatgctactaattcagtttcttgaaaacaaagtggctatagagcttacacgagcagaatttgttgaagcacaagaggcatgtgaatgcatctttgagatgcttagaggccaatatgctcattcagttggctgttatcacgaagctgcttttcattttattgaagcagtgaagcttacagacagcaaatcaatgcaagcaatgtgccaagtttatgcagctgtctcttacatctgcattggtgatgctgaatcttcttcacaggcacttgatttgattggtccagtttatggagtaatggattctttcgtaggagttagagagaaaacaggtgttctttttgcttatggtcttttattgatgaagcaacaggatctacaggaagcaaggaatcgtttggcaaggggattgcagctgacacatacgtatttggggaaccttcaatttgtttcacaatatttgacgatccttggtagtttggcccttgcattacatgacactgtacaagccagagagatattgagatcttctttgaccttagcaaagaaactttatgatattcctactcagatttgggtgctatctgttttgacagccttatataaagaattaggtgaaagggggaatgaaatggagaatgctgagtatcaaaacaaaaaattagaagatttgcagaggagacttgctaatgcacatgcatccatttatcatattgaaatagtaagttcacctcgacaaagaatcgttcaccaattaaacgatttggacatcaagcgtgcaatggccgacccaactatgggagtcaatcttgatatccctgaatctattggtctgtcagcacccttatctgctccatcatcatcaaggctagttgatatagacaccagaagacgtccaagtgggttgaagagtttagcagatagggtttccacttaccagcaagggggagggggagtcaggatcgccatgctggaggatggggtcttccacaagatcctgcaagatctggttatgcatgatagcgtcaaggtaggcatagtggcccttgctaagagatcaacaagatctggtgggagcgaaaaggaaaaagcagaagagggagaggttgtagaggagggtggcggtggaggactccgagaagaggcaattcttgaagttgttgagcattttgcagccgtagccctcgaacacggcaacgaagcaagcgtagcagagcttctctag

SEQ ID NO: 34113 - DNA, 345 bp, Glycine max
  Peptide Sequence Number=SeqID_125798
catgtttgtgacacttcatcttttatccagacgttggttcggtaccagctgcctgtggtcgtgattgttttcaacaatggtggtgtatatggtggtgaccgtagacgcccagaggagatagatggacctcacaaagatgatcctgcccccacagattttgtcccaaatgcagggtaccatgctttgatagaagcttttggtggaaagggctatcttgttgggacgcctgatgaactcaagtctgccctttcagaatccttctctgctaggaaaccagctgtagtaaatgttgtgatcgatccctatgctggttcagagagtgggaggatgcaacataagaattga

SEQ ID NO: 34114 - DNA, 2478 bp, Glycine max
  Peptide Sequence Number=SeqID_125799
atggcgatctcggagaacgtgctacccttgaagctgttgttttgttccaattgggttccacttgtgagagcatgtggtgcttcatggatccctttgaaggggttttggggtgggtttgatttttgggaatgcattggcaagtgggaggagtggaacatgggggaatgcaataatgataattacaataataataataatgggtttggggaaattgaggatggtggctctgagctagggttccatggacatgaagataatttgatgtttggaatgatggtaggaggggagaagaagtgtttgaattctgagctatggcatgcatgcgcgggtcccttggtgtccctaccaactgcagggactcgtgtggtttatttccctcagggtcatagcgagcaggttgctgccacaaccaacagagaagttgatggtcacatacccaattacccgagtttgccgccacagttggtttgccaacttcacaatgttacaatgcatgcagatgttgaaacagatgaagtgtatgctcaaatgacgttgcagccattgactccgcaagagcagaaggatacatttcttcccatggagttgggcgttccaagtaagcagccctcaaattatttttgcaagacgttaacggcaagtgacaccagcacacatggagggttctctgttcctcgtcgtgctgctgagaaagttttccctccattggatttctcacagcaaccacctgcgcaagaactaattgctagggatctccatgacgttgagtggaagtttcgacatatttttcgaggacagccaaaacgacaccttcttacaacaggctggagtgtatttgttagtgccaaaagactagtggctggagattctgtgcttttcatatggaatgaaaagaatcagcttcttttgggaatacgtcgtgccaatcgaccacaaactgtcatgccatcgtcagttctatctagtgatagtatgcacattgggcttcttgcagctgctgctcatgccgcagcaactaatagctgctttacagtgttctataacccaagggctagtccatctgagtttgtcattccgctttcaaaatatatcaaagctgtgtaccatacacgcgtttctgttggtatgcgtttcaggatgctttttgagactgaagaatcaagtgtccgcaggtacatgggtacaataactggcataagtgaccttgatcctgttcgttggccgaattctcattggcgggcacttttgtctcctttctttacaaatgatcttgttacagatggcagagatgaagcaactaatgggcttatgtggctaaggggtggacctggagaccaagctctcaattccctgaattttcaaggttctggtttgttgccatggatgcagcagagaatggatccaacattacttggaaatgatcataatcagcaataccaagccatgtttgcatctggtttgcagaacttagggagtggagatttaatgagacaacaaatgatgaattttcaacagcctttcaattatcttcaacaatcaggaaaccccaatcttcctttgcagcttcagcaaccgcaagcagttcagcaatctgtatcttctaataatatcctacagccacaagcccaagtgttggcagagaacttgtctcagcacctccagaaatcacacaacaatcgagaagaccaaacacagcagcagcagcacacttatcaagatacggttttacttcaaagtgatcagctccatcagaggcaacactctggtttaccttcaccgtcatattcaaaaccggatttcttagattcaagcatgaagttccctgcttcagtttcgccaggacaaaacatgcttggttcactttgtcccgaagggagtggcaatctcttgaatttatccagaagtagtcagtccatgttgactgaacagttacctcaacaatcatgggccccaaagttcacaccattgcagattaatgcttttggcaactcaatgcaacatgtgcagtattctggaaaagatactgcaatggtgccaccacattgtaacccagactcccaaaatcctattctatttggggtcaacattgattcatctggccttctgcttcctacgactgttcctcgttatactactgcatcagctgaaattgatgcatcagcaatgccaataggagagtctggattccagtctcctctatatccttgcgtgcaagattcatcagagttggtgcaaagtgcagggcaagtcgaccctcaaaaccagacacgaacattcgtcaaggtttacaaatcagggtcagtagggcgctcacttgacatctcccggttcagcagttatcatgagctgcgggaggagttggcacagatgtttggtattgaggggaaattagaagaccctcttagatcaggctggcagcttgtattcgttgacagggagaacgatgttcttctccttggagacgatccgtgggagtaa

SEQ ID NO: 34115 - DNA, 303 bp, Glycine max
  Peptide Sequence Number=SeqID_125800
atggaggagttgattaacaaaacacaactttcttctaaaataatcccaacatcatcacgtcggcttggtggctccacaaagaatctcacttcctgcaccctactgcagttattctgctcccacgaacatggttcgcgatcatcacagggaaactgtgcaataagtgtcgaggccaccctgtcgtgcaccgtaactccccccatggtgattagcctaggccacaagggagttcccaaaccgagtgatacacccctagtacaagtactcctcctcacaaggaactacaagtacatactgccatag

SEQ ID NO: 34116 - DNA, 84 bp, Glycine max
  Peptide Sequence Number=SeqID_125801
atggctcagggatggtggcctgagatgatgcatcctgtacctattgagaaggcaaggttcctggccaggataccttctcaatga

SEQ ID NO: 34117 - DNA, 381 bp, Glycine max
  Peptide Sequence Number=SeqID_125802
atgactagaggcaatccatctgacttacaaccctttgatcctaagatagataggacatttcatagattatttaggcatcattttataccttttgatcattctgagcattccattactggtgaatctgtgcattttgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatgccttgcag

SEQ ID NO: 34118 - DNA, 339 bp, Glycine max
  Peptide Sequence Number=SeqID_125803
atggtcattctgtgtctcgctgcccaggctcgaacatgtccaactaaacgcagagacaaattatggttccgctggcagggaggttcactggccgaatggtgtttcgctcgaacgaaattagtgtcttatctttacttcccttttatctccaataaaagacaagtaaagaggggcaactgtcataccctaatttcgtccggggaccatttgttgttgggatgcgaccctcatttgaccacttcgaggtacttggcacctatcgttaggaaattcgtgaagttctgggacgtgccggaagtcaaaagaaagcattgtagcacaatccgtgaagttccatga

SEQ ID NO: 34119 - DNA, 318 bp, Glycine max
  Peptide Sequence Number=SeqID_125804
atggaagagagcctctcgcctttccttgtgagagatttcgacacgcaaagtttcaagattatacaaagagtccacaaggcgtgggaaagcccgttaaggaaagataaagaacttaggggcatccgtaatggcatcatcggtggttatcatgaatggctgagagtcatacacgaggagcccttgaacaagaaaccaagagggctcgcaaggaagagcatggccgagataaattccgaggagctttgtggggcagcaacaatgagctcaatctccagagagaggaaagagaccagtcacgagtacatggcatggtcttaa

SEQ ID NO: 34120 - DNA, 141 bp, Glycine max
  Peptide Sequence Number=SeqID_125805
atggttccccgcatgtcatcaggcccgccgcctctcgatgacaaagggtcagtatcacagagattgtgggatggccgaaaaaagcgaggctcttgctcctacgtatcctcaatttgtgatgaggaactcagacctacgtag

SEQ ID NO: 34121 - DNA, 514 bp, Glycine max
  Peptide Sequence Number=SeqID_125806
ggatcgcacccacaagatacctagtggacccagaggagtccaacagggcactggggtttccaactttggttacgggcctctgtcaatcctacaaggtgcccgtcccccccaacaagggatcgcacccgcaagacacccaatggacccggagaagtccaacagggtcttggggtttccagctctgattacgggactctgtcaattctacggagtgcccatcgcccccagcaaggtcatcaggcctcctactaaccgagctttcatcaagaagtactgcgcccctaggcaggcacagggcgagacaccacagcagccaggggatggccggcagcaggcaacagacaaacagccgccacctccagagcccctcagctcatctacaacggctggagcgttgcctatgacccgtggccgaccagtaggcgaccaagtccaaagccaaaggaaagcaaaagtacccgtgaccaacaagtcatcacgcgttcggctcaagatattaaagaagcgctactag

SEQ ID NO: 34122 - DNA, 159 bp, Glycine max
  Peptide Sequence Number=SeqID_125807
atgtgggatcgacacaaacttcaaggagcactcaaaccgggtgtatttacccccaagacctacactccaaagagtccgtcaggacctctccctccagattcagctcacatcacaagtaatgtcacatcaagtgttaatcacacacttattcacaactaa

SEQ ID NO: 34123 - DNA, 625 bp, Glycine max
  Peptide Sequence Number=SeqID_125808
tttccatgctctttctacggaggaggcaagatttttgctgacagagttgctcgaggccccgcggtggattgtcgcagctcacacttatctgctgcaccttgtcggttgcactctttttgctaataagagtgcaacatacgtgcatgtggttcaccttgacgctttccgggaccttgctcagagtggtggttacgcttggggagttgccgcgctggttcatatgtatgaccagttagatgaggcttgtaggaccaccacccgacagcttgcggggtacttgacgctacttcagtgctggatctatgagcacttccctagtgtgcaccaatgtgtgacagatgatacataccaggagacgtccccacgtgcttcccggtggttgacgtcgaaggcacacatgaaggaatcacaggagcaccttacagggcacgttgtgatggagatttcatcattccagggtcagctgagatggggtcctatggtggtcacagctcgaccggagagggtgagcatccctccgccgcctgttggtgctcgattgtcacacgatgagatagatgacaggtggatgcagtttgcggagcacttactacctgcgggtcagctttgtctagtgcctgagcag

SEQ ID NO: 34124 - DNA, 537 bp, Glycine max
  Peptide Sequence Number=SeqID_125809
atgaccactcttacatggatatggatgacgttgctatttagcaacattctgcccagcgaccacaatgccaatctccccctgcagatgtatcagttgggatcgcgcccacaagacgctcagtggacccgaagaagtccaacagggccttggggtttccagctctggttacgggcctctgtcagtcctatagggtgcccgtcccccccagcgaggtcatgccatcgtgacataggtaaggatcgtgcccacaagacacccagtggacccaaagaagtccaacagggccctggggtttccagctctgattatgagcctctgtcgattctacggggtgcctcgttcccccagcaaggtcatcgaggccctaagtatacatatgggttctactatatcgagctttcatcaagaagtactgcgcccccaggcaggcttgcagggcgaaacaccccaacagccgtggggatggccggcagcgggtcaacagacgctctgccaccacctctagagttcaccttagctcatccacaaaaaggttag

SEQ ID NO: 34125 - DNA, 390 bp, Glycine max
  Peptide Sequence Number=SeqID_125810
atgccgcgctggaaacataccgcaaggttgcggaggattgcagaaggaagtattaccgctcattttaattctgaattgatagaaatcaaagaacatagtgttgtatttaaagataaaaacggagagatcaatgaaattcaaaatgactttgttctcgctatgaccggatatctgccggactttggtttcctgatcaatgcaggaattgagctacagggagaatgtctcaatcctgtatacgaccctgaaaccatggaaacaaatattcaaaacctctatcttgcaggcgtggtttgtggtggaaaagacacgcatttatggtttattgaaaactcaaggatccacgctgatatgattataaagaatatcctaaaaacaagggaacattga

SEQ ID NO: 34126 - DNA, 117 bp, Glycine max
  Peptide Sequence Number=SeqID_125811
atgcccagggcactgaattccacagcacaccagagtgcctatttcaagaaaagagctctggaggcaggtttcttctgtaatggctggctaaacacccttgttggggatttctactga

SEQ ID NO: 34127 - DNA, 273 bp, Glycine max
  Peptide Sequence Number=SeqID_125812
atggcagaaatcaaccaaggtaagacgatgactggtcacgattggccgcgtatttttgtttcctacttacaggtacatagggacagatcgagtggggctagggtcacgaccgaccgatcgttgccccttcccggtgctaaacaagcagagaacgtcactgcaaggcagcccagccttaggcctaggttgtgttctgaagcaatggggcatgccacattgctcccattctcttgcaatttacgtccaaacatgcacccaccaagtgctcggtga

SEQ ID NO: 34128 - DNA, 303 bp, Glycine max
  Peptide Sequence Number=SeqID_125813
atggtgaagaaacaaaaattcataggacatcaagaagcaggatatcctcctaatgacatatccagaagagataatccagtctacatccttagttcccttcttgatgttttgctactgaagaaggacataacaaacagctgcatttatgaatcggccaacgcgcggggagaggccggtttgcgtattgggcgctcttccgcttcctcgctcactgactcgctgcgctcggtcgttcggctgcggcgagcggtatcagctcactcaaaggcggtaatacggtttatccacagaatcaggggataa

SEQ ID NO: 34129 - DNA, 215 bp, Glycine max
  Peptide Sequence Number=SeqID_125814
ggaacgcgcctgcaagacacctagtggacccggagaagtccaacaaggtcctggggtttccagctctgattacgagcctctgtcagttttacggagtgtctgtcacccacaacaaggtcattaggccccgtgttaaccgggctttcatcaagaagtactgcgcccccaggcaggcgcagggcgagacaccacagcagcattgggatggccggtag

SEQ ID NO: 34130 - DNA, 228 bp, Glycine max
  Peptide Sequence Number=SeqID_125815
atgtgtagcgccgtgagatgttgcaacatcggcggtgatggagttacagtgtcgggacagatgtcgtacaggatgtcacgacatcatgcttcagaacatgcagtttatgtgtgtccgtatgaacagattaaacaagtaaataacacaagagaattgtttacccagttcggtgcaacctcacctacatctgggggctaccaagccagggaggaaatccactctcaatag

SEQ ID NO: 34131 - DNA, 54 bp, Glycine max
  Peptide Sequence Number=SeqID_125816
gtggatgactatgaagaacctgatgctagaggacatgagaacacaatgctttga

SEQ ID NO: 34132 - DNA, 351 bp, Glycine max
  Peptide Sequence Number=SeqID_125817
atgccgacgccatttgcatatcaaagcaataaggttgttccgtggaagtatatccctcccgcatttggagaaagagttgcaaccgaagttgactccctatcagccaaggtaaccaacatcaccggcctcagtggcgtaacccacagtggccgggtgttcgctccccctcactcagcagaattgccctccaaggggaaagcgcccatgctacaagagcccacagacgtagccaccccctcaaaagaagtggatcctccgttggtaaagggggctgaaaagaaagaaggaaaaacggtgactttggaagaggctcatgagttccttcgcctcatccaacaaagcgagtttaag

SEQ ID NO: 34133 - DNA, 250 bp, Glycine max
  Peptide Sequence Number=SeqID_125818
atgcctttcaagcccaatgtttgtgatgaggacatgaccaagagcaagggcaagaatccacttgaaggacttggaggacctatgacaagggctagagcaaggaaagccaaggaagctcttcaacaagtgttgtccatactatttgaatacaagcccaagtttcaaggagaaaagtccaagggcccaattggcaacctaggcatcagccttttgggagaccaaatggtggctgacttgttggctgttgggg

SEQ ID NO: 34134 - DNA, 495 bp, Glycine max
  Peptide Sequence Number=SeqID_125819
atgagttctggttcagtcaccaaagcaccaccaccctcttcttcttcatcacccaactcttcctctgagtcccttgatggcttgaagtttggccagaaaatctactttgaggatgtgagtgttgcagcaacaacaacaactcaaggggcctacaaaacaagtcgtgtggtttcttccccttcttctgcttcaaagaagggaaggggtggttctttgcaacctcctaggtgtcaggttgagggctgcaaagtagatctgagtggtgctaaggcttactattctaggcacaaagtttgtaccatgcactccaagttccctactgttattgttgctggtttggagcaaaggttttgccaacagtgtagcagctggcttgctatattgggtaattctacttctgctttggtttcctttcctcatcttacttccattgtttttgctatttttagtgcatttgctatactgctatgctattcacatgctcttgttttttag

SEQ ID NO: 34135 - DNA, 279 bp, Glycine max
  Peptide Sequence Number=SeqID_125820
atgagggagatatgtttgaagattagggatgaaggaggctcaagaacgagggtaaggctacgccgcatgactggtttcgtgggtatttatagaggaggacgaagtgtaatcgattacaaggtatatggtcaagaaagattccatagtcagaaagttgttgcttcatccataagatttgtacacaacaactgccggcagaaatatattccgcttctacagtggataaagcaacactattttgtttcttactatgccaagaaactagagcagatccaatga

SEQ ID NO: 34136 - DNA, 348 bp, Glycine max
  Peptide Sequence Number=SeqID_125821
atggcttctatgatggaggccatgctaggaatgaggcaactcatggagaaaaacgtggccaccactgccgctgtcagttcggctgctgaagtagatccaactctcctagctaccgcgcatcatcctcccccaaacacagtaggacgagagaagagtacacaggggcacaacatcaaccctcgtttgggatacaatcgggtggcttacccttatggattgtcgcctaattacacgccgccagtcatgcacgatgacgtgggtcatgtctcttcccccatccttgaaagggagcctcctcaacagccccacgaggcccatgaagatcatcaagagcatgcccaaggggat

SEQ ID NO: 34137 - DNA, 285 bp, Glycine max
  Peptide Sequence Number=SeqID_125822
atgtctctgaaaaagctttccgcgaaaagatctaggagggacgtcgcggctgaagggaccagtgccggccccgagtttgatagccaccgtttcagagcaccgagcaccagcagcgtttcgaggccatcaaaggatggtcgctccacagagagagatgcgtccagctcagggacgatgaagggagtgcgggacatgcagtcatgggtgaggggtcaatggattccctttgacgcagatgccttcagccagttcctgggtgacccgctagtgttggaggaaggctag

SEQ ID NO: 34138 - DNA, 882 bp, Glycine max
  Peptide Sequence Number=SeqID_125823
atggaaccgattgcatccctttcccagtattatgaccagcccctaaggtgcttcacgttcgaggacttccagctagtgccaactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctctcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcgcacctttttctccaagaaggtaggcccgtctatccgctacaaggtcaccgctcgattctatcttcatgcgaaggatgtcccatgagaggagtgccatcagacgaaagcatcacgcctttcatcgcacggggtttcagtgaccacaacgtgaggtactccaaggagttcgcaaggcatgggatgcggcgtgaagaaaggacagagagcttaggggaagcaactgtgagagacgatgaggttaaagcttcggaagaaagtgatgaggtacaagccctaaaggcagagcttgaaagagcccgagtagtcgaagagaagttcaaggcagcaatagtaagctcaagctccgaagaggtgaaaggaatcatcacgggtcaaaggcatgatcttgaaggacgagctaaaggcttaccttag

SEQ ID NO: 34139 - DNA, 201 bp, Glycine max
  Peptide Sequence Number=SeqID_125824
atgagggcttctgagggatgggtcactggtaatcgattaccaggacgcttcagcgcactgtggagtggatactaccacgcctactcatatcgtctagtggagcccgtccaagtgatcgaggtgacgtcattcgaggaagaccctgaggaggatcccgaggagctacctcctgagcttgctgcggatgctcttgacttctag

SEQ ID NO: 34140 - DNA, 294 bp, Glycine max
  Peptide Sequence Number=SeqID_125825
atggagagaagtatgatagatgctgccagtggtggagcccttggagacatgacccctgctgaagccagaaatttaattgagaagatgatgcaatcctaccccccaagggtattggatagaagactccaagaggctcgggctagagctactaaagaaggccttagggttctcatgaaccttaggggcattttgagtagtctttgtagtaggaactttttctgtattttcaagtattttgtcaaggagcttttcaaggaagttttgttaagaaagcttctcaaggaagctacctag

SEQ ID NO: 34141 - DNA, 675 bp, Glycine max
  Peptide Sequence Number=SeqID_125826
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggcaggcgctgccctatcggcggccgcgtaatggaagggcgtgcgatgatggcgatcatggcaaggcgcgaacgcggctggagaccggcccgttgatcaccgcctattgctccaattgcaaatccgtcgagattggcgatctgtcgcagaccgccgcatttccggatgacgtcgtctggatcgacatggtcgagccgacgcgcgaggaagagctctacgtcgaaaaagtgatcggcatcgaagtgccgacccgcgacgacctcaaggatatcgaaccatcggcccgtctctatggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 34142 - DNA, 546 bp, Glycine max
  misc_feature (5)..(5): n is a, c, g, or t
  Peptide Sequence Number=SeqID_125827
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccatagagacgggccgatggttcgatatccttgaggtcgtcgcgggtcggcacttcgatgccgatcactttttcgacgtagagctcttcctcgcgcgtcggctcgaccatgtcgatccagacgacgtcatccggaaatgcggcggtctgcgacagatcgccaatctcgacggatttgcaattggagcaataggcggtgatcaacgggccggtctccagccgcgttcgcgccttgccatgatcgccatcatcgcacgcccttccattacgcggccgccgatagggcagcgcctgccctgtagcctaacggaaacggatgggatcctctag

SEQ ID NO: 34143 - DNA, 120 bp, Glycine max
  Peptide Sequence Number=SeqID_125828
atggcgttggcttgggcgctgcccgggggaaccttcttctcttccgactgcatgcaaatttgtggttcttccctccctcctatggacacttcaagctgcccccagtccatgaaccgctga

SEQ ID NO: 34144 - DNA, 441 bp, Glycine max
  Peptide Sequence Number=SeqID_125829
atgacccaagagctggtagcctgcggagacaccttacggttatccgcacctcgattcagtgaaagtgtgattgatcgagcagaggccaatatggtcatctgcaccctttccgaagatgtacatcttctggtggagactttttcaagtctcacaagttatccagaactacaggctggtagcccgatgatacgcggagataccttatggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 34145 - DNA, 183 bp, Glycine max
  Peptide Sequence Number=SeqID_125830
atgggaaatgcaatgagcttgctaagcgagcatgctgcgctaagcgagttcatcagtactcattgtgtatataggcgttctcagaagaactcgctaagtgcgcctactgcgctaaagttggtgccgctaagtgcagcctttaaggagcttagcgcatatccttgcggtagatgttcagcttag

SEQ ID NO: 34146 - DNA, 186 bp, Glycine max
  Peptide Sequence Number=SeqID_125831
cttaaatcgaaatggtctggaccatttaccatcaagaaagtctggccatatggagtagtggagctttgtgatcctcaatctaaagatcctgataggacatgggtagtgaacggacaaaggttgaagcaatatcatggtggagctatggaaagattgaacactattctacacttcaagctagaataa

SEQ ID NO: 34147 - DNA, 180 bp, Glycine max
  Peptide Sequence Number=SeqID_125832
atggataaactgagagccaagagaccagcgaaacctgtagataggcatatgactgagacaagtatgcgagcggggaatgcctctgtgtatggattgcttaagccacaacctatacagagatataggcaattgcaatttgaatcaaaagattatattaagaaatggatgcaaaattcatag

SEQ ID NO: 34148 - DNA, 198 bp, Glycine max
  Peptide Sequence Number=SeqID_125833
atggcttttgtggatgattgggtgatgggtaatgagaagggccaatattggctgagtgatgacattgttgggctggtgggaagtttggccatactcgcttcgatcctttccccagtgaagaccaaatccgcaaagcttaaaggtgcgtaccccaccattgggatcatctctttctccatcattggaggtgccacttga

SEQ ID NO: 34149 - DNA, 300 bp, Glycine max
  Peptide Sequence Number=SeqID_125834
atggggtacttttccgagcatggatgggaatggaatttctcttggagacataatctatttgatagcgagatgggggtagcatcaaatttcttagagactattgctgctatcagaatatgtggtaccctgaaagatacctggctgtggggagctgaacctaatggcatcttctctactaaatcagcctacaacctcattaaagcagagcagcttttggaagatcaagattcgggttttcaccagctttgggatcttaaagtcccccctaaggttctgtcttttgcttggaggctgctctag

SEQ ID NO: 34150 - DNA, 291 bp, Glycine max
  Peptide Sequence Number=SeqID_125835
atggagccactgaaaatgaggacgcgtagccttctaaaggtgagggcgtgcagccctctgcaggtgaggatgtgcagtcctctgatggcgaggacatacagtcctctaaaggtgttaggtactagtacccaagggtccacctttatgagaaagcaagagatcgactcatcgagagggccgattgactgtccttttgaaaaaggtgataattcatgcaaccctatcctatcttttgcaaatctctccgggaactccctcagagtgtatgttctgtttgatttagtcacttga

SEQ ID NO: 34151 - DNA, 384 bp, Glycine max
  Peptide Sequence Number=SeqID_125836
atgaactccatctgtcctcctctagaaaaagtgaagaccaagggtgctccaaaaaaaccacttgccaaacaacaaaagtcaacaaaacgcgatccgtcttattgggagtatgttgatgctttacactttatgcaaaatactgcgttattgggtatgggtgaagaatcgtggtcattggtgaggaaccatctgcataaagaactgactagttggtctgatgagtatatgaacctggttggtggcatagagagatttgaggaattaaagcgttctctacttgcagacgacttatctaagcttaccatggacaagtggatgaatattacggatatgggatacgtcattacttcacgatacaatgtgatcgttgtttctctttcatga

SEQ ID NO: 34152 - DNA, 198 bp, Glycine max
  Peptide Sequence Number=SeqID_125837
atgattatgaggggccaagacatttatagtagccaagatgaggctacttcttcaccttcctctagtgaaagtgaagaagcaaaaggggaagaatctagtgaagaaatctacccccaagaaaaagaacaacctttaatggtattattaggcatcaaaccctcttttgtaaaatcactcgtgcacccaacatcttcatga

SEQ ID NO: 34153 - DNA, 691 bp, Glycine max
  Peptide Sequence Number=SeqID_125838
cagctacacccagggacaatactatctggcgagtttcgccaataaaatttggctctcgccgcagggtgaagtcgacctgcacggctttgccaccaacggcctgtattacaagtcgctgctggataaactgaaagtctcgacccacgttttccgcgtcggtacttacaaatccgccgtcgagccatttattcgcgacgacatgtcgccggctgcgcgtgaagcggacagccgttggatcggcgaactgtggcagaactatctcaacaccattgccgctaaccgccagatcaccgcgcagcagctgttccccggcgctcagggcgtgatcgacggcctgcgtaaagttgatggcgataccgcgaaatacgcgctggataacaagctggtcgacgagctggccacctcgacggaagtggaaaaagcgctgactaagcagtttggctggagcaaagcggataacaactatcgcgccatcagctactacgattacaacgtcaaagcgccaactgaacagggttcggcggttgcggttatctttgctaatggcgccatcatggacggtgaggaaacgccgggtaacgtcggcggcgacaccaccgcggcgcttatccgcgacgcgcgcctggatccgaaagtaaaagcgatcgtcctgcgcgtcaacagcccgggcggcagcgtcagcgcctcgtag

SEQ ID NO: 34154 - DNA, 240 bp, Glycine max
  Peptide Sequence Number=SeqID_125839
atgaggacgcgtagccctctaaaggcgagggcgtgcagccctctacaggcgaggatgtgcagtcctctgatggcaaggacatatggtcctctaaagattgactgtccttttgaaaaaggtgataattcatgcaaccttatcctatcttttgcaaatctctccgggaactcccttagagtgtatgttctgtttgatttagtcactttaccattttggagtgacggcaatggagccgtttga

SEQ ID NO: 34155 - DNA, 519 bp, Glycine max
  Peptide Sequence Number=SeqID_125840
atgaatttccatgccatctatctacacttgagaggcaattccacatcatatattcatttgggaagcattctcgtgccattttcgccatggatttttgaaatgcattatttgctatacattcacactttgcaagcttgggttcctaggcctagaatcgcattcgggcacttattttatcctctacgtgttgtcctcatacatataaatcagccccacagtccaaagttcacaaaaccatgctcatatgtcgttgaggcatttcatcgagcacttggtgggcgcatgtttaggcatgaatatcaagagaatgggggcaatgtggcatgccccattacttcagaatgccccctaggcctaaggccatcccttacaacccctcaattcaacaaaaacaagcaacaattcaaggataaatccctcacgttttttagcaaatacatgcaacttagagtaccaaaatacatcaatggaaagctagagagcccaagaatgaggtacttacttgttggagatgaataa

SEQ ID NO: 34156 - DNA, 255 bp, Glycine max
  Peptide Sequence Number=SeqID_125841
atggtaggtcagggaggcagagcattggaaagtatgggcggcccccattttgtgcaggtccagagcaagcattcctttccaccatatggcttgcctcccaactatacaccacccaatgttgcatacgctcccgatgagaatgtcgataactctgctcccatacccattgagagccaacaacctcaatctggtcatgcacaggtccctcgacccccatgggagagacacatgaagtaccttgagaccacactctag

SEQ ID NO: 34157 - DNA, 186 bp, Glycine max
  Peptide Sequence Number=SeqID_125842
atggtaatcaattacagctttgtaaatcagtttgaaaaacaatgctggctattggtaatcgattactaccttctggtaatcgattaccagaaggtttgtcatcatcaaaaagggggagattgtagaagcaagcttcatgatgatgaaccaaacaattttgatgatgccaaaagcccaagtgattga

SEQ ID NO: 34158 - DNA, 449 bp, Glycine max
  Peptide Sequence Number=SeqID_125843
gaccttcaacaaagctcttctcgggaagtagagatgggatttgtttcaccaaagcaaggagttgatttgatggcggtgacccatgaccaacaattcaataatgtacttcaacagggaacagtatggagggtgggcaacggggataaaattcgtttctgggaggattgctggactggaagcgcatgggaatggaacctctcttggagaaggcccctatttgacaatgaggtagcctcggctgtaggttttctggaagatatatcacacactgcactccaacaatatgcagcagacagcagggtatggaaacctgaatccaatggatactattcttctaagagcgcctacattctgctgcaagggaactcagaggagggaaacatggatgatacattcaaggacttatggaagctgaagatcccagctaaagcatcaattttcgcttggag

SEQ ID NO: 34159 - DNA, 297 bp, Glycine max
  Peptide Sequence Number=SeqID_125844
atgtctcctccacctctaggacctctcaatcactcacaaactcagctcatgctctcaggacggcttccttttccagctctggtctctgcaaatcttcacacaacaaaatctctcaaactctctggaatttggacctctctttctagaactgaagacatgcaagagatcctcaagaaaaatggccaaactccccctctaaatatgattttaggcttaaataggtggctttgttcgtgctcgtgcgattcttcctcgcgctcagccgaggagggttgcgctcagcagatggctcgctaa

SEQ ID NO: 34160 - DNA, 358 bp, Glycine max
  Peptide Sequence Number=SeqID_125845
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaagtgtagaagatgagtctagtggctcgtgtactaccgaatttggtaccgagctcgaattcgtaatcatggtcatagctgtttcct

SEQ ID NO: 34161 - DNA, 411 bp, Glycine max
  Peptide Sequence Number=SeqID_125846
atgtcgcggaacttcacggattgcctaacaatgggtgtcaagtacctcgaagtggttaagcgaaggtcgcatcccaacaaacagatgggcctcgtagataaaccttctgggggtcatcacgtcgttcaaaggcttggacctgcgcggcctacccgactcgacggcattaaccgctccccctccatgattggcaagcgggcactgttcggtggagtggccctcgagggaaagttccttatcgcgttggaaccggcgccaaagtgggcattgccggccgggcgagtcggggttggagtcgtagcttggggggtctccctctggattggcggaggcaccctagcttgtattggtgctgagttggaagattccccgacgcgagttgagaagctcgggttatgttgtgcatactga

SEQ ID NO: 34162 - DNA, 318 bp, Glycine max
  Peptide Sequence Number=SeqID_125847
atgaacaagattagaaatggtcaagataaaggaaagtggataacaactaatgttcgagcagccttggacgaacattggggttctacaaatttcctaaacaagagctccactgccaaggtgaatcgatctgttgatagaggagtgataagaagagttgagaggagacaccacttcaaggagaagatgagtctagaagaagctcaccaccataggaggtcatggataagagttttgaggaagaaggagatgaatgaagggaaagggagagaagagcacgaaattttttgctctaagagagctctgaactttgaagtttaa

SEQ ID NO: 34163 - DNA, 732 bp, Glycine max
  Peptide Sequence Number=SeqID_125848
atgtcttcaatcgctgaaaatccagattccgaactatcgcaacctaaatcaggctggaaacttttctgccgtctcgccagcggagagataacgccgggacgtgcctggcgtaacccggcataccgccgcaagtttattttacgttcattgatgaagccatttgccaccgcgcaattattaaacgacctggcgcgtcagcctcagcttccggccatgcttaacgtacagccgggtttaccctgccgactgcatcgtccctggttgtcggtaaattgcagccaacagcagattctggatgcgctcaatttccactatcaagcgatgagtgaacaattgacgccgctggcgctaaatgggtatttatcacgtgcgggaaccctgctggcgactatcagcggtaaagacgatcggcagtttcgtattgtgctgcgcgctgagccgaatctcgataaggaaggcgaagccacgctaagtttcgtgacagaagaagatatcgtacttgccgaactcacctttacgctttgtcgactggaaggcaaacgcgtcatgtggattggcgggcttcaaggtgccaaagcaaatgtatcgcatcagttgatacaagatgcgactaaagcctgtcatggactgttcccgaaacgactgctggtggaagcggcgatgtcaatggggcaatcattctctgttgagcgcctgcaggcagtgagcaataccacacaggggatcctctag

SEQ ID NO: 34164 - DNA, 102 bp, Glycine max
  Peptide Sequence Number=SeqID_125849
atggctaatgttttccttgccggaaatgttcgatcggcgtcatcggatgatgcttccgttttaaacctcgatcgcttaaccttccatgccgacgtcggctag

SEQ ID NO: 34165 - DNA, 177 bp, Glycine max
  Peptide Sequence Number=SeqID_125850
atggggtcgaaccaagcacattcttttaagaaaagggtgtcatcaagtcaaggtcaagtatggaaattaatggtagcggaatggagatggaagaatactgattggaaatgccacttcaaggagaagatgagtcaagaagaagctcaccaccataggaagccatggataagagcttga

SEQ ID NO: 34166 - DNA, 525 bp, Glycine max
  Peptide Sequence Number=SeqID_125851
atgatttcaagattgagtcaagaacaattcaagaatcaagagaaagtttcatcaagaagattcaagattcaagactcaaagattcaagaatcaagagaagattcaatcaagataagtattaaaaagtttttcaaaacattgagtagcacaagcagttttttacaaaatcattaccaaagagttttactctctggtaattgtcataccctaatttcgtccggggaccattgtttggcgccatgcaaccttcgcttgaccgcctcgagggttgcttatggaggaagcaacccagctcgcctgggcgagctgggcggaaacctcctcccccattttcctataaataggcgaagggaggttgttccgaatatccctaacccccttggctatgcatttcagctgttttgggtgaaaaaaattatttccgtgaagaaaatccaagtcgaggtgcttccgagacgtttctgtgagaaaatccgtgaaggttttccgtcgttcttcattcgttcttcgttcttcaatgggtaa

SEQ ID NO: 34167 - DNA, 300 bp, Glycine max
  Peptide Sequence Number=SeqID_125852
atggcatttgggttgaaggtagctcgcctaggcgagctgagctcacccaagcgagctgataactttattctgaagcaaccctgctcacccaagcgagctggttacttcatcatgaagttgtctagtcctatgaaagataaaggtgaggactttgagtcctacgaaggcataaaagtgaggactttgagtcctataaaagatgacgtgaggactttgagtcctatgaaagatcaagtgaggactatgagtcctataaaggcgaggactttgagccctatgaaacaagccaatgggcactag

SEQ ID NO: 34168 - DNA, 798 bp, Glycine max
  misc_feature (18)..(18): n is a, c, g, or t
  Peptide Sequence Number=SeqID_125853
aactcatgttcccaccanagagaagcatgttggaactttcttcacaagatgcattgttggcacagaacaagctattagctaagcagctgaaatcactcactgagacactcagcaagttgccaacacaattacaagcggctcagccctcttattcaactgtcatgcaggttagaggctatagtatttgtggaggagctcatgaatccgactgttgtataacccaagatgaggtttctaaagaagggcaaggttggaggtcacatccagggaatcagttcaataaagaccaaggaggaccttccaacagatctctgaatcaagggcctaacttgtatgagaggaccactaagctgaaagaaactttgtctcagtttatgcagaattcttttggaggttttggagctaatactgagaaaaatcctaaggaagaatgtaaggctgtcatgaccagaagcaagaaggagaccattgtggaggataagagtaggactaatgaggaaaaggagttagaagttgagggagaaaaagaaaatgagggaaatcagataaatgagagaaaaataaatgatgaggaggaagaaaaaaatgaaaaaaagagagatagtgaggaagagaaaaagactaagagtgagttggcaagagagaaaaagaaggaggctgtcccaagttccggaaaagaagcaccatatcctttgaaggattggagaaatggaagtcctaccaacaagaatgacactgcaattagcggatcgctcaatcacaaggccatatggtatagtggaggacgtgttggtcaaa

SEQ ID NO: 34169 - DNA, 549 bp, Glycine max
  Peptide Sequence Number=SeqID_125854
atggacctcatcaaggctgctggactgctgaagactgtcagcaagttgggagattgctatgaaggcttaatcagggaattcattgtcaacattccctctgacatatctaacagaaaaagtgatgagtatcaaaaggtgtttgtcagaggaaagtgtgttagattctcccctgctgtgattaacaagtatctgggcagacctactgatggagtgatagatattgctgtttctgagcatcaaattgccaaggaaatcactgccaaacaagtccagcattggccaaagaaagggaagctttcagcagggaagctaagtgtgaagtatgcaattctacacaggattggagctgcaaactgggtacccaccaatcatacttccactattgccacagaatcttttgctgtcaaattacccattgccttccctactgtgttgtgtggcattatgttgagtcagcatcccaatatgttaaactacactgactctgtgatgaagagagaatctcctctatccctgcattacaaactgtttgagggggggatcctctag

SEQ ID NO: 34170 - DNA, 273 bp, Glycine max
  Peptide Sequence Number=SeqID_125855
atggaaaaaaattccaagaagactctccaactcttagatgctacaagtgcaaccaacttggtcacatcaaagcaaatttcccctcaaacgagcaatggcctgagaagaataagaagaaaagtcatgaagaaagaagatccagtaagacatatattgcatgagatgacaataattcatccgatggttcggagaaggagattaaccttctatccaaagactatgagagcgatgagaacatctctcaagaagactaagcaaaaagcaaaagtctga

SEQ ID NO: 34171 - DNA, 333 bp, Glycine max
  misc_feature (67)..(67): n is a, c, g, or t
  Peptide Sequence Number=SeqID_125856
atgggcgatattaacgcctcgatccccacgccgcagccggtgcattaccgcccgatgtttggcgcgntgggtgccgcgcgccacgccacccggctgacgtttatctcccaggccgccagcgcgaacggcgtcccgcagcagctcaatctgcaaagcgccacggcggtggtgaaaggctgccggacggtgaagaagaccgacatgatccacaacggtttactgcccaatattaccgtcgattcgcaaacctacgaggtgcgcgttgacggtgaactgataaccagcgaaccggccgacgttctgccgatggcgcaacgctatttcctgttctga

SEQ ID NO: 34172 - DNA, 177 bp, Glycine max
  Peptide Sequence Number=SeqID_125857
atgaagaaagtagacataaatgagaagagcacaaaaggaaaaagtgttgagtttgtaagattgctgaatgaacccatggtaaccattcagtctacatcttactgtattggcacaatagattcaaaagctggttcagtccttatgcgtgtggcagcaatacgttcaaaaacttcttga

SEQ ID NO: 34173 - DNA, 228 bp, Glycine max
  Peptide Sequence Number=SeqID_125858
atgagggtggtagaggaccaagtatttgggatatctttaaccataaatatccagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34174 - DNA, 303 bp, Glycine max
  Peptide Sequence Number=SeqID_125859
atggggtcgtttctaaaatatttgcagcatggggcagttttttacgtggaaacggttgcatgcaagacccaaaccgccattgtcaatggcgagtttggtgtcaaccctaaatcgccagtcctaatggcgatatgtggaagccatagggaaccgccagtcaaactggcgagttccatggtacaggctacaggaggtttttgcaggggtgcaggagcagcttttcagaaaagggagttgcaactgccattggcgagttgcctgcaagttgcaactcccattggcgggttgcacaagaagaaatag

SEQ ID NO: 34175 - DNA, 159 bp, Glycine max
  Peptide Sequence Number=SeqID_125860
gaacgtggtacgggtcggatgattggcgtaggacatgaatctcatggtctttactacctcaagcctaatctttcttggcgcagggcattttccatcagtcctcttgtcctcatactcctcaacagaatggcattgccgaaaggaagaataggcatctag

SEQ ID NO: 34176 - DNA, 210 bp, Glycine max
  Peptide Sequence Number=SeqID_125861
atggaagaagatctcaagaagactctcaagttcttagatgctacaaatgcaaccaaattggccacatcaaagcaaattgtccttcaaatgaagaatggcctgagagaagcgataagaaaaggaatgatgaaagaaggaccaagaaagcctacattgcatgggttgacaatgactcatccgacggttgaaagaaggagatcaaccttctaa

SEQ ID NO: 34177 - DNA, 554 bp, Glycine max
  misc_feature (549)..(549): n is a, c, g, or t
  Peptide Sequence Number=SeqID_125862
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggcatcatgtcatggtaccctgtcgcaccaagggcaattgcatctcacctggctgttacacggctagagcagctcttttttgcagccaaaatcgtggaaaatagtggccaaaatcgttatgttgtcttgaataattgttatgatctgggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcanaggcg

SEQ ID NO: 34178 - DNA, 336 bp, Glycine max
  Peptide Sequence Number=SeqID_125863
atgtgttctccacttgcctccactcctcctcttcctcctcttcctccaccttctcctccttctcctcctcctcctcctttggacgcatcggctttgccgtctactatgaagcgtacacgcaaagcttcacgtttacgatcgttgtccactagaccacctggtgctgagagaccagtggtgcttgttgatcatgctaccgggaaggccgacggtccccacaggaagaaattaagaacatatctggggattgtggcgcgtgataaggtggacatcacctacgagaactggaaggaggtccctattgctcagaaggacctgatttgggaggatattcag

SEQ ID NO: 34179 - DNA, 453 bp, Glycine max
  Peptide Sequence Number=SeqID_125864
tcaacaacccaagtagatgtaccctctacttgtaccacaaaggatgtaccctccaatgtgttaagacaaagatctcaagcggttaaacctttgatactttgtgaatggggatacaaaagaattctcaggcgggagaagggagacacaaaagaattcagacagttagtccttcattcttttggaaatgggagaagagagacacaaaaagaattcaggcgatctcaggtggttaaaccattgatactttgtgaatggggatacaaagattctcagcgggagaagagaatgaaaaggatgaatagcacaagttttcaaggtttagaaaaccagaaaacttcagaaagcttttggtacaaagaagaagaagatgttcaaagagattcaaggcttgtaaaggattgtaatgaaatgattggaaaagtattcaagattgttgttagaaagattgattga

SEQ ID NO: 34180 - DNA, 168 bp, Glycine max
  Peptide Sequence Number=SeqID_125865
atggcgaggacgtgtagtcctatgatggcgaggacttgtaatcctctgaaggtgaagattgactgtccttttgaaaaagctgataattcatgcaaccttatcctgtcttttgcaaatctctccgggaactccctcagagtgtatgttctgtttgaattagtcacttga

SEQ ID NO: 34181 - DNA, 246 bp, Glycine max
  Peptide Sequence Number=SeqID_125866
atgaccacatttaaggttcccaacaaaacactcactatcctaagggaaaaattgcctaaaattattacacacaaatggaagtttggtaagctattggaggctcccaacacacttctaatgaaaggcctttttgtttcaaaatttgaaagcaatgcagtgcttcttagtccaatagctcttaaggtggttggacccttgcttcttgactcaaaactttcaagggatgacaccaatcctcctttctaa

SEQ ID NO: 34182 - DNA, 620 bp, Glycine max
  Peptide Sequence Number=SeqID_125867
tcataactcttgcaagagcctaagtgaagaacttcgttactattacgaaggaaggcataggtcacatcttagacctcactcccatagaagagaaaaggaaagaaagcctcaagaggctaacattaacctctcatacttccatgggaaggacaatgtagaggctaacttagattgggaaataaaggtagagcaacaacttaaaaagaagtctacttcaaaatcttatggctctctctcttatccaaagaaagacctaggtcaaggcatcttaggggtgacaccttctaatcccaaatatgataaggggaaggcaatagaaaagcaagcccctaaggctagtatgcaagagaaaactagctctataaaccaagatgaggctactacttcgccttcctctagtgaaagtgaagaagcaaaaggagaaggatccagcaaagaaatctacccccaagaagaagaacaaccattaatggttaaggagtataaggaggtaagtgtctcctccaagagcactgccacacctcttgggcttgatattattcctcaagtaaaggagttgttggatgggggtttggttcgtaagagcttaaatccttgtgctttgttggtgcccaaaatag

SEQ ID NO: 34183 - DNA, 114 bp, Glycine max
  Peptide Sequence Number=SeqID_125868
atgatgcaatcctaccccgcaaaggtattggatagaagactccaagaagattgggctagagatgcaagagaaggccctagggttctcatgagccttaggggctccataatgtag

SEQ ID NO: 34184 - DNA, 342 bp, Glycine max
  Peptide Sequence Number=SeqID_125869
atgggtggtggtgcatggccgttcttagttggtggagcgatttgtctggttaattccgttaacgaacgagacctcagcctgctaaatagctatgtggagatgttctgggccgacgcgcgctacactgatgtattcaacgagtctatagccttggccgacaggtccggatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtga

SEQ ID NO: 34185 - DNA, 251 bp, Glycine max
  Peptide Sequence Number=SeqID_125870
gcccacttgggccctccagaatattcctccagaaggctgttgcttctggaggaagcaacctggctcgcctgggcgagctgggcggcaaccacctcccctattttgctataaataggggaggaagtgaagaaggaagggccgaggcgcttccgaaacgtttccgtaacgttttccgtgaggaatttcgcaaaggtttcaaccgttcttcgacgttcttcattcgttcttcatcgttcttcgatcttcaacgg

SEQ ID NO: 34186 - DNA, 285 bp, Glycine max
  Peptide Sequence Number=SeqID_125871
atgaagattgttatctctattccactaataaattgtgattttgatggagaagaacattaccgggacaattgttatttctattctataaataaatccgtctggagacaagattcgaccatgtacaatcattatgagaaaagaagagctcttgatcttgaaaatgtattggcaaacttcatgacatatcaagctagctctaaaggtgattgttattcagcgcaacagcaaggaactcagtttggaaaggactattcttttgaagattatcaatgggaatcagaatga

SEQ ID NO: 34187 - DNA, 294 bp, Glycine max
  Peptide Sequence Number=SeqID_125872
atgttggataaacaagaagctatgggaccagcaaaacctgcagataggtcgaatcgtaaggtcgatgatcccctatatctgatgacatcgaccatcccacagttttttttgaagccattgcaggttatgtgggatgctaccatgttcagggtgtttaatcaagacttccccttgcatctgactgagacaagtatgcgagcgaggaatcccgatgtgtatggattcctcgagtcacagtccatccagagatctgggcaatcacaatttgaatcagaaagttacatgaagaactag

SEQ ID NO: 34188 - DNA, 258 bp, Glycine max
  Peptide Sequence Number=SeqID_125873
atgacggtgaaaacctcggacacatgcagctcccggagacggtcacagcttgtctgtaagcggatgccgggagcagacaagcccatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34189 - DNA, 87 bp, Glycine max
  Peptide Sequence Number=SeqID_125874
atggtgattttccaccatggagatgcaacggaagataaaggagaagaggtagcttccttgagaaaattccttgagaagcttctttga

SEQ ID NO: 34190 - DNA, 612 bp, Glycine max
  Peptide Sequence Number=SeqID_125875
atgaatcaaaaatctgcacctgtcaccagactctgcggtttatgctcctctgccgaccaccacacatacctttgtccttttgtgcaacaatctgaagcaattgaacagcctgaagcttatgctgcaaacatctacaacagacctcctcaacctcagcagcaaaatcagccacaacagaataattatgacctctccagcaatagacattacgttcctccactaatccagcaacaacaacagcaacagccccagaaacaacaaacaattgaggctcctccgcaaccttcccttgaagaacttgtgaggcaaatgactatgacaaacatgcagtttcaacaagagaccagagcttccattcagagcttaactaatcagatgggacaattggctacacagttaaatcaacagctgtcccaaaattctaacagattaccttctcaatctgtccaaattcccaaaaatgtgagtgccattacattgaggtcaggaaaacagtgtcaaggacctcaaccagtagcatcttcctcatccgcaaatgaacctgcccaacctcactctattccaaaaaaaggtgatgacaaaaatttaaagacaaattccaagatatgctaa

SEQ ID NO: 34191 - DNA, 562 bp, Glycine max
  Peptide Sequence Number=SeqID_125876
gatcccttcaagtcagcggctgttaggatccgaaaaaagaatgccgaactaagagacgtcaacatagccaccaccaaggccttagagcaagagaccaagagggccagcaaggaagaacatggccgaaacaagttccgaggggctcagtggggcagtaacaacgaacttaagctccaaagagaggaaagagaccaattgcgattagatggcataattctgaaggacaaattgaagacttgcctaaggtcaaaaaggagtttgtctcagcagttatgtgagaccgaaacaaacatgttggccatcatcagccagtacaaagaagaattaaatttggccaccgcccacgagcacaaagtggcggacgaatacgcccaagtgtacgcagaaaaggaggctagaggaagagtgattgactcattacatcaagaagcgacgatgtggatggaccggtttgctctcactttaaacgggagtcacaagcttccccgattactggcaaaggccaaagcaatggcggacgtgtactccgcccccgaggaaatccacgggctcctcagctatt

SEQ ID NO: 34192 - DNA, 197 bp, Glycine max
  Peptide Sequence Number=SeqID_125877
ttcctcacatcttcaccgtcgggatttgtgagataaaattcacggagagagaaaaaagaatcgcacgaagacagtacaagtggaagcttcaatcccttctctgtctctctgacgtttggaaactctatcgaagcagtcagaggaaaagactcgaggaatctcagggaatcgctagagatgctgctatcactgtctga

SEQ ID NO: 34193 - DNA, 675 bp, Glycine max
  Peptide Sequence Number=SeqID_125878
atggcgaatgaacaccagcaaagagttacccttgaggactattcaagcagtttagtgccgcaattctttaccagcattgcatgtcctgaagaagaagttgttgaaaagtttctgaagaaatatttcccagagtcaaagactacggaagggaaagtggtaatctcttcatttcatcagttccctgatgagtccttgagtgaagcgttggaaagaccacaaaccaagcaactactagatgcttcagtaaggggaaaaataaagttgaagacccctgaagaggcaactgagctaattgagaatatgtcagccagcgatcatgacattttgtgcgatagagttcatcaagccacaaagaaaagcttgttagaactatcatcacatgacgctttattggcacagaataagttgctttctaagcaacttgagattttaacagaaacactcggtaagctcatgaaacaggccaatgtattcccattgaagaacacactcaagaagttcactatatgggaaatcaacagagacaaggatatactcaaggaggattttcaggcttccagcagggtccttttaatgaacaaggataatggagatcacaccctgccaatccaacaagggcctaacatctttcagaggactactaagctggaggagactttgactcagtttatgcag

SEQ ID NO: 34194 - DNA, 300 bp, Glycine max
  Peptide Sequence Number=SeqID_125879
atgcatagatctcccacaggcaattcagttcctctggacttggagattgaagctacattgagaaggaacagagccgagagaagaagaaaattactgcaagacaagacagtagcggttattcttgaggaagaaactcacttttctgattgttcatcatctgattcaccattatcaagggaatctgtgacttatttaccagaagccgtttccatggctgatgagcaccagcaaagggttacccttgaggattattcaagcagttcagtgccgcaattctttaccagcattgcacgtccggaa

SEQ ID NO: 34195 - DNA, 261 bp, Glycine max
  Peptide Sequence Number=SeqID_125880
atgtcatggatgaatatcaaaggcgctttccccttcaacctgaaacagcacttcatgcagcacatttctatccagattgaaggattaagggctaagcgatggaggtattggtggctggcagtaacatggtctatatggaagctcagaaacagaattttgtttgcaaatgcagaatttgatactaatcggctttttgaagaattttgtttgcaaatgcagaattttatactaatcggctttttgaagatgctatctttataa

SEQ ID NO: 34196 - DNA, 453 bp, Glycine max
  Peptide Sequence Number=SeqID_125881
atgtggatggatcggtttgctcttaccttgaacgggagtcatgaacttccccgattgttagccaaggccaaggcgatggcagacacctactccgcccccgaagaaattcatgggcttctccgctattggaaaaataccataactaaacgcgccacaaggcatccctatcgcaccagatccaaatctagaacgatgggtgatcaagaggagacacaggaacagatgaaagccgacatgttggctctgaaagaacaaatggcctccatgatggaggccatgttaggaatgaggcagctcatggagaaaaacgcggccaccgctgccgctgtcagtttggctgccgaagcagatccaactctcttggcaactgcgcatcatcctccctcaaacatagtaggacggggaagggacacactggggcacgatggcaaccctcacctgggatacaactga

SEQ ID NO: 34197 - DNA, 624 bp, Glycine max
  Peptide Sequence Number=SeqID_125882
gcgaaacttgccaaggagaagttcaagttggccgctacacacatccggaaggagtgtgccggattacgggaagagaatgcaactaccgcaagagcccttgaacaagaggccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagctatcatcgccaagtaccaagaagagttaggcctagccacgacccacgagcatagggtcgcggacgagtatgcccaagtatacgcggaaaaagaggctagaggaagggtgatcgactctttacaccaagaggcgaccatgtggatggatcggtttgctcttaccttgaacgggagtcaagaacttccccgattgttggccaaggccaaggcgatggcggacacctactccgcccccgaagaaattcataggcttctcggctattgtcagcatatgatagacttaatggcccacatgattagaaattgctag

SEQ ID NO: 34198 - DNA, 196 bp, Glycine max
  Peptide Sequence Number=SeqID_125883
acacttgttagcactgccacacctcttggacttgaggttattcctcaagtaaaggagttgttggatgagggggttcccacggaccctaagagaataaaggtcattcctgattggccccctccaccaagtgttgagggaaggatcccagagtatgaagaacctcgggatttgatgtcaaatcctttccaaggtggag

SEQ ID NO: 34199 - DNA, 660 bp, Glycine max
  Peptide Sequence Number=SeqID_125884
atggaacggccgatcttgccgaagggcttgcccgaggacattgaagacaagaaggccgttgcccaggcatggttccagcatctgcgcgacaccatcgtcgcctccttcgaaaccctggaaaacgaactgaccggccccttgtccgatcaggaaccgggccgtttcgtccagaaagactggctgcgtgacaatggtgaaggcggcggcggcaagatgtctatgatggaagggcgcgtcttcgaaaagataccgggcgcggaagaagacccgcgcttctgggcatcgggactgtcgctcatcgcccatccggtcaatcccaatgtgccggctgtgcacatgaacacccgcatggtcgtcaccaccagccactggttcggcggcggcgcggacctgacgccggtgcttggccgcaggcggacgcaacaggacgccgatacccagctgttccaccgcgccttcgagatcacctgcaaccgccatcccgtggcggactatccacgatacaagacgtggtgcgacgagtatttctacctgaagcaccgcgacgagccgcgcggcaccggcggcatctttttcgactggctgcatccgcaagagcaaaatggcggctgggacgccaatttcgccttcgtgcaggatgtcggccgggccttcaatctg

SEQ ID NO: 34200 - DNA, 381 bp, Glycine max
  Peptide Sequence Number=SeqID_125885
atggctacacagtcaaactctcctccgcctcctcctccttctactggtgtagcatcgcattcgtcgtcaccaccattgaagcggactagaaaggcctcacgcctaagattattggcgactagaccagttagggcagagagaccccttgtccatgtggatcctgttactctcaaagcagacggtccccacagcaagaaatttagaacatatttagggatcgttgctcgtgataaggtggatgtcacatacgaaaattggaagcatgtccctattactcagaaggatttgatatgggaggatattcaggctgaatttgatatccctgaagcatctgatttaaggacaaaaaagaaaatacttcagactgtggggatcctctag

SEQ ID NO: 34201 - DNA, 282 bp, Glycine max
  Peptide Sequence Number=SeqID_125886
atggcacgcagcgtgtccgcttcgtgcccttattcaagggccctatatgggagagagctaaaagggtttttagtgataatccccaaggtggtcatatctctcttgatggtctctagagtccccagtggagtcgccaactgtcgcaacctacccttcggcaggaaggcgacgtgtgactcgtggatgcgtgttccaagaaaggaatacgcgcggagccgccaccaacgtttatttgaggaaatcatcggaaaaactggaaaagacgggatctacgaactttaa

SEQ ID NO: 34202 - DNA, 153 bp, Glycine max
  Peptide Sequence Number=SeqID_125887
atgccctcccggcttccaactagggaattggcgggtagaggaacgcccagagatccgacgacgagtcccgcgaaggtactaataccggggacccgaccatcgattttgagcaagaagcgtgtcagacggaggatgaagaagatgaagatgtag

SEQ ID NO: 34203 - DNA, 348 bp, Glycine max
  Peptide Sequence Number=SeqID_125888
atggcagcggaatggagaaggaagagagagaggagacgccacttcaaggagcagatgagtctagaagaagctcaccaccatagaaggctatggataagagcttggaggaagaaggagatgaatgaatggggaggaagagaagatgatcaaggggttcccgtgaaccttaagagaataaaggtcattcctgagtggcctactccaccaaatataaggaaaatttggggcttccatgacttaacaaacttttacaaaaggtttgtcccatatttttctatacttgtagcactactcattgagttgctgttaagggaaaaagcccagagtttgaagaacctcgggatttga

SEQ ID NO: 34204 - DNA, 492 bp, Glycine max
  Peptide Sequence Number=SeqID_125889
atgaaggttcatatctcctcaccttcaaaggactacatgtcttcaccttcaaaggactacatgtcctcgccttcaaaggactacatgtcctcgccttcagagggctgcgtaccctcacctttagaggactacacatcgtcacctttagaggactacacgtcctcgccttcagaggactacatgtcctcgcctttagaggactacacgtcctcgccttcagaggactacacgactacacgtcctcaccttcagagggctgcacgccctcgccttcagaggactacacgtcctcacctttggtggactacacgtcctctccttaagaggactacacgtcctcaccttcagaggactacacgacctcggcttcaaaggactacatgtcctcacctttatagggctacacgccctcgccttcagaggactacacgtccttgccttcagaggactagacgtcctcaccttcagagggctacacgtcctcgcctttag

SEQ ID NO: 34205 - DNA, 425 bp, Glycine max
  Peptide Sequence Number=SeqID_125890
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctgtggaccacttcaagaaacaatttgcatatcttgaggagcattacggcaaaggggggactgttactccccctgagaggcaacatgcatcattaccaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 34206 - DNA, 345 bp, Glycine max
  Peptide Sequence Number=SeqID_125891
atgtgggcctttcaaactggtcatcagatcaactgggcccatttagttcggtaccagatgcataaggcattacgggccaatgcacctttgccttatcctcaccttgttactctttttcttcatcatttcaatgttcctttggatgatgaaccatttgtcaaggtcaaaaggtctttctccactggtgctggtgcggttacctcctttggttaccgaaaggatgttgatgatactcgccttgatgaaatggatactcgcattgatggtatggatatgaggatcactcaactagaagatgatatgagcttcaattggcaattctttgatccccaggccgactcttag

SEQ ID NO: 34207 - DNA, 415 bp, Glycine max
  Peptide Sequence Number=SeqID_125892
atggctccgagaaagctttccacaaagagatctaggaaggacgccgcggccgaagggactagtgccgctaccgactttgatagccatcgtttcaagagcgctgagcaccaacagcgttttgaagccatcaagggatggtccttccaccaagagagacgcgtccagctcagggacaacgagtacacagatttcctggaggagatagctcgtcggtgttggacgtcgctggtcgctcccatggccaagtttgatccagatatagttctcgagttttatgccaatgcttggcctatagaggagggcgtgcgggacatgcggtcatgggtaaggggccagtggattccttttgatgcagacgccctcatccagttcctgagatacccgctagtgttggagggagggccaggagtgcgaa

SEQ ID NO: 34208 - DNA, 237 bp, Glycine max
  Peptide Sequence Number=SeqID_125893
atggcagtggtggtggaacaacattattttctccaatacgacattattttccctacgctgtatcaaatctctaaccaacaacagcaacctatcagcctcttgggaagtcataaggaggaacgatgggaatggaactttaaatggaggggaaacttatttgataatgaatctacaatggctgctgaattcctagaggaaacagtagggctagcagtacagcaacaaggaacagactga

SEQ ID NO: 34209 - DNA, 225 bp, Glycine max
  Peptide Sequence Number=SeqID_125894
atgggttctccacctgcctcccctcttcctcctcctccttctcctccttcttcggacgcatcggcttcaccatctgccgtgaagtggacacgcaaagcctcacgtctacgatcgttgtccactagaccacctggtgctgagaaaccagtggtccatgttgatcctgctaccgggaaggccgacggtccccataggaagaaattaagaacatatttagggattgtg

SEQ ID NO: 34210 - DNA, 222 bp, Glycine max
  Peptide Sequence Number=SeqID_125895
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggagatcatatgtatcctctacggaacaatcttgcatgagtcaggtgagactatgggtggcaaagctcactcttcaaatatttaa

SEQ ID NO: 34211 - DNA, 395 bp, Glycine max
  Peptide Sequence Number=SeqID_125896
agcttcggcattcaagtccgagcctctcgatatactacgggactcaatcaaacatccgagtaaaaagttattgtcgtttgaatttgctcagagcttcgataatcaatttcgagcgtcttgatttattacgggacttagtcagacatccgaagcttcggtcttcaatttcgagtgtctcgacatattacgggactcagtcagacatccgagtaaaaagttattgtcatttgaatttgctcagagcttcgataatcaatttcgagcgtctcgatatattacgggactcagtcagacaaccaagtgaaaagttattgtcgtttgaatttgctcagagcttcgatattccatttcgagcgtctcgatatattacgggactcaatcagaccaccgagtaa

SEQ ID NO: 34212 - DNA, 477 bp, Glycine max
  Peptide Sequence Number=SeqID_125897
atggtggcgcgtgttatgctcaggaatggatttgagcccgcaatgggtctaggcaaggactacctcgggaatgccgatgtggtcgatatcaagggaaatccatacaagtatggattagggtatgaacccgggatgccggggaggaggaacgtgccgtcaagatttcgggcggatagggtatggcccggccgtattagccagcgtttcaccagcgctggaatggtgtccgaggaggaggtggcagcaatagaagaggagttccctcaagacccaccaagttttgtgcaaccatgccacctcgatttccaagtggggaactggcgcgtgataagccagtcagaagtctataccgctgattcaatatatgagggtcgattctttgaggaatctaacaacgagggtttgacaatcgatttcgatcgagatataagccaaacaataaacgaggaaaaggaagaggacgtcctgtcaccatga

SEQ ID NO: 34213 - DNA, 198 bp, Glycine max
  Peptide Sequence Number=SeqID_125898
atgaacacatctttaaagcatactccgcacagtgttggcctctttgggaatgaagcggcaattcctccttctgatgaggcatggacactaatccctgacccaactacaattcgtgcgaaaggtcggccaaaatcaacaaggatacagaataagatggattggttttgttcaatgtatttacttgttggtcttcaatga

SEQ ID NO: 34214 - DNA, 290 bp, Glycine max
  Peptide Sequence Number=SeqID_125899
gggagaagcttgccgcccagctcgcccaggcgagcaaggttgcttcctccagaagcaaaagccttctggaggaatcttctggagggcccaagtgggcctggggtcagtggatttcctttgacacaaatgccctcagccagatcctgggtgacccgctagttttggaggaaggccaccagtgtgagttcagtcagaggaggaacagggctgacgggtttgacgaggaggccattgcccagctgttatgcacaccggggcagggttttgcccggaccgctgtaaggaggagg

SEQ ID NO: 34215 - DNA, 258 bp, Glycine max
  Peptide Sequence Number=SeqID_125900
atgagagtcgtcattgcgaaaagggcaggacggacgaaatcagtgtcctatctttgctttcctcttatctccgatgagaggcttgcgcgttccgtgaaattccgtaatgtggcggaagtcgaaaagagcttcctccagaaggctgttgcttctggaggaagcaacctggctcgcctgggcgagctgggcggcaagcatctcccctattttgctataaataggggaggaagtgaagaagaaaagggttcagccccttag

SEQ ID NO: 34216 - DNA, 384 bp, Glycine max
  Peptide Sequence Number=SeqID_125901
gaaccagccatgtacaactatcatgagaaaggaagagctcctgatcttaaaagtgtattggcagacttcatgacataccaagctagctctaaagagtatgcagagattgaagcacatcaagaaagcattcttcaagataccacaatccatcatcaattggtcaacaaagaagaaaaggatgaagtctccagtactccagaatatccctgcatggcaactactggctatgttgtagggaaagataaaggtcatttggaactcagtgtggaggatcagaaaatctcttttgacctctttgaagccatgaaacactcagatacgggtgatgcctatgttgaagaagaagaggtggatcatgaaatagcattatcagcttcaaccatg

SEQ ID NO: 34217 - DNA, 255 bp, Glycine max
  Peptide Sequence Number=SeqID_125902
atgcccggaaagagtgtgtcgagttacgagaagaaaatgcagctaccgcaaaagcccttgaacaagaaaccaagagggctcgcaaggaagagcatggccgtgataaattccgtggagcattgtggggcagcaacacgtttgtgcgagacagagaccaacatgttagctatcatcaccaagtatcaagaagaactaagcctagccacaacccacgagcatagggtggcagacgagtatgcccaagtgtacgcataa

SEQ ID NO: 34218 - DNA, 1179 bp, Glycine max
  Peptide Sequence Number=SeqID_125903
atggccccgaggaagcttgcctcaaagaggtcctggaaggataaggcggccgaaggaactagttccgctcccgagtatgacagtcaccgctttaggagcgctgtacatcggcagcgcttcgaagccatcaagggatggtcatttctccaggagcgacgcgtccagctcagggatgacgagtatactgatttccaggaggagataggtcgccggcggtgggcatcactggttacccccatggccaagatcgatccagaagtagtccttgagttttatgccaatgcttggccaacagaggagggcgtgcatgacatgaggtcctgggtgaggggtcagtggatcccgtttgatgcagatgctatcggccagctcctgggatatctgttggtgctggaagagggccaggaatgcgagtatggccagaggaggaaccggtctgatgggttcgatgaggaggccatcgcccagttgctatgcataccggggcaggattttgcccggactgctgcagggaggcgagtgcgaattatgcgcaccaacatgaccaccctgactcagatatggatgactttgctgctcagcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctttggatccagataagtccaacagggccctgggatttcccgcactgatcacaggactctgccagtcgttcggagtccccgtggcacctaccaaggtgattcggccacccatcacccgggcttttattgagaagtactgcacccagagacaggctcagggggatgctccacaggccgcgggcgcgccaccaccacctcatcaggctagcccggctgggtcatttgacatggagcagtatttactgcatttggtttgccagcaggcggccaaccaccgggcacatgtacagacccatgattgtctgtaccagctgagcctcagcatgcagagccagggcttcgcttctttttcatgccctactccagaccaattcagggcagaggtcgcatggcccggggattggcccgaggcccaagcaggagaggcgcccccagaaacattgggttga

SEQ ID NO: 34219 - DNA, 765 bp, Glycine max
  Peptide Sequence Number=SeqID_125904
atcgtcgatgatatgacggacacgccgagcaacaagagccaagaatgcgtcggacagggcgcggggaatatcgcctcggcactgatcggcggcatgggcggatgcgccatgatcggacaatcggtcatcaacgtaacatctggtggtcgaggacgtctttcaacgttcgtggctggttctttcctgctgtttctgatcgtcgtcctcaacgatctcgtccggatcatccccatggccgcactcgttgcagtcatgattatggtttccattggcactttctcttggcggtcgatcctcgacctgagacgccatccgcttccgtcatccgtcgtcatgctggcgacggtcatcactgtcgtcgcaacacatgatctggcaaaaggcgtgatcgttggcgtcctgctgtccggcatctttttcgctggcaaggtagcccgtctgttcaaggtcacgcgtctggagaatcccgaacagaccagtgtcacctatgcagtagttggacaggtcttctttgcgtcggcagaagcctttatccacgctttcgacttcaccgataagggcaaacggatcatcatcaatctcgcaaaggcccatctctgggacatcaccgcaattggcgcgttggacaaggtggtattgaagctccgtcaggcgggcaacgaggtcgaggttctcggattcaacgaagcgagtgctgatatggttgatcgcttcgcgctgcacgacaaggatgagcggctcgcggcaagcgccgcactacactga

SEQ ID NO: 34220 - DNA, 596 bp, Glycine max
  Peptide Sequence Number=SeqID_125905
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccaacggtcaatagtaccatgattctcaaggaagtattcaacctggaggtatccatccggctaccccatacaaaacctctcaggctagggtcagaagcaacaaaatactacagatatcaccacgaccagacaatcaccaagcaggagcaagacctgcaggacggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 34221 - DNA, 168 bp, Glycine max
  Peptide Sequence Number=SeqID_125906
atggacgaagatcaatgggcatattacagtgcgatgtccgaagaagttgatatggattttcaaaatgaagaagattgtggtgtgaatgaagcacatgttgattgtttagatgcttttaatacttctcaggtctttgaaacccgagaagatgttttgaagtgggcatga

SEQ ID NO: 34222 - DNA, 467 bp, Glycine max
  Peptide Sequence Number=SeqID_125907
atggtggtcccgggaaacatcttccagtccccgttcccaaagtggtataaccctagtgcccaagcttttggaggacgtaaagaccccttgaaggtttatctacaaggccttgcaaaaggtgggcatgattccctgcggcgggcgcagagaagactcttgcttaatgcatccggtgagagggaggaggaacaacatgtatacatgcagtcggcagatgaagaaggacctaaaaagcctaaacccttggtaatacacttcaccaggaacacgactccccaaagacctcaacacccctcagcagtgtcgggcggtagatctattccatttccttacgagaacaaccgcgcagtttcgtggaggtatgcccctccgagcagtaggaaggaagaagctaccgatatcagctcactatcggccaaagtgaccaatatcaccgggctgagcggcataacccacagcgatcgcgt

SEQ ID NO: 34223 - DNA, 598 bp, Glycine max
  Peptide Sequence Number=SeqID_125908
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgttcgagactagtttgttcacttggaggagcttgttccgtttacttgattcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34224 - DNA, 159 bp, Glycine max
  Peptide Sequence Number=SeqID_125909
atggcttcctatggtgtggcatctccaatcatctttcttccttctctatttcgctgccatgatcttctagaagcaaaggactccattgatgaagaagatccaaggcctacaagctccacatggagctacatcatgtggtatcagagcatcttcatctag

SEQ ID NO: 34225 - DNA, 253 bp, Glycine max
  Peptide Sequence Number=SeqID_125910
atggcgagccaagagaagtggggcccgtttgtagatattttagctttgttgatttttggggttgtcctctttccgaacgttgacggtttggtagacatcaagcttatcgataccgtcgacctcgagggggggcccgtcgggaaacctgtcgtgccagctgcattaatgaatcggccaacgcgcggggagaggcggtttgcgtattgcgcgctagcggagtgtatactggcttactatgttggcactgatgagg

SEQ ID NO: 34226 - DNA, 405 bp, Glycine max
  Peptide Sequence Number=SeqID_125911
atgaagagagagaaaggaatcgcacgaagacagtatatatggaggcttcaatcccttctccatctctctgacgtttgggaactctatcggagcagtcgaaggaaaaactggaggaatctcagggaactgctagagattccgttatcgctgtcagaacacactgtgattccaaaaattattcaagtgttggagtttgagaatattatgattagatttgaggggttggacctgaatcaggagggagaggccctgacgaactcttcggagtataggccttgggagtcacctgatttgagtgctcctttaagtctgtgccgatcccacatggttggagcattctcgcaaaacagcatgaccctgactattctccctatgattttacttagtgagagtaacctaacatag

SEQ ID NO: 34227 - DNA, 351 bp, Glycine max
  Peptide Sequence Number=SeqID_125912
atggcaaaacctatatctaaaaagggttcgcgtaaaaatgtacgtattggttcgcgtaagcatactcgtaaaataccaaagggagttattcatggtcaagctacgtttccacaatactattgtacacgaagggggacaccttttgccgctcaaactgcagcaggaaatgctattcgaacagtatcggatcaaggcatgcaacgagcagaagtcatgataaaaggtcctggtctcggaagagatgcggcattaagagctattcgtagaagtggtatactattaaattttatacgagatgtaactcctatgccacataatggatgtagatctcctaaaaaaagacgtgtgtaa

SEQ ID NO: 34228 - DNA, 449 bp, Glycine max
  Peptide Sequence Number=SeqID_125913
tacaatctaaatcccttaacgaggatccattggagggcaagtctggtgccagcagccgcgttaaaaagctcgtagttggaccttgggttgggtcgatcggaccgcctccggtgtgcacccggtcggctcgtcccttctgccggcgatgcgctcctgtcctaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 34229 - DNA, 441 bp, Glycine max
  Peptide Sequence Number=SeqID_125914
atgactgagacaagtatgcaagaggggaattctgatgtgtatggattccttgagccacagtccatccagagatatgggcaatcgcaatttgaattagaaagttacatgaagaactggatgcagaatttaaaacgggatgtctacctaggagcctacctgaatgggccagacaactacctaaaaggaataattagcagtgctttgaaaggacttgacgatactccacaacctaaatccaaggctggtgctagaaaaaaaggaagcactaagtgtggctattacgtgatgcactggttgtcaactataatcttaggaagtttcaagaataattgggaaacgataatttattttaatgatgctagaccattggaatcagagagattgaaggcgcttcgcatccagtgggcaaagtattatctgaaagttagaaatgaaacttag

SEQ ID NO: 34230 - DNA, 96 bp, Glycine max
  Peptide Sequence Number=SeqID_125915
atgggcagaatcatcttaggccacagtcagatgtcgagaccagttgacagcggaagtcaaccaaggtacttagggatgggggcaaatgggggatag

SEQ ID NO: 34231 - DNA, 673 bp, Glycine max
  Peptide Sequence Number=SeqID_125916
atggccgtgacaaatttcgtggagctttatggggcaacaacagtgagctcaagcttcgaagggaagagagagacccaatcacaagcacatagcatggtcttgaaagaggagttagctgcttgctcaaggtccaaaagaaacttgtctcagcgtttatgcgagacagagaccaacatgttagccatcgtcagcaagtaccaagaagagctaaatctagccacggcccacgagcataaagtggcgggcgagtatgcccgagtgtacgcagaaaaggaggctagaggaaggaaaaacgccataactaaatgcgccccaaggcatccctatcgcaccagatccaaatctaggacgatgggtgaccaaaaggagacacaggaacagatgaaagccgacatgtcagctttgaaagagcaaatgccttccatgatggaggccatgttaggaatgagacaactcatggataataacgtggccaccgctgccgctgttagtttgaatgctgaagcagacccaactctcccaactaccgcgcaccatcctctcccaaacgcagtaggacaagaaaggagcacactggggcacatcagcaaccctcatttgggatacaaccgggtggcttacccttttggattaccacctaattacacgccaccagtcatgcgtgatgacgcgg

SEQ ID NO: 34232 - DNA, 342 bp, Glycine max
  Peptide Sequence Number=SeqID_125917
atgaccatgattacgaattcgagctcggtaccctatctggttcttgaatgcttagccgagcgaactcttgctgatcattatcaaatcatgatgtctggtggtgatgtttctaactggatacatatgttgctgcctttggctttggaaagaggaacttgcataattaccaatatgggtgcaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34233 - DNA, 273 bp, Glycine max
  Peptide Sequence Number=SeqID_125918
aatgaccaaacttggtctctgcttgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttacgcacggggaaggggagaaacgttaaggcgttggaccattaacgatctcttgtttttgaaaggagagaaacgttaa

SEQ ID NO: 34234 - DNA, 411 bp, Glycine max
  Peptide Sequence Number=SeqID_125919
atgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggggctagacctgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 34235 - DNA, 828 bp, Glycine max
  Peptide Sequence Number=SeqID_125920
atggctacctcaccaaaagaaactgcagcttctggttcacccgctgtaccatcatctccgcaccaggaacaaccagagttcaacatccaacccatacaaataattcctggtcaagcttcagtccctgagaaactggttcccagaagacaacagggagtgaagatttctgaaaaccatagccttgcaacaagtcctagggaagtagacacggagatggacaagaaaatccgcagtattgtgagtagcattctgaaagatgcttctgtgcctgaagctgatgaagatgtcccaacatcgtccaccccaaatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaggcagaaagggaaaaacccccattaagaggtctggacgaatcaagactatggcccagaagaagagcactccagtcactcctaccacatccagaagaagcaaggttgctatcccctccaagaaaaggaaagaaatttcctcatccgattctgatgatgatgtcgaactagatgtctcgacatctaagagggccaagaaatctggaagaaaggtgcctggaaatgttcctgatgcaccattggacaacatctctttccactccattgggcatacttgcggttga

SEQ ID NO: 34236 - DNA, 195 bp, Glycine max
  Peptide Sequence Number=SeqID_125921
atggtagcaataatcccagccaaggttcctcaacctccatttttcagacgatatgactcgaacgcaacatgtgtttatcatggaagagttctagggcattccgttgagcattgtaggactctgaaacataaggtgcaaggtctaattgatgcagttggtttgtttgctcaagcgacctgcgctcctgagttttaa

SEQ ID NO: 34237 - DNA, 351 bp, Glycine max
  Peptide Sequence Number=SeqID_125922
cacaattttgttcaagagaatttttcaaagaaaaatcttttaccaagagttttacactctggtaatcgattaccagagggcagtaatcgattaccagtagccaacattcttttcaaaatgatttacaaagatgtaatcgattgtagaagcaagattcatgatgaatcaagattgattccaggagttttgatgataacaaagatgatgacaaaaagctcaaaagtcaaagatcacttcatgataacaaagatgatgacattcaagattgagtcaagaacacttcaaggatcaagaggaaatttgatttcaagaatcaagaatcaagattcaagattcaagattcaagaataa

SEQ ID NO: 34238 - DNA, 174 bp, Glycine max
  Peptide Sequence Number=SeqID_125923
ctccaagtagagcttgtaggccttggatcttcttcatcaatggagtcctttgcttctttaagatcaatggcagcggaatggagaaggaggaaaggtgattggagatgccacttcaaggagaatatgagtcaagaacaagctcaccaccattggaagccatggataagagcttga

SEQ ID NO: 34239 - DNA, 496 bp, Glycine max
  Peptide Sequence Number=SeqID_125924
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34240 - DNA, 468 bp, Glycine max
  Peptide Sequence Number=SeqID_125925
atgccctcaccttcaaaggactacacatcctcgccatcagagggctacacgccctcgctattagaggactacatgtccttgccatatgagggttgcacgccccctccatcagaggactacacatcctcgccttcagagggctgcacgccctcgccttcagaggactacacgttctcgccatcagaggactgcatgccctcgccttcagagagctacacagggctacacgtcctcgctttcaaagggctacacgccctagcctttagaggactacacatcctcaccttcagaggactacacgtcctcaccttcagaggactacacgtcctcgccttcaaagggctacacgccctagccatcagaggaccacacgtcctcgccttcagaggactacacgtcctcaccttcaaaggactacatgtcctcaccttcagaggcctgcacgcccccaccttaaaaggactacac

SEQ ID NO: 34241 - DNA, 381 bp, Glycine max
  Peptide Sequence Number=SeqID_125926
atggaaaggttagtggacctagcagcgattgattctttcctcgcctttcaccatagcaaggaaagcccggtcgtcactattttggccaacatatacgacacgttcgaccggagatgtgaaaggagcggcgcaagcattgtttgttgcacactggccctctatgtgtggttggtctcacaccttttgtgccaagaggggaggcacgtttgtccactacaaggtcaccactcgtgtgccaaaaaggggaaggtttgtattaactataatcccgtcctcgccataagacagcttggctaccccatgagaggagcaccgtcagaggaaaacctcacgccttttatcacacggggtttcaatgatcccagcgtgagggtactttga

SEQ ID NO: 34242 - DNA, 282 bp, Glycine max
  Peptide Sequence Number=SeqID_125927
atgtttgtattcaacaatgctttgaaaggacttgacgatactccacagcctaaatcgaaggctggtgctaggtggattgttgttaaatgtaatagacaaaagggaagcattgagtgtggctatttcgtgatgcactggatgtcaactataatcttaggaagtttcaagaataattgggaaacgccatggatgagctcaattatatgggatccaagaacaatggctatgagcagttcaccaaaaatagcaacttctatcaaggatgaagttatagacaagtga

SEQ ID NO: 34243 - DNA, 240 bp, Glycine max
  Peptide Sequence Number=SeqID_125928
atggcgattccaatgacatgcgggggtaccttatggttatctgcaccttttgtcaaccagaggcaagttttactttcatcatctacagacattcaagtccaacgacacgcaaaattcttctctgctaggacgatagagtttgatagcatgtggaaacgtcatggttatcccattttatcgctttcaaggcatggaagttttgctgacgcttctgatgccttctttattctttctgaatga

SEQ ID NO: 34244 - DNA, 342 bp, Glycine max
  Peptide Sequence Number=SeqID_125929
aagaagttgggttggagattagatttggtcttggttatcatctataacttaactggtcatggttctaatcttgcttctcctatggatcttatcctggttgttggcaaattagttgtttgctcgcaagctaaagatgttgttcttgcgggttttatctttgtgcttttaacatcaatattcatgtacctcaaggctggtaaaatcatttcatggttctccttcgctatgggagttgttttggctatttctatagctcattccaaaggttggggcaagctttggctagaggtggattctcttttagtcctcaaggctttcaatgttatcagtgtggctccttag

SEQ ID NO: 34245 - DNA, 162 bp, Glycine max
  Peptide Sequence Number=SeqID_125930
atggcccaagatatttccatggaaggcttcgaaggcaacgttaacaatattacaactaacaactacctcacctttgctgaggaggagatccctgtcgaggggcgagggcacaataaggccctacacgtgtctgtcaagtgtatggatcacattgtggccaag

SEQ ID NO: 34246 - DNA, 291 bp, Glycine max
  Peptide Sequence Number=SeqID_125931
atgctgactattgagttagagctaagggtagagcctctagctgtcaaggctgtcagaaaccaccctgcaggcacagctgaagtgctcatccaatggaaagatttacctgactttgaagctacatgggaatcggttgatgttatgaagcagcaatttcctgcatttcaccttgaggacaaggtggctctcttggggggagtattgttaggttaccgattacgcaagtgtatgaaggaaggacacgtggcaagtataaaaggaagtcagagcagcagccagaacctggattag

SEQ ID NO: 34247 - DNA, 151 bp, Glycine max
  Peptide Sequence Number=SeqID_125932
gaatttacaagatagtggaactctcaagcgggttgcttggggactggacataggcacaaggggttataccattttgggaacagagactggaagatctttcccggaaggcggtaatcagatccttccaggtgcgaatgcgagaagcttctag

SEQ ID NO: 34248 - DNA, 201 bp, Glycine max
  Peptide Sequence Number=SeqID_125933
atgcaccctgagttcctggatgaagacatcatggccctattcaaagagaagcggacacacaaggatatagacaaatggattgtttgttttgatggggcatctaatgctttgggccatggagtaggggcagtccttgtatccccagatgatcaatgtatccctttcacggccaggctagttgagaggggaatgggatactag

SEQ ID NO: 34249 - DNA, 178 bp, Glycine max
  Peptide Sequence Number=SeqID_125934
tcatcttcctgctattaggagtgaaaatcttgcacaaccagaaccagaaatagagcctcgaagaggtaagagagcaagaattgctaaagactatgggcccgattatatggcctatacattagaggaggatccatcaaacctccaagaagctttgtcttctttggatgctgacttgtga

SEQ ID NO: 34250 - DNA, 273 bp, Glycine max
  Peptide Sequence Number=SeqID_125935
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggagaaagagagacggcggtgacagaggtggtgttggcggcgatgacaaccctggtgggtggaataatgtcagcgaaggtggtggaatggtgatggtgacggtaatagtgatgacaatgttttaa

SEQ ID NO: 34251 - DNA, 562 bp, Glycine max
  Peptide Sequence Number=SeqID_125936
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctccgtaacagaactgatgtggaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34252 - DNA, 276 bp, Glycine max
  Peptide Sequence Number=SeqID_125937
atgaagacaaaagctcatgatagaatcactaaaaatatagtaagtgaaactgagcaaaaggctccataccaagatgatgagcttgtagggcttcaagaagtgttggaagttgagtctgatgtcattaatgaatctcttgtggatgttgatggaggtggagaagagatagatgcatatttacttaaacaactagacttggttgaatcagatgaggatgaatggatattaagtaagaatgagattgagagtgacattgatgatacaaatacttattag

SEQ ID NO: 34253 - DNA, 306 bp, Glycine max
  Peptide Sequence Number=SeqID_125938
atggaattgattgagaatatggctgctagttatgttatatgtggtggagcacatgattctagccgctgcattcccatggaagatacagcacatgaaggtgggccacctaacaggccacaacaacaagggcctagtctctatgacagaacgatgaagttggaagagactcttgctcagttcatgaaagtatccatgtccaatcaaaagagcatagggtcaaccatcaagaatctagaagtccaagtgggacaattggcaaaacaattggcagaccgaccattaagcagctttggagccaacacatag

SEQ ID NO: 34254 - DNA, 535 bp, Glycine max
  Peptide Sequence Number=SeqID_125939
aggtgttgaggaggttaaagatgcagaggctcccattcctatacccactgacgaggttattttagtggggcagacacttaacaccttccttgcttggccaacacatctcatgaagcatgtatcagaacatgtagttgtgtctccagcaaaaccaccagataggacggatcatgaggtcgatgatcccctatatctaatgacattgaccatcccacaacttttcttgaagcctctccaggttatgtgggatgttactgtgttcggggtgtttaatcaagacttcctgttgtacatcaagcatgaagatctctctgaaattgcacacggtggtcaatgtctcagcatatctgttatacagttgtggatttttgctttgaaaggacttgatgatactccacaacctaaatccaaggctggtgctaggtggattgttgttaagtgtaatagacaaaaaagaaccactgagtgtggctattacgtcatgcactggatgtccacgataatcttaggaactttcaggaataattgggaaacg

SEQ ID NO: 34255 - DNA, 252 bp, Glycine max
  Peptide Sequence Number=SeqID_125940
atgaagaaacaacaatggaagagaagcggaagacaaaggagaagaggtgagaggaggcgccatccactagggaataagccatggaagaaggagcttcaccaccaagatgagccttggataagaagcttggaagaatgcttcaatggaggaaaagaaagagggagagaaagagagaggggggagcacgaaattgaaggaataaaagagggagagaagtggaactttgaaaaaaaacaaaaaaaaattagttga

SEQ ID NO: 34256 - DNA, 303 bp, Glycine max
  Peptide Sequence Number=SeqID_125941
atgagacctgatgaggttgttcctcttgagccaattgtgccaactatacatgagattgttgaagcagaaggtccactctcaccagggatggacctatcctttgctcagcaggtagcagatcctcctacaccagtacgggagagacaagcaaatcctcctacacctatgatggagatgccagaagaccctaccatgccaatcctaagactttcatccactccttcaattaccccagttctacatctgacagatgaggaggatatgcaagaccaggacacacaagaccagtcacaggaattctaa

SEQ ID NO: 34257 - DNA, 276 bp, Glycine max
  Peptide Sequence Number=SeqID_125942
ttccctgagagttcgatactcggttcttaccattttatactacttgtgcgattcggtacacttgccggttgtgaacaaaggtggtgcgtggttctacagggcaaaacaattggtgttaatgtagaagatgatgattcatacatggacacctgtgttagtcctttgtccacaaaaatcactcctaacgttgtcggagaagaagaagctgacgacgaagtagctgcagaggtggttcaaaagttgcaaccacgtgaaacatcaactttgtttattgag

SEQ ID NO: 34258 - DNA, 513 bp, Glycine max
  Peptide Sequence Number=SeqID_125943
atgaacttatcaaaaagaaaaggacacgctttacggcgcccttaccgaactcgtgctagagctagagtaatgggtgaagcagaggaggtgccaagagaagatgaaaggccgaaaatggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatggtaggcaaagatttcggaagtacggatgatcccatgatgtgcaaattcaaaacgagtacgccttcccatcatatggcttgcctcccaactatacaccacccaatgtggcatacactctcaatgaaaatctcaataactccactccgatactcattgagaaccaataacctcatcaggcacatatctctcaaaccatgggggagacacatgaaattccccagcacaatctag

SEQ ID NO: 34259 - DNA, 60 bp, Glycine max
  Peptide Sequence Number=SeqID_125944
atggcgcctgatgcggtatttactccttacgcatctgtgcgggatatcacaccgaatatg

SEQ ID NO: 34260 - DNA, 306 bp, Glycine max
  Peptide Sequence Number=SeqID_125945
atggccaagttcgatccagaagtagtccttgagttttatgccaatgcttggccaacagaggagggcgtgcgtgacatgagatcctgggttaggggtcagtggatcccgtttgatgccgacgctatcaaccagctcctgggatatccgatggtgttggaagagggccaggaatgcgagtatggccagaggaggaaccggtctgctgggttcgatgaggaggcaacctataggacgcacctagttgctcatgatcctgggaatttaaataaaacaagcgcaagctcggaaggtagaaaaataccttag

SEQ ID NO: 34261 - DNA, 204 bp, Glycine max
  Peptide Sequence Number=SeqID_125946
atggaggattgccttgagggtcctcacttaagcaatcatgaaactagctccaaactcgaaaatggaggacacatgaatgacaacccagcaataaaattcatgtggctccggaaaaggatgagaatggaggattgccttgagggtcctcacttaggcaatcatgaaactcagctccaaactcgaaaatggaggacacatgaatga

SEQ ID NO: 34262 - DNA, 789 bp, Glycine max
  Peptide Sequence Number=SeqID_125947
atggaggggaacatagatgtgactatcatgaaggaattttatgctaatctttatgtcccaggggataagcctccaaagcaagttagggtcagagggcatttaattaagtttgattcggattccttcaacacttttctggagactccgattgttctagagccaagggagactcttcctacttactccaagttctgcagattaagaccagaccctcaggagctggctgcccaactttgtatcccgggtaggggatttgttttgaatgttgagggcctgccatggaagctactaaggaaagacctcactactctggcgcagacttggagcgttctgtcttatttcaaccttgcccctacatcacacacttttgatctgaacttggacaggtcaaggttggtatatggattagtgatgaagatggacatgaatgtgagagccttcatctctggacagatcactcttatggttcagtccaactcctcgaggctcgaatttccagccctcatcactgccttatgcatggcccgaggagtcaccttagattccttgacttttgagtccctcatcccaaccattaacttggcttacataaagaagaattgttggaacttagacgaccccacggtcagctttccagggacccgcaaggccagggctagagaatctgaaggtccatcttctgctgctccccagacatctactacaccagctcctactccttcagcactagttaccgttatttctggtcactccgctcagagcacagacctcatgatggcaatgttgtag

SEQ ID NO: 34263 - DNA, 237 bp, Glycine max
  Peptide Sequence Number=SeqID_125948
atgagggacgacaatagatcttcgtacgccattgggatcgaggtgaattctggaattggcctcaggggaaagttcctcatcacgttggaatcggcaccaaagtgggcattgccgaccgggcgagtcgtggttggagccggagcttggggggcctccctctggatgggggcgggcgctctagactgtacgggtgctgaattggagaagttcccagcgcgagctgagaagctcgggtga

SEQ ID NO: 34264 - DNA, 601 bp, Glycine max
  Peptide Sequence Number=SeqID_125949
atggacaatgtagaggcttacttagattgggaaataagggtagagcaaaaacttaaaagaaagcctactttaaaatcttatggctatcattcttatccaaagaaagaccaaggtctaggcatcttagcagcagcaccttctaagcccaatgatgataaggggaagacaatagaaaagcaaccccctaaggctaaggacacattacttctcaatgctccaccaagaaacctttatagtagccaagatgaggctactacttcaccttcctctagtgaaagtgaagaagcaaaaggggaagaatctagtgaagaaatctacccccaagaagaaggaaaacctttaatggttaaggaggagtctaaggaggtaagtgtcttctccaagaggttaactaagaaggaaagtcattttgaaataaagacaaatattaaagaaacttctcctcttagacaacctccacattttctcctttgtaaaaagacacttgttagcattgccattcctcttcggcttgagtttattcatcaagtaaaggagttgttggataagggtttggttcacaagagcttaaatccttgtgctttatcggtgcccaaaatag

SEQ ID NO: 34265 - DNA, 294 bp, Glycine max
  Peptide Sequence Number=SeqID_125950
atggaattgcaagttgacatgtggttcgatgccatggaatcaagaatcaccaaggttgaagaagatgtctccttcatccgtacttgctttgatccaccaccaccgcctccatcatcctctagattatttcttgtcttgatttcagggattgtcatcatcaaaaaagggggagattgtagacaaaggatcaagctgaatgttttgatgatgccaaaggatcacatgcttctcaaagctttattcaagacaaagaaattaaagatattcaagatggatgatcaagacagtctctag

SEQ ID NO: 34266 - DNA, 726 bp, Glycine max
  Peptide Sequence Number=SeqID_125951
atgcacgcgctgcagacctctggcaactgcattcgcaacgtcactgcggatcatttcgctggcgctgcggccgacgaggttgctgatccgcgtccttatgccgagatcctgcgtcaatggtcttccgtgcatccggaattttcgttcctgccgcgcaagttcaagattgcagtgacgggtgccgaacgcgatcgtgcggccattcaggttcacgatatcggcctgcatctgaaaaagaacgacaagggcgagatcggctttgccgtttatgtcggtggtggacaggggcgcacgccgatgatcgccaagaagatccgcgacttcctgccggaagaagatctcctgtcctataccacggccgtgatgcgggtttataacctgcatggccgtcgtgacaacaaatacaaggcgcgcatcaagatcctcgtgcatgagacgggtgcggaagaactggcccgtcaggtcgaggtcgaatttgcggaactcaagaactccgaattgaagctgccggatgccgatatcgccgccatcaccgcctatttcgcgccgccggcgctgaaggaccggccggaaaggctgggaaagcctggcgcgctggaagcgggccgacgagggttttgcccgttttgtggagcagaacgtcgccccgcacaagcatccggactacggcatggtaacgatctcgctgaagccgatcggtggcattccgggcgacgcgacggatga

SEQ ID NO: 34267 - DNA, 402 bp, Glycine max
  Peptide Sequence Number=SeqID_125952
atgtacaaagataattggacccaaccttggcccatgggctcagaaatctatcctaaggttcatgagaaccctagggccttcttcagcagctctagcccaatcttcttggagcctcttgctcatggagatgaagatgataaggaagaagagacaccaataaaagagaaggaaaaagaaagaataaaagaagaagacaaagaaaaagaaaaaaagttgaaaaatgaaaaacaaaaagagaaagttgttgatgatgagatgaggaaaggccagagtgaggcaaacactaacaagaagaaggatactgctccaaatgaaggccaggaagtaccttatcctttggtaccttcccagaaagagaagaaatacatttggctaaatttcttgatatcttcaagaaactag

SEQ ID NO: 34268 - DNA, 354 bp, Glycine max
  Peptide Sequence Number=SeqID_125953
atgtccttacctgtagaggactacacgtcctcaccttcagaagacttcacgtcctcgcctttagagggctacatgccctcgccttccgaggactacacggcgtcgcacctagaggactacacgtcctcccctttagaggactacacgtccttgcctttaaagggctacacgccctcgcctttagaggactacacgtcctccccttcagaggactacacgtcctccccttcagaggactacatgtcctcacctttagaggactacacgtcctcaccttccgaggactacatgtcctcgccgtcggagggctgcacgccctccccttctgagggatgcatgccccttccttcatag

SEQ ID NO: 34269 - DNA, 382 bp, Glycine max
  Peptide Sequence Number=SeqID_125954
atgactagaggcaatccatttgacttacaaccctttgatcctgagatagataggacatttcatagattagttaggcatcattttataccttttgatcattctgagcattccattactggtgaatctgtgcattctgttattggtgattttgaacatcctgatcttgagcattataattttgagcattctaattctgagcattctgattttgcacattctgagaacatggcacaacctccacctcgtgagaggactctaagggaaatggctgcacctgatttcacctatgaaagcttgtgcatccaataccctgatgaggatatcccatatgttcttaaaactggactgattcatttgcttccaaagtttcatggccttgcag

SEQ ID NO: 34270 - DNA, 246 bp, Glycine max
  Peptide Sequence Number=SeqID_125955
atgcttgtgtgtggtgggctgtggaaagagaagtacagaatgagttctggatgtttgctagtagatcccaacggtcacaatcttgggaggattgatggggacccagtgttgagaggaacgaggatatgggctacgtgggagtacgtgagctcagttggaggtgggcaacaggggatggtgggttttatgcgcgcttttgtggatgtggaaaactttgttgtgcaccatcgcccgaccgccacctag

SEQ ID NO: 34271 - DNA, 348 bp, Glycine max
  Peptide Sequence Number=SeqID_125956
atgactatccaagatctccaaacagagataaacaatctaaaaagagaagtaaaagaacttcgtcaacaacaagaaattcatcagatcattctttctcagcttgaggtagaaagtgattctgaaaataccaacaaaacaatggccctattcgacacaggggctgactcaaactgtattttagaaggattaattcctacaaaattctttgagaaaacctcggagaaacttagtacaacaaacggctcaaaattaaaaattaattttaaattctcaaatgcaattattgaaatccaaggtcttaggattaacacaaactttcttctggtaaaaaccctcaaaacgaagtaa

SEQ ID NO: 34272 - DNA, 351 bp, Glycine max
  Peptide Sequence Number=SeqID_125957
atgcctcttgattctgaaccttatgttccaataaagagatcctttctaataggcgcttcaggcattgcatcctttggttatcaaaaagagcatgatggctcttgggtgaaaaggggtactcgacatgttgatgaagaaggacatggtggagaagattcatctcttcttcaaaagattttggataggttcgatggtcttcaagcctttgttggtgaaaggtttgatactttggagttacaagtggacatgcgcttcaatgagatggagtcaagaatcaccaaggtcaaagaagatgtttcttatattcgttcaagctttgatctaccaccaccgcagccaccatcatcttag

SEQ ID NO: 34273 - DNA, 234 bp, Glycine max
  Peptide Sequence Number=SeqID_125958
atgtcacccgacttcatgggtcaggatgacaaaggtgctgaagacgatgtaagtctccgcttgtcaacggcaatcgtttgtgcggataacagcttgggtatcttcgcatgtcacccgacttcacgggtcaggatgacacaaaccgtttatacggataaccgcttgggtactcacatgtcacccgacttcactggtcaggatgacaaaggtgcagaagatgacgtaagtctctga

SEQ ID NO: 34274 - DNA, 672 bp, Glycine max
  Peptide Sequence Number=SeqID_125959
atggcttccatgatggaggccatgttaggaatgaggcagctcatggagaaaaacgtggccaccgctgccgctgtcagttcggctgccgaagcagacccaactctcttggcaactgcgcaccatcctccctcaaacatagtaggacggggaagggacacactggggcacgatggcaaccctcatctgggatacaaccgagcggcttacccttatggattgccgcccaactactcaccacccatcctgcaagacgatgcgggccatattgcttctcccgtccttgaaagagagcctcctcaacagcccgatgaggtccacaaagaccctcaagactatgctcgaagggatgtcgagttctatcccccgatccccgaaggaccggcacccagcacgttgcctcagcccaacatcacgacacaaccaatagttttgtccacggaaggaccgcccccggcaattgaagaaaggaggaagctcgatctcctcgaggagagattgagagccgtggaaggatttggggactatccgttcgcagacatgacgaatctttgcttagtacccgatgttgttatccccccaaagttcaaagtgccggacttcgacagtataaagggacgacttgtcccaaaaaccatctcagatgtactgtcgcaagatgggcgcacactctaa

SEQ ID NO: 34275 - DNA, 200 bp, Glycine max
  Peptide Sequence Number=SeqID_125960
atcgaagaacgatgaagaacgaatgaagaacgtcgaagaacggttcaaacctttgcgagatcctcacggaaaacgttacggaaacgtggttgccgcccagctcgcccaggcgagctcagctcgcccaggcgagcagggttgcttcctccagaagcaaccgccttctggaggaatcttctggagggcccaaatgggcctgg

SEQ ID NO: 34276 - DNA, 169 bp, Glycine max
  Peptide Sequence Number=SeqID_125961
atgttcattaagaccaaaatctcggttagaatatgtggttctgttgaccagcatggaaaggttcaagacttgcttaaggacattgatgatcagttcatcacttcagataagactttagcaagcaccctgatcatgaagttctcctctcttcggctcaccagtgtgaaag

SEQ ID NO: 34277 - DNA, 177 bp, Glycine max
  Peptide Sequence Number=SeqID_125962
atgtatgtgaatttagccaaggagatgtgtgtgatgaatggcaccgaggaagcttgcctcaaagaggtccaggaaggacaaggcggccgaagggaactagttccgccccggagtacgacagtcaccgctttaggagcgttgtacaccagcagcgttcgaagccatcaagggatggtc

SEQ ID NO: 34278 - DNA, 382 bp, Glycine max
  Peptide Sequence Number=SeqID_125963
atgactagaggcaatccatctgacttacaaccctttgaccctgagatagataggacatttcatagattagttaggcatcattttataccttttgatcatcctgagcattccattacttgtgaatctgtgcattctgttattggtgattttgagcatcctgatttggagcattataattttgagcattctgattctaagcattctgattttgcacattctgagcacatggcacaacctccaccccgtgagaggactctaagggaaatggctgcacctgatttcacctacgaaagcttgtgcatccaataccctgatgaggatgtcccacatgttcctaaaactggactgattcatttgcttccaaagtttcatggccttgcag

SEQ ID NO: 34279 - DNA, 852 bp, Glycine max
  Peptide Sequence Number=SeqID_125964
gttggacccttaggtactagtacctatcaccttcagaggactgtacgtcctcaccttaagagggctacacgtcctcgccttcagagggctacacaccctcaccgtcagaggactacacgccctcaccgtcagaggactacacgtcctcgcctccagaggactacatgtcctcgccttcagaggactacacgtcctcgccttcaaagggctacacgccctcaccctcagaggactacgtgtcctcgccttaagaggactacacgtcctcaccttcagaggactacacgtcctcgccttcaaagggtcatgtaccctcaccttcagaggactacacgtcccctcgccttcagagggctgcacgtcctccactttagaggactacacatcctccattttagagtactacacgtcctcgccttcagagggccacacgctctcgccttcagaggactacatgtcctcaccttcagaggactacacgtcctcgccttcaaagggttatgtaccttcgccttcagagggcttcacgccctcgcctttagagggctacgcgtcctcactttcatttttgggccaccccctgatattggagggcgaccaactgtgcaagcacaaccagagagggaggctataacgcagctattatgcatatcggggcaagatttcactcgtgccgcggcaaagagacgagtgcggatcatgcacaccaacatgaccactattacacagatatggatgacgttgctacttagcaacattctgcccagcgaccgtaatgccgatctccgcctgcggaaggatcgtgcccacaagacacccagtggacccggagaagtccaacagggtcctggg

SEQ ID NO: 34280 - DNA, 405 bp, Glycine max
  Peptide Sequence Number=SeqID_125965
atgccgttggccatcggcggaggtgaagcgcagatcgctgaaacgataatccgcagaatcgctatcggctacggtagtgccgatcttgcgttccaaatcgggcctggccagcacggagcccggcagccaaaggccgatggcgagcgccagaagcgcggagataaaatgccggttggacaagaacatgcggatcaacatcctcgaaaaaggccgatagtagcatccgttcgcgtcaggcaaaaacctacctttagggtggacattccgaccgcggaacccggaagcgcgccgccagttgctttgccgggtattgttcttgggccgggcgtgggctgccagggattgccggcaggggccgcgaacatgccggccggtattgccgatcttcaccgtggggccaggtga

SEQ ID NO: 34281 - DNA, 348 bp, Glycine max
  Peptide Sequence Number=SeqID_125966
atgaatagcacaagttttcaaggtttggaaaaccaaaaaacttcagaaagcttttggtacaaagaagaagaagaagttcaaagagattcaaggcttgtaaaggattgtaagaaattgattggaaaaaaacaatcactggtaatcgattaccaaattagtgtaattgattacacaaagcttttatgtgtgtcataccctaatttcgtccggggattattacttgatgacatgcaacctttgattggtcgtttcaagatacttggcacccttggttgcacaatatgtaagtctcgagacgcgccggaagtcaaaaggaagcagggttatgcgatccgtgaaattccgtag

SEQ ID NO: 34282 - DNA, 1188 bp, Glycine max
  Peptide Sequence Number=SeqID_125967
atgaataattcagggaaataccttatctggacactgctctccgtgatcggagcctttgccctcggctatatcgccttaaaccggggtgagcagataaatgcgctgtggattgtcgtcgcggcggtctgcgtttatctgatcgcgtatcgtttctacggcctgtatatcgccaaaaccgtcctcggcgttgacccaacgcggatgacgccggcggtacgacataacgacggcctcgattatgttccgactgacaaaaaagtgctgttcggtcaccattttgcggcgattgccggcgcagggccgctggttggcccggtgcttgccgcgcagatgggctacctgccggggatgatctggatcctcgccggcgtggtgctggccggcgccgtgcaggactttatggtgctgtttgtttcgacccgtcgcgatggccgttcgcttggcgaactggttaaagaggagatggggccaaccgctggcgtactggcgctggtggcctgttttatgatcatggtgatcatcctcgcggtactggcgatgatcgtggtgaaagcattgacccacagtccgtgggggacatacaccgtcgcctttaccatcccgctggcgatttttatgggcatctatattcgctatctgcgcccggggcgcatcggcgaggtgtcggtgataggcctggtgatgctggtgttcgcgatcatttccggcggctgggtggcggaaagcccgacctgggcgccgtggtttgattataccggcgtacagctgacctggattctggtgggttacggctttgtggctgcggtactgccagtctggctgctgctggcgccgcgcgactatctctccacgttcctgaaaatcggcaccatcgttggtctggcgattggcatcctgattatgcgcccgacgctgaccatgccggcgctaacgaagttcgttgacggcaccggcccggtatggaccggcaacctgttcccgttcctggggtggtcgatccgttgggcggcatcataccctgtggccgctgttcggtatcgccaaccagatgctggcggggatggcgctgatgctgtgcgcggtggtactgttcaagatgaaacgccagcgctatgcgtgggtggcgctgctgccgacaagctggctgctgatttgtacgttgaccgctggctggcagaagtcgtttag

SEQ ID NO: 34283 - DNA, 417 bp, Glycine max
  Peptide Sequence Number=SeqID_125968
atgtggatgacgttgctgctcagcaatgtcctacccagtgatcataactccgaccttcctctgccaaagtgtcagcaggtgatccggccgccgatcacccgagccttcattgagaagtattgcacgcctaggcaggcacagggtgatgtgccacaggtcgcagacgcaccactgccacctcatcaggttgatcccgctgggtcattaggcatggagcggtatctacaacacttggttcgccaacagacgaccaaccaccgggggcagtttagggctgaggtcgcatggcccggagattggcccgaggaccagacggaggaggcacctgcaggagctcctgacgatgcagaggacgctcgcatggatgaggagatgacagacttgctcggcttcttgggaggaagtggagccacgtga

SEQ ID NO: 34284 - DNA, 423 bp, Glycine max
  Peptide Sequence Number=SeqID_125969
ataatgctggtggttattgtaatttggaaggtgatgcaagtgatggaagtgatgatgatgcaagtgatgaaggtgaagtgtttaacattgatggatttcttgatatagcaaagtttgatatgaacaatataagaagtggtgatgtgggaaggtatcaatttgctgatctggaattgacttatagatacttcatctatgattcaccatttggaaaggcatatttcagggcccctggctcgcctaggctagcctctggctcacttgggctgccaaatagcttagtggtgaatgttaagagaaattggagagaaatcaaagagaagaagaagaaagaagagaaaaatgaggccgaggctttaccgaattgcaaccgtaaccgacttctacattgttcttcgttcggtgttcttcgtttgtcatcca

SEQ ID NO: 34285 - DNA, 354 bp, Glycine max
  Peptide Sequence Number=SeqID_125970
atggtggttatatcactgtcaatgaaactcaaggaagagcactgttctattggtttttcgaggccactcacaaaccagaacaaaaacccgttctcttatggctcaatggagttatttcacaagctcccttccttcttcctccctctcccccccaagctcctttcctccttcgcctccgcctccgccgctccctttcctttcctctcctttcccttcaaacgaatgtttcttcatgtcggactcaaccaacaagttgtgattgcgaagcataaaggttatgtgagtggtagcttgtcggatgaggggaaggttggacttggaggagattctgaaccaaccagaggatactggtga

SEQ ID NO: 34286 - DNA, 152 bp, Glycine max
  Peptide Sequence Number=SeqID_125971
aattcacaagcgattctcctcctcaaatcttagccagcctacatcaatcagaccttgcatcttatgtttcagggtcatacaatgctcaatggaatgctcaatccgtaaagatccacaatattccggaagccaaaaagagcattgttgcgtaa

SEQ ID NO: 34287 - DNA, 132 bp, Glycine max
  Peptide Sequence Number=SeqID_125972
atggattttgttctttgtatcattatgcccaggagtgcaaaaggaattaatgaaacattgggcttaatccagattttggttgtggacttgaagaggggaaataaagcagcgcttacctcagttaatttctaa

SEQ ID NO: 34288 - DNA, 576 bp, Glycine max
  Peptide Sequence Number=SeqID_125973
atgggggcatattctacggatgaaaagctgttgatgcacttctttcaagacagcttagccggagcagcagtggcgtggtataccaatctggaagcttctcagatccggtcatggaaagacttggcaactaccttcattaggcccccatacttgcaatgtggtttttcaagtgatggacacaaatcccgcctacagctgcctcttggggagaccctggattcatgcgctaggagtggtcccttcgacgcttcaccagaaattgaaattcgcggttggtggactcttggtgatagtgtcaggcgaagaagatatgttgccctaatggtggcacgggtaatgctcaggcacggttatgagcccggaatgggtctgggcaaggatagcctcgggaataccaatgtggtcgacattaggggaaacccgtacaaatatgggttgggatatgagggtcgattctttgaggatcctaacaacgagggtttgataatcgattttgaccgagaagtaagccgaacaataaacgaagaagaggaagagaacgtcctttcaccagagttggagaggttgatcgcttag

SEQ ID NO: 34289 - DNA, 537 bp, Glycine max
  Peptide Sequence Number=SeqID_125974
atggcagaaccatcaaagaagcgaaaaggttcttcgagtcgaagccagcggcattccgagactcaagaaacgcagattccctcctccatttcctcttcctcattgttctcattagaagaacaatggatacggtacacaaatattttctcttctcgttccattattgatccaaaatttattggcatggatttcttttccaatgagagttttgaatgcattcaggcatttgagaactccaatctcattcatttcatgtctttaaaattgcctgtttattctgaattagttaaagccttatattctaatcttgaaattcaagaaggcaatttgatttctgaagtttatgggataaaaatggtcattgatcaatccctattctatgacttgacccaattgtctagtgaaggtgtaccattcgaaggtacactgaatgatgattggaaatttgatttcaatgtgcatgatgcccaccggttagtttgcaccaaccaagcggatatgaccgggaaggcttcttgtcgggtcattggcttttga

SEQ ID NO: 34290 - DNA, 192 bp, Glycine max
  Peptide Sequence Number=SeqID_125975
atggtggagaaaagcatcgaggtattcatggatgacttctcggtttttggaccctcatttggcagttgtttgaggaacctagagatggtacttcagaggtgtcagaagtttcttagggcatgcaggattctacaggaggtttatcaaggacttctcgaagattgccagacccctaagcaacctgctgaataa

SEQ ID NO: 34291 - DNA, 291 bp, Glycine max
  Peptide Sequence Number=SeqID_125976
atgactcactataatccttaccctcggaagcaagaaaaggaaagaaggaaattcccaatcaaagagaaagcaaaaaaggaaggaaaggaaattcccaatcaaagagtgggagaaagagaaaaaagaaaaagaaaggaaattcccaatcaaagagtgggagaaagaaaaaagaaaagaaagaaaattcccaaccaaagaatgggagaaagtaaaaaaggaagagaagaaagctcctggtcaaagaaaccagaagaaatgtgcagagaggtctttagaccggacaatatctga

SEQ ID NO: 34292 - DNA, 495 bp, Glycine max
  misc_feature (15)..(15): n is a, c, g, or t
  Peptide Sequence Number=SeqID_125977
atgcgtaaggagaanataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccccccgcggccgatcgtcatcgagaagggcgtcggcgggacctacatctacgtcgaagcgggcgtgcagctgcagctcaaggcgaccgtcgacacggcgaacgtgttctggacccgcgtcggcaccggcggcgagatcctcgactccggaacctggccggcgacgaccaggggcgacgactcggtcatcgtcgagaacatctccgccgagaacgcctcgacgaccacgatccaacccgtcgtcctcgatcagaacagcggtgagatctcgatcaccatcgccgagcccgagaaggaagaacagtga

SEQ ID NO: 34293 - DNA, 192 bp, Glycine max
  Peptide Sequence Number=SeqID_125978
tcatttgcctcacaagttcttcaagggaaggttgtggaggagcctcaactgtttgttgtttctgaggctgttgctattgttgttgttgttgttggattggtggaggaatgtatggtctgcttgggccagcagcattctgaaaataaggctgttgttgttgctgctgctgttgtgaaggattcgaccatctaa

SEQ ID NO: 34294 - DNA, 357 bp, Glycine max
  Peptide Sequence Number=SeqID_125979
atgaagaacgtcgaagaacggttgaacctttgcgaaattcttcacggaaacgttacggaaacgtttcggaagtgcctcggcttagattttcttcatggaaacgattttccagcaattcgaaagagagagaagtgccaaaggggctcaacccattccttcttcatttcctcccctatttatagcaaaataggggaggtgtttgccgcccagctcgcccaggcgagctcagctcgcccaggcgagctcagctcgcccaggcgagccaggttgcttcctccagaagcaacagccttctggaggaatattctggagggcccaagtgggcctgggtgctatttgcacccccatttttactaa

SEQ ID NO: 34295 - DNA, 189 bp, Glycine max
  Peptide Sequence Number=SeqID_125980
atgccgatctccccctgcggaagtatcagttggtctgtgccgtcatgtcatagggatcgcgcctgcaagacacccagtggatccggagaagtccaacagggtcttggggtttccagctctgattatgggcctctgtcagttctacggagtgcctgtcgcccccaacaaggtcatcaggccccctattaa

SEQ ID NO: 34296 - DNA, 639 bp, Glycine max
  Peptide Sequence Number=SeqID_125981
atgaccggccctctcaatgagtcaatctcttgctttcacataagggtggacccttgggtactagtaccctcacctttcagagggctacacgccctcgccttaagaggactacacgtccttgccttaagaggactacacgtcctcaccttcagaggactacacgtcctcgccttcagagggctgcacgccctcgccttcagagggctacacgtcctcaccttcagagggcttcacaccctcgcctttagagaactacacgtcctcacctttagagggctgcacgccttcaccttcagagggctccacgccctcaccttcagagggctacacaccctcaccttcagagggctacacgtcctcgccttcagaggactacacatcctcgccttcagagggctaaattccctcgcctttagaggactagacatcgttgcctttagaggattacacggctgcacgccctcaccttcagaggactacacgtcctcacctttagagggctgcacgccctcgcctttagaggactacacatccttacctttagagggcttcacaccctctcctttaaaggactacacgtcctcaccttcagagggctgcacgccctcgccttcagggggctccacatttgcgccttaa

SEQ ID NO: 34297 - DNA, 282 bp, Glycine max
  Peptide Sequence Number=SeqID_125982
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtttatattttcaactgccattgatggcaaaattaaagcctggttatacaataatatgggttctagggttgattatgatgccccaagtcattggtgtactacagtgctttatagtgctgatggaagtaggtaa

SEQ ID NO: 34298 - DNA, 513 bp, Glycine max
  Peptide Sequence Number=SeqID_125983
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcctatctggcctcaagcaaatgaatcatccaacctcaaatatgataggcaaagatttgggaaggccctcagtgtcacccacaaccacaaccctcacattccacagcggtaaaaaaccctcatgctatggcagaaatgggaaagaggaaaggctcagggccattgaaggaggtaaagattatgcctttcctaacctagaagagttgttcctagtacccaatatcatcacccctcccaagttcaaggtgctggactttgacaagtacaaggggactacttgccccaagaaccatccaaagatgtattgtcggaagataagggcatacgcaaagatgaggaactgctaa

SEQ ID NO: 34299 - DNA, 501 bp, Glycine max
  Peptide Sequence Number=SeqID_125984
atgattcaatatcattcctatgttctttccgcagcacctgatgtgtggaattacaatacttcttcatcggattcagttttgataaagaaaatcattcaaataagggactttattatctccaaagagctaagtacggaagaggccaacaaaaggattcaatcttggagcaccaatgaacaattgcttgttggcaaagcctatgaatacattagaggtgtcaagcctactggttccctctgccctttatgttcaaatgaggctgagtcaaatgctcatttgttcttttctagcaggaaatctctccaagtttgggctcacattcgtgatttggctcttttccgtaggcgtttcacttctttacagtgcattactgactctttaattaggggcagatccaaatcaggtgttcaaggaaaattacgttgtttggctatagcaattacagtctactacatctggctgtctaggaacaagctgatttttgaagattatccttttaag

SEQ ID NO: 34300 - DNA, 348 bp, Glycine max
  Peptide Sequence Number=SeqID_125985
atggaggccatgatgagcatgaagaagataatggaagccaatgtgtacgaacggccccatgatgtgcaaattcaaaatgagcatgccttcctgccgtatggcttgcctcccaactatacaccacccaatgtggcgtacactcccagtgagaatgtcaataactccactcctatactcattgaaagccgacaacctcaaaatgatcatggacatgtctctcaaaccatgggggagacacatgaaatttcccaccacaatctagccgacttcgagccttgcctcggatatgccattgaagggcaagcagttggtggtatacccctgcaaaacacttcggaaggcccttag

SEQ ID NO: 34301 - DNA, 486 bp, Glycine max
  Peptide Sequence Number=SeqID_125986
atgcgcagcgatggagatttggcggcacaagtggctcctcccatggttgagagagagatgatcaccatgatggtagacactctgccgtccctcattgccaaccaattggccgtggtaactcccggaaaggatcggcccaatgtgaaaaccaacccgctcgccaaccatggagggggagcggttaatgccgttgagtccgacaggccgcgcaggtctaaacctttgagggacgtggcaacccctaggaggtttatctttaaggccctacaaaaaggaggtgtgattccccatattgggcgtaaggaggattcctgtttgctgcattccggcgagctgcataacatggaaacgtgtttggaagtggaggaattgttacagcggatgatagatcagggtcgactggaagtcggcagtgaaggaagagaagagaagcacatatgcatgcagtccacggaggggagcaatgttgcgaagcccaaaccattg

SEQ ID NO: 34302 - DNA, 542 bp, Glycine max
  Peptide Sequence Number=SeqID_125987
atactgctgtacgaacatcagatgctggatatcttacacgcagacttgttgaagtggttcaacacattgttgtacgtcgaacggattgtggtaccattcaaggaattgcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacaggaaaatcatacaggtccggttcagtctctttttcaatccgaaaagatcaagatcaaatga

SEQ ID NO: 34303 - DNA, 158 bp, Glycine max
  Peptide Sequence Number=SeqID_125988
atgtcattgcctagccctgttcatgtgtcctccaccttcgagtctggagccccgcgaaaaaaaaaagaaggagtagagatgagagtcgtcatcacggaaagggcaggacggacgaaatcagtgtcttatctttgctttcctcttatctccgatgagag

SEQ ID NO: 34304 - DNA, 297 bp, Glycine max
  Peptide Sequence Number=SeqID_125989
atggccaacaatacaatcaacaacagggacaatggaggaaccaccctggaaatcaattcaatagagatcaaggtttctatgtctaaccagaagagcatagagtttgccataaagaatctggaggtccaagtgggacagcttgcaaagcaattggcggatagatcatcaagcagttttatagctaatacagagaaaaatcccatggaggagtgtaaagctatgatgactagaagcaaaaaggcaatccatgtggatgaaagtgaagctgagaagaagatggaggaacataaaaaatag

SEQ ID NO: 34305 - DNA, 435 bp, Glycine max
  Peptide Sequence Number=SeqID_125990
atggcacaacctccacctcgtgagcggactctaagggaaatggctgcacctgatttcacctatgaaagcttgtgcatccaatacactgatgaggatgtcccatatgttcttaaaactggactgattcatttgcttccaaagtttcatggcctcgcaggtgaagacccgcacaaacatttgaaagaatttcacattgtctgctccaccatgaaacccccagatgtccaagaggatcacatatttctgaaggcttttcctcattcattagagggagatgtccaaggtccatcacgagctgggatgaccttaagagagaccacagccatcaggaaggatatctcaggactcagtaatatggagagaagtatgatagatgctgccagtggtggagcccttggagacatgactcctgctgaaagccagaaatttaattga

SEQ ID NO: 34306 - DNA, 795 bp, Glycine max
  Peptide Sequence Number=SeqID_125991
atgtctcctttccttgtgagggatttcggcgcacaaaattccaagactatacaaagaatccataaggcgtgggaaaccccgttaaagaaagatcaagagcttagaggcattcgtaatggcatcattggtgggcaccacgaatggctgaaagttcatatacgaggtttagattggctcgccaagttaaaagtcgtcagcaaagagagttttgaagcaccggaggaggacgagaagtccaagctctcaaaagcgaagattgcaattactgcaagagcccttgaacaagagaccaagagggctcgcaaggaagagtatggccggaacaaaattcgcggagctctatggggtagcaatagtgaactcaagtttcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtaccaagaagagttaggtctagccacggcccacgagcatagaatcgcggatgagtatgctcaaatatatgcggaaaaagaggctagaggaagggtgatcgactctttacaccaagaggcaaccatgtggatggaccggtttgctcttaccttgaacgggagtcaagaacttccccgcttgttagccaaaggccaaggcaatggcaaacacctactccatccccgaagagattcatgggcttctcggctattgtcagcatatgatagacttaatggcccacataattag

SEQ ID NO: 34307 - DNA, 330 bp, Glycine max
  Peptide Sequence Number=SeqID_125992
atgccaagtatctcaaagcggctaaccaaaggttgcatgtcatcaagtaataatccccagacgaaattagggtatgacaggtgcgtcttccatgggaggaaaatgcgcggagtcgccaccaatgtttatttgaggaaaatgtcagaaaaaccggaaaggtgtggtctacgaactttaagtgtgaaaggttcaggagttgtttttatgcacggggaagggggagaaacgttaaggcgttggaccattaacgatatcttggggtggtcgacaaaagtggggcttttgctcctacgtatcctcaattgcgatgaggaaatcagacctacgtag

SEQ ID NO: 34308 - DNA, 357 bp, Glycine max
  Peptide Sequence Number=SeqID_125993
atgtgcatcgcaacaaactataatgttaaatcaataggcggtttcactctcttgattcaattatgggcatgggagcgatgcccaacgttagccccgtcgtttattcctccaccgcaacaaaacgcaccacttgcctatagatggttgggaggtgaaattcatcacatagacaatgccaatttacttgattttcatcgtaaattagatgtcatgaaacgcgacgagttcgtctgggtcccttattttggacatgtggaaatgaatttgagccaagtttgtttcattgggtatgtattatggacatgtatcgtaccacttaatttgttttcaaagagtggaatggcaccagccggatag

SEQ ID NO: 34309 - DNA, 537 bp, Glycine max
  Peptide Sequence Number=SeqID_125994
atgttgaaggttgtgagatatgacgcaattttttctttaactcatgaggaaacattggaccaccaatgcaaaactggttcgactttgggctcagattataaaacagaaaatttggagatagaacatgaagagggaagaaagtttgcatgtggaaaaaggagaagaagactaggagaagctcatctaaaatcagaatggaaaaagatttgtgtgactaacaaattgaaagaaaataacaaaattcaaattgatatagtgcgcaaaaagcacccagaaaaactgttgatgggccaagcaaaagagagtggagatgcggaagaatcagagggcaagttgaaagcaattcttggttacactgaagatgatgtggtttccaccaactttgtgggtgacagcaggtcaagtattttctatgcaaaggcaggaattgctttgaatgaaaaatttctgaagctgatcacatggtataataacgagtggggttacagcaattacattgttgacttgattgcacacatcgttaagatgtctcgttaa

SEQ ID NO: 34310 - DNA, 843 bp, Glycine max
  Peptide Sequence Number=SeqID_125995
atggaaagtggtttttggagcaacgttccgcagcgattgcaaacaaagaggaagagtaaattcaatggcaagggagcactttctacatcgaaggcagtgctttctaaaacgaaggaagcactttctagatccaatgaagcactttctgcacccaaggaagctctttctaaaccgaaggaagcacattctagacccaataaagcacattctagacccaataaagcactttctacacccaagaaagcgctttctacactgaaggaagcactttctagatccaaggaaaagctaaacagtggagattttgatatttacttgaaacttggaacatctcaaggtgacaagcaagaccgttgtagttggacagaagatgccttgctgttttatacattgcagcttggttttgttgacatggattttgatctcaatgctaaaggcaatgagaaagttgaaagtttgtgtgaagaaggtggtgattgggagagaaagaattggctgaaagtacggcctgcctcgggtgtcgcggccgctatcgcgactgagcggcacccatccgcgacgaagagggtcgtagtggcgcggttcaatgtcgcggatgtcgccgccgctatccgctatcgcggcggggtggagtggcggagtggtgcaggatctgaaccggattttcgcgcggctaccgtgacgctgtggaaatttcagaaatgccctctaatgtggaaaagtgaggccaccacgagtctgcatcccgcgaagctgcgacccgacacctgcgtcctgcgtccggtggccccgacaacgagtttgcactgcgctgccaccttgcttgaggtgaggaagacttga

SEQ ID NO: 34311 - DNA, 1554 bp, Glycine max
  Peptide Sequence Number=SeqID_125996
atgaaggaagaagttgatccatcaacaaagagggagaagcacaaggaaaacggagtgacgaatgtgggcagcgaagacgattttcttgataacccaattacagatttgatcaagaaggtagtcgaagctggtgattcaaccaagccacactgttttcaagattcaaattttcataaaaagattgttatggtgaaacaaaaatcattcatgaaaatggttggaacaacaatggtgctggaatcttggaatgtcaacttgttgggtgagcctttagcattaaattttgttgcatctatggttgacagcttagccatggagctaaggcagaaggaatgtactgagccagtcaagctgattaaagttatatggagtccacccttgtccctcccaccaccaaagccaccggacctcagtttgcatgcaggggcaatggattccaaccttgaggacaagattgattttaaggaaggggcagtatttggcattattggaacaggggcacgtgataggtttagtgtcacaaaatccccctcctttgttattcagcagtatgttggtattttgctacttgttaatgttaatattgggaatgtgaaccacctttttatatcagtaaggtttgacttcacccattcacctgccgaaagatgcacagtgggtagggagcagcatgccgggaggaaaagtgacatagctgaccagaatttttgctataatagtgaaaaggaggcagttacagggagtggggacgtggtaggagaaataagaagcaaggaggaagaggcacgtaacccatttatggaacaggaaaacatttcaaatgtaatcggcttttcttttcccacccccgatatcaccccaacacctcacgttttcagcccaaacagaaataagggagatacagcgtccccctggaagggcatcgggaacttaatccctgcagagaggactgagagagtgtgcgaaaaaggaaactatgaaggggaacttcatggtgatatcacgggtaggcaggtaatcaaagtaaaggagtcacgtgaatctgagggggcatctgaaagtggattgggctgtgctacccacaccccccatgccacaacagaacgacagttttctagaccacaaacaagcaagttgcaagtttactcgcggaaaaggtgtttcaaaaagaaattggagttgggctgtacagctggaccaagctcagacacagacatggccaccgatctaattatatcaagtccacgtcagcaacaacgtgagaacaaagagaaatgtgggtctgtacaagaagaaatcacttccaacatagatgacatatcagcacaaatagagaatgaggaggcagaatttgcgaacattcagaagcaggaggcagcagccttatgggatgtggcaaaaacattgggggtcgcagccttatgggatgtggcaaaaacattgggggtcacttgtgggtcactgcaaaggaattatgtggacaaaataatggaaatggaggaaagagatagaaaagaggcagagagattgagaaataggaggagttcaccatga

SEQ ID NO: 34312 - DNA, 1821 bp, Glycine max
  Peptide Sequence Number=SeqID_125997
atggcggcggtagcggtggcagaggttgggaaggccccacggccgggccagggcggttacgaagcgcacggcctgagcgaggaggaggctcgtgtacgcgccatcgcggagatcgtgagttccatggtggacctctcccacaaaggccagaacgtggacctgaacgcgctcaagtccgcggcgtgccgcaagtaccggctctcacgcgcgccgaagctcgtggagatgatcgcggcgctccccgacgccgagcgcgagacgctcctccccaagctccgcgccaagcccgtccgcaccgcctccggaatcgccgtcgtcgccgtcatgtcgaagccgcaccggtgcccacacatcgccaccaccgggaacatctgcgtctactgccccgggggacctgactccgacttcgagtacagtacccagtcttacaccggttatgaaccaaccagcatgcgtgcagttcgtgcgaggtataatccatatgtccaagcgaggtgcaggatagatcagcttaagcgtttgggtcatagtgtagacaaggttgaatttatcttaatgggcggtaccttcatgtcacttccggctgattaccgtgattactttataagaaatcttcatgatgctttgtctggacacacatctgccaatgtggaagaggcagtggcttactctgagcatggggcaaccaagtgtattggcatgacaattgaaacgaggccagattattgtcttgggcctcacttgcgccaaatgctttcttatggttgtacacgattggagattggagtccaaagcacctatgaagatgttgctcgagacacaaatagaggacacactgttgctgctgtagctgattgtttttgcctggctaaagatgctggtttcaaggttgttgctcatatgatgcctgatcttccaaatgttggtgttgaaagggacatggaaagtttccgggagttttttgagagtcccttgtttagagcagatgggcttaaaatatatcctacacttgtaattcgtggaactgggctttatgagctctggaaaactggcaggtatagaaactatccaccagagcaacttgtggacattatagcaaggatccttgcaatggtacccccatggacacgtgtttatagagttcagcgggatattcccatgcctctggttacctctggggttgagaaaggaaatctgcgggagctggcattagctcgaatggaagacctgggattgaaatgtcgtgatgttcggaccagagaagctggaatccaggatattcaccaccaaattaagccagaagaggtggagcttgttcggcgtgattatatggcaaatcagggttgggaaacatttctatcatatgaagatacacggcagttcataactggccttgttcctcttgctcatatttttccttctttaattgtaaatcaagagggacgtgtctcaacctgttgctcaaacacagcaatgaccttgtctgaactctctgcttgtaaacaggatatccttgttggtttgttgcggctgcgaaaatgtggccgcaacacaacttgtccagagcttatggggaagtgttctattgttcgtgaactccatgtttatggaactgctgtaccagttcatggacgggatgctgacaagctacaacaccagggttatggcacacttttaatggaggaggcagagcgcattgcttgcagagaacacagatcaacaaaaatagctgtaatttcaggggttggcacacgccattattacaggaaactgggatatgagcttgaaggaccttacatggtgaaatatctagtgaaataa

SEQ ID NO: 34313 - DNA, 220 bp, Glycine max
  Peptide Sequence Number=SeqID_125998
ggaaagccagtgataaagatggaggaagcgcaaatttgggctaagaaggtggagctgccagcgttcatggggacaaacccaattgtttggattgctagggctgaaaaattctttgagggtgctgcgacacattggttctacatttggggccaaaacaacccagattcaaattgggagtcattttccacaactttgatcaaaagattcggagatcaccatg

SEQ ID NO: 34314 - DNA, 2415 bp, Glycine max
  Peptide Sequence Number=SeqID_125999
atggaaccaattgagagaacggatcctagactaagctacgaaggtaatcggcatggacagcaacccaaataccatcatgcaaattggagggatggtacagacatcacctcattctacttcactaggttccttgaggatgcaagaggaggagctgtggaccattttcaaaaaatggggggacgtaagggagatattcatatccagacagaggaacaaaggaggcaggagatagatgagatgagagaggtgagagagggtagaacgagagagggtagaacgagagaaagagtgagcttgagagggagattacgaaggagagttcatgacagtgtaagagggagtgcccgtgacagtgtaagagggcgtgttcgagtgagagaacgggaaaaaggaggccaggtacattatccagcctctgatggccaacatggggagaagtacactgctagagaaaggagaagaaacactgaatatggtgaaagtaggggtcttgcagagagtaggagggcatcttatgaggtggataacagccctactagaactgatgaagggtgggtggaagtatctcataggaggaagaagaaaacagctgtagacagaggaccctctgtgctcaataagcgacaaaggcaacataggagaggtacatggagagataaggaggatgtcacctccttttacttctcaagattccctgatggggaggttcaagatgtgcagaggttggaaagacagttggataatagcatttttcttggtgggatcaaaatgtttgtcaataaaccaaagtttgaaagggataccgtgaatagaggccatctgcatggtactcttacaaatggaaaggggagaatacaggaggtggacaacggtggtcagaaaacatatgacacgggcggaagacttgggtcctatgtcgaggtggctaggggggtaataccaccagtggataacttgtctaaccagaaggtggctgtccaaggtgacaacagactcgtcctgagccctgaggaactgagatgggttttagaccccgacatcaatcctcgctattgggttgatgattgggttatcttacccaacctcgaagacgataaggcgcttcgtttagtgaatgaggaaaggacgaagggctccacacctatactggacctccataaatggtccccacatattcgtccaacacacaggttggcttgggtgctgttatggggtttaccgccaactgtgtgggaagtagtttatatggagaaggtcgtggcggagcttggggagctggtggaggttgatgaaatggtcgaggaacgttggaggatggacgcggcgcgaatcttgattaggacgaacctcaggccgggcattgccatggcggtcccagttgtcattgatggagtggatgccgttattcacatcgttgaagacatgcaggggctcagaacgaagacgaagcccaaacaatcactcacgtggtacccgccatcacctctctcaaccgagccaaacactccgatgacatacgcagctcaaaccccaggggttgataccaagggagcttcgtcggacggtgggtcacaaggctccgacggtgggttttctgggcactggcgccgtacccagtcgttccttgcgggtcgagtcaatcggacccaatctgcccacatctgccacatggattggtctgccgctgacaaacctgacatggcccaatcgtatggcgacaacaatggtgtggaggaccaaagccctaaggaacacaacaacggtcatctacgacaggaagggaaaacatttaatgcctcgtcccacagtaggtgctgcgttgacatgcaaaaggaaataattactttgaccacaatgggtgcagcggaggagcagaaagaagacgctgttgaggtggcagattttgatcagaaccaaaaaggtgtcgaggagcagaatgaagacgctgtcgtggccttgtctggttccaaagtgggtattatggagggagaaaagcaaataataggcccttttgaggaaagccaccaccattctctaccatccgtcaccggagctctgacaacctttccaggtggtggttacaacatctcgattgggcttgcgacgctcctgcgcacacccactcttttgcacgctagacttggccaaacaatgcttttctcttgcacttgtaggcgtgtggcgcaccgtcttgggctgcgcttctactgcaggagtctcttttctgagcataacctaagagtttgcctcaaacagagcatccttgcggacacaccattggagctcgattttgtttacccttttttaagtactgtttggtttgtgattttgggcactgtgcagtccattttttatgtgttttgcattgttgcgaagaagtttccagtcgcctatcctaccgttgtctcttattag

SEQ ID NO: 34315 - DNA, 2571 bp, Glycine max
  Peptide Sequence Number=SeqID_126000
atgttggttatcacaccagaaatttggttattcagcctccattgtcctcttcctcttccttttctctttaatggaggggagaatcttgatacatggaaccttttagctagagctagggatgagggacgtcttttttctaggatagtatggcctaatgatcctgagattaaagagcttgtaaagaggttgcatcttcttcttactgtaaaggactctgctgctaatgttccaaaaaatcttgaagccagaagaagattagagtttttctcaaattcattatttatggacatgccttcagcaaagcctgttagtgaaatgttgccattcagtgttttcactccatactatagtgaaactgtgctttatagtacttccgaattgcaaaaagagaacgaagatggcatatctattcttttctatcttcaaaagatatttccagatgaatgggaaaactttcttgaaagaattggtcgaggagcatccactggggacgcagaacttcaagaaaattccagtgactctttggaacttcgtttttgggcttcttatcgagggcagactctggcgaggacagtgcgtggtatgatgtactataggagggctttaatgctgcagagctttctggagagcagatcacttggagtggacaattattctcaaaacaacttcattacaactcaagattttgaatcatctcgcgaatcacgggcacaggcagatttgaagtttacttatgttgtatcatgccaaatttatggtcaacaaaagcagcgaaaggcaccagaagctgctgatattgctttattgttacagaggaatgaggcactccgagttgctttcattcatgttgatgaaagtacaactgatggaaatacttcaaaagtgttttattcaaagcttgtcaaagccgatataaatggaaaagatcaggaaatatattctataaaacttcctggagatcctaagcttggggaaggaaagcctgaaaaccaaaaccatgcaatagttttcactcgtggtgaagctgttcaaactattgacatgaatcaggacaattatcttgaagaagcaatgaaaatgaggaatcttctggaggagttccatgcgaatcatggccttcgccctccaagcattcttggagtgagggagcatgttggaaaaggaagggatgttgggttaaaccagattgccctctttgaggggaaagtggcaggtggtaatggagagcaagtgcttagcagggacatttacaggcttggacaactttttgatttcttcagaatgctttctttcttcttcacaactgttggttattatgtctgcaccatggcgttttctggtcttgatgaagctgtctcagagaaggcaaaattgcagggtaacacagcacttgatgcagctttaaatgctcaatttttggtccagattggcgttttcactgcagttccaatgataatgggttttatacttgaattaggattgctgaaggcttgtttcgagggttggttaaactggtttcgtgaccagttcccagttggattggttggtttggctgttttcagtttcatcacaatgcaactacaattgtgttctgtcttcttcactttctcattgggaactagaactcattattttgggcgtaccattctccatgggggtgcaaaatatcgtgctactggtagaggctttgttgtccgtcacataaagtttgctgaaaattacagactatattctaggagccactttgtcaaagcgcttgaggtggcattgcttcttatagtttatatcgcatatgggtatgcagagggaggtgctgttacgtatgttttgctaactctaagtagttggttccttgtcatttcttggcttttcgctccttaccttttcaacccctctggtttcgagtggcagaagactgtggaagattttgatgattggacaagttggcttctttacaaaggaggagtaggagtaaaaggagaaaatagttgggagtcttggtgggacgaagaacagacaattttgagtgcaaggttcttcttgtttcaatatggtgttgtgtataagctgcatcttactggaaatgatacatcacttgcgatctatggattctcatgggctgtcttggttggaattgtcttgatatttaagatctttgcctacagcccaaaaaaggctgctaatttccaggtagtgttgcgatttgcacaaggggttgcatctataggccttgttgcagctgtgtgtcttgttgttgcctttactcaactgtcgatagctgacctttttgcaagcatccttgcatttatccctactggatggggaatattatctttggcaattgcatggaagaagatagtttggagtctcggcatgtgggattctgtccgtgagtttgctagaatgtatgacgctggaatgggtatgatcatttttgcaccaatagcatttttatcgtggtttccattcatttcaactttccaatctcgccttctcttcaatcaagccttcagccgtggtcttgaaatttctatcatccttgctggaaacaaagctaacgttgagacttag

SEQ ID NO: 34316 - DNA, 2925 bp, Glycine max
  Peptide Sequence Number=SeqID_126001
atgaatgttgtgcctgtaggatggatgaaaaagaatgtccaagatggtatacatgatgttccttttcaatcttctcaggtggctttaaatactgtaagtgaaaatggaaatacagctcttgcattattggcttcagcatatggaaattcttctgactctgaggaagatcagattgcggttgacagtcatgaatcaaatgtgataaactctgcttcagaaagtttactttctgatactcgagattcccatgctagtcggactgcacttgataggggagattatattccttcaaagagttccagttatgaggattttatacatcgtagattagagtgttttgaaaatacaaggacggtgcctaattccacctctaattgttcccaagatgcttatgatgctaaaaggtcgttgtctagcaagtctatggttccctttgattataaaaaagctttgatggtgctacaatctgatgaagactcatccagaatgcatgttttttgtctagagcatgctgcagaagcagagcagcaacttcgctcaattggtggagccgacatattgctcctatgtcatccagattatcccaagatagaggctgaagcaaaaatggtggcggaagatttggggattgattacgtattgaagaatattgtatacaggcacgcttccacggaggatgaggagaggatccagtcggctctggacaatgaggaagctattcctgggaatggtgactgggctgtaaagctaggaatcaatctcttttatagtgcaaatcttagccgctctcctctttatagtaagcagatgccttacaattctgttatatactctgcatttggttgtagctctccagcaagctcacttgtagagccaaaggtctaccaaagaagggtcaacaagcagaaaaagattgttgctgggaaatggtgtggtaaagtttggatgtccaatcaggtccatccccttttagcaaaaagagattctgaagatattgaggatgagaaactcttacaagggttgacattacctgatgagaaaatcgaaagatcagaaagtacccccaaaagggaagctattagcagaaaatcaggtaagaaaaggaaaaagacagcagagaatggacgattcaggaaaggaagttatgctaagaaaaatatactttcagatgattccactgaagataaacccaactcacagccaaggaggattcttcgaagtaagaaagccaggcatgttgagagagactgtgctgctttgaaacgggattattctcctccatatcatcatagaaaaccaacaagccaccaaacaaacttcactgaaagtgatgcagtttctgatgattcacttgatgatgatgatcacatgcggcaaaggaggaatgttaaagttgaaaaggctaaatttatggacaatgatgtggtttcaaatgatacgatggactatgactctgattgcctgcagagggaagaacatagcagcaagcaagttgaagatatggagagagatgcaaattcagaagattttttggatgttggttctcttcagctgcaacggaagatttccagagccatgcatgttaaaagcatcagagaagaagatataatttctgatgaccaaatggagagtccttttcaaaagaggcaaaagagaattcctaaaagcaggcagggaaaataccttactggaaaagatataatatctgacgaccaactagagctgaaaatgcagaagcggcaacagacgaatcctaaaagcaggcaagccaaatacctcaacaaagaggatattgcatcagatgaccaattggaggaccattatcgtagatatcaaaggaatcctaaaggcagacaggccacatgtgtagcaggggaagatgaaatgtctgatgaccatttggagaatcattgtcagaagcagcaaacaaatttctctaggaaaaggcaaaacaaagatgttgttagagaggttaaaaacgaaatgtgtgatgaccaattggaggaccattttctgaagcagcatagaagatttcctaagagcaggcaaaataaacacactgagaaagaaatcatggatgacttagctgagaataattctcatctgctgcatagaactcctaaaaggaagcaagctaaatgcatggaagaagatgatatgaattcagatgatgaaatggaagatgatcagccgctgaggagagcacttcgaagtaaacaagctaaaccaaagacacttctgaaacaagctaattccttccaagcgaaaaagcaggcatctcggcccataaaacagggctctcggttgcttgtgaaatcaaaggctcctcagcaaataaaacagcctgctcatttgcggaataagcaatctaataacacccaggaatttagtttatatatggaagaggaggaagatggtggacctagcacacgccttaggaagagagccacaaaagctcaggaatctgaaggaaaattgaaagacaagcaaacaaaaaggaagaaggtgaagaatgctgcggctgcaaaggtttcggttggccatgccaaaatgaaggatggggaagcagaatatcagtgtgatattgatgggtgcactatgagttttgggtcgaaacaggagctgatgcatcataagaaaaacatctgccctgtaaaagggtgtgggaagaagtttttctcacacaagtatctggtgcagcatcgtcgagttcatgaggatgagcgcccgttgaagtgcccttggaagggatgcaagatgactttcaagtgggcatgggctcgtaccgagcacattcgagtccacactggcgcaagaccttatgtatgtgccgagccagattgtggacaaacattcagatttgtgtctgatttcagtcgtcataagcgaaagactggtcattcagcaaagaagaattgtcaatag

SEQ ID NO: 34317 - DNA, 279 bp, Glycine max
  Peptide Sequence Number=SeqID_126002
atgagctatacagcagatgaagatttcttaaatgcagatgcagtctttgactgcattggtgatcctcctgaggagagatttgatttggctttctgcggaagccttcttgagaagcaatacaaggaaggcaacaaacaccgacacggatacgggacacgacacgaatacggacacgtggacacctgtaatatccaaaatatagaacgtaatacgggtgttgtgtcggtgtcggacactgacacggacgcgtgtcggacaccggatacggcaaagggctga

SEQ ID NO: 34318 - DNA, 753 bp, Glycine max
  Peptide Sequence Number=SeqID_126003
atggaggctacaagtacattggaattggctaaaaacacgggaactggttttgggaagaaagtaaatgaattgctgtccagaatggttgttctagatggaagagacaaatctgaacttgagaagctgggaagaagggaaactaagaaggaaatggtggatagaactgtgtgtcaagctttgtggggggattccaaggtgaaatgggcagccaatccagcagtgaacagtgctggaggcactaatttgaaaatgaaaattccaagcaagactcttgttgaaattggtgataaagacccttcttttgttggatcacgagattggatcggtgccattgaattgagctttgttttggacaaacttctgggtgttacgtgcaaagtcatcaatgttagatctggagctgagcttccggaaagatgtcgagagctagcgttgcactttgaaaaccaaagtacacctaatctttctttgggacacaaaagtagtagtagtagtagcagtagtgcatgcgaggagttgactttgactgcagctgtgtactcattggattgtgccagtgaatatgcaggcaggctcatccctgtacttgttgtcgatgagctggagaatggccacagggaacttgatgaggaccttttcagtggtggcagagggattggtgttgtcagggaagtgggtggatcgacaggaatggtgagcatgtatcaaggtttgaagcaattacctcttagtacagagaatctctctggttag

SEQ ID NO: 34319 - DNA, 309 bp, Glycine max
  Peptide Sequence Number=SeqID_126004
atgagaaatcctattgaagcattatcaacatttcttctccgccgcagtgcaagtcatacaccgtggttgtttccattcccacagcatttggggttcaaagagaaaagaagaatactaataatcaaagagaaaagaaacgtagggcaggggagaagaagaagcgaaacgacaaagctcggaggagtaaaaaaaaaggctccgcaagacagacacaatgctaatagcaaaaacaagcatagaagagcatatttctacatggttttgttcagaggaaaaaggaaagcagtggcgtgggaagcgggttgttga

SEQ ID NO: 34320 - DNA, 255 bp, Glycine max
  Peptide Sequence Number=SeqID_126005
atgtgcatgaattgcacaaatcaaggaagtcactcagtctattatgtaagtcaccgagggaatcaaggaactagaaagaaatttgtgaagaagcatgataaaggcagagggccattaaagatcaatgatggctctatgcaactccagaagaagacatcaaagagtaataattgccatttatgtgggaaatctaaacattttcagaaggattgtcaaaagcggattccttaccatcaaaaccataagcccaaatga

SEQ ID NO: 34321 - DNA, 194 bp, Glycine max
  Peptide Sequence Number=SeqID_126006
atggaaggcaaggttggccagagtttgcaccttatgatgccattcacgttggagcagcagcaccagaaattccccaaccacttattgaccagttgaagcctggaggaagaatgttgagtcctgttggaaacatttttcaaaggtggtggataatgctcaactgcgaggttactaaaatagaaccaaaatcctga

SEQ ID NO: 34322 - DNA, 432 bp, Glycine max
  Peptide Sequence Number=SeqID_126007
atgactctggaagcaagttcaataggtgaaaatgtgatagaacaaccattgatagatcatactgacaacgaggaaaatgttatagaacaaccacctataaataatactgacaacgatgtagaacaaccacctagagatgatactgacaatggtgaaaacgtgatagaacaaccacctataaataatactgacaacacaaatagtcataatttcaatcaagaactagaagacaatattttagaaataggagtagaagggaatgttgagcataataacacttctagtgaagacaatataaaaattgatattttatataatatactaagtctctttaaaattcttgtaaaaaaagactcctttaacattttcgccttaagctccaaaatgtctgtacacggtcctgtttgtaagcaaaccatgtatcccttctaa

SEQ ID NO: 34323 - DNA, 724 bp, Glycine max
  Peptide Sequence Number=SeqID_126008
atgacagaggcacaaagagagggagacatcatggtttcttctaatggactagctactacacaacctcttttttcttttggattgatttctgatgttcaatatgctgacattcctgatggtcgctcattccttggtgttccacggtattataagcatagtattcttgtgttgcggagagcggttaaagaatggaacactcatcagaagcataagtttgctattaattttggagatattgttgatgggttttgtcccaaagatcaatctcttggtactataaagaaactagtggacgaatttgagatgttcaggggaggacctgtgcatcatattattggcaatcattgcctatacaatcttcctcgcagcgagttacttccattattgaagatcaaaacacttgatggccgtgcttactatgatttctcaccagtgcctgaatatagattcgtagttcttgatggctatgatatcagtgccattggttggccaaaagatcatccaaaaacattggaggccttgaaaatcttaagggagaagaatccaaatgaaaataagaacagtccaataaatatggaggggcttgaaagaaggtttctcatgtttaatggagccattggaaaggaacagatgaaatggttggatgatgttctcctggaggcaacaaaattgaaacagaaagtggttatttgttgccatctgcctctagatcctggcgcggcaa

SEQ ID NO: 34324 - DNA, 540 bp, Glycine max
  Peptide Sequence Number=SeqID_126009
atgacgaaggagaagcctcaagcccttgccttaaggaggaaactggacaagcaattgaagttggaactgaccaacagtagtccaagaacttgggggtcttcaatatatggtattggggtggatgcagatgatctcaagtctgatggaggaaattattcagtgttcaattacactgatgaggatcaacatgctaaatctctttttcgttgtcctttctgcgattttgagtttgaattttcttcggcccatatctgcttggaagagctttgtcctatgtgtgacaaaaaattagggaaggatgcaatcagagttgcacataattcaagcccacaaaagagaactttgaagtctgacaaatctagcatcttgtccggggattcagtagcgattgacaagaaaattggcaaaggtttctccagcgttgcctcagacatttccaatgccataggctctaggtcagatgcacccccgaataccggtgatgaacaggttatcgaaggcaaaagggtgaggccatcttttgttctagagttggattga

SEQ ID NO: 34325 - DNA, 144 bp, Glycine max
  Peptide Sequence Number=SeqID_126010
atggatggtataaaaactccaataatgatattgaggagcaaaaccgaaagatggctttggtggagcaagtcgacaagttggttgcttgaaaatgacatcattgaggcatatttctgggtggggatatcatttgtgcggaggtga

SEQ ID NO: 34326 - DNA, 690 bp, Glycine max
  Peptide Sequence Number=SeqID_126011
atggctgaacggtactcgccctttgtatatgttgaagatcaagatgtgttgtatgaaatatgtggttatgtggtcgagagggtactcggtttggatgcatcagtgccagtcgaaggttcatcgtcagaggagtcggttggaagcgggtcgggagttcgagggtacaatgatgaagtttttgaagtttcatctgactcccactctttggggttgaatttttctagttcaattgacctcttagcaatcgaggggtctagtgacattttgccatttttgagccaattgcaaaaaaatatgggtaaaaaggtgggtgggagtgttgtagctctgatggtggccactattgccgagacggggacctccacaggagctttccctcaacctaagaagcgttcggtgcttaaggaaaagtgcttgcctccccctatcacgcttctcgggtacatgtgggttgacagggaggtcaggatatatcttacacggccccatggtgggcgccaaaatattcatgtcacaaatgaactgaaaacttacccttacgccaaagagtcttctgttgtgtcaaagggtcttctcggtcctcttacttgggggttcacccctctttatactaaccttactgggcctgagatctgtggtcctaaatgtcctaattaccagttaagtaatacacctcttaatcttgcttag

SEQ ID NO: 34327 - DNA, 486 bp, Glycine max
  Peptide Sequence Number=SeqID_126012
atggatgttcggtggattcggtgtcggaggaagaggagaagcggagttggtttgtccagtgtgccgagatttcaacgctgcgatgttaatgacggtgaacgtgcacatcgacagttgcctcgcacggatagtgatggaggagcagcggcggatgaggcggtttggttgaaaccaaaggcgtcaagaggagaagctgccgccagagatcaaatggtgttgaaacttttgtcatttaacgccaaagaggtttcgattacggttacgaagttttggtggctctcagagcggctcaaggccttgagatccaacataatttcctttgtttcagtgaaatttgttggaggaaactcgaattccacaaatgaggagaaggaattgaagatgctttgtcttgtttgtatggttttcagcaccgcaatggtgaccgtggcgaatgcgcacatagacgattgtctggtaatggcaataaagaagaatgagttgtga

SEQ ID NO: 34328 - DNA, 2424 bp, Glycine max
  Peptide Sequence Number=SeqID_126013
atggaagagccagaaaaccacaccttacattcccaacttattgtagataatcccaatgagatttggaaaagtgaaaacatcttacgattttttctaccccaatttaccctcctattgtttttcattgtctctatgactcgttttatacactacatcctcagacctttcaatcaaccacattttgttgctgaattttttgcaggtttactgctatgtccagaaatagttggaaaatcagaaattactgcatatgtgatacctccaaaagcactccttggtgtagagacagtggcacatgtgggtctcatctacaatgtcttcctaaccggcttggagatgaacctagacgctgtcctactagcgcgaaaaaaggcaaccaccattgctattgctgccaccatcattccaatggcgttagggactgccatatattctttaggtcaagctctctacccagatgataagtcatctttcaacacacctagtgcatatttattctgtgctttggttcttagtgtcacaaattatcctgttctagctcacattcttgctgatcttaagatcctctacacgggtcttggtagagtggctgtaaccgcagccacaattaatgacttctacaattgggcaatgtttgtgattctgattccttttgccactcatagtgaaaaaccctttgtgtcagtgatgttgaccatgatctttgtcctcttttgctactacatgttacgcccttcacttaaccgtttgatagagaaaataacggacaagaatgaatgggacaactacaagttgtcgtatgtgctcgtaggggttttgttttgtgcacatgttactgaaatgcttggcactcactccattgttggggcattggtgttcgggctgattcttcctaggggaaaattcgcggacatgttgatggaaaggtcagacgatcttgtctctatgtatctggcaccattgttcttcattggatgtggtataagattcaacttcgcaactttcgaaaagacaaagttgcgtaatgtgatgataatcacgctcttgtcatgctgcacaaagatagtaagcactgtgatagccactggcttctatcgtatgccttttcgagatggagtggcccttggagcgcttttgaacaccaaaggcctcttgcccttagtaatgctaaacattgcaagtgacagagagattttgagtagggatttctatacaattatgacgacggctaatgttctgatgactatactagtgtctccaaccatcaactacatatacaagccaagaaagcaatttgagaaggataagctaaggaccatacaaaacctgaaggctgatgcagatatccgagtagtagcttgtgtccacaacgcgcgccaagccgcgggaatgatcaccatccttgaagcatgcagcgccacaaacgcttcccgtctccgcgtgttttctcttcaactcatcgagctcaaaggccgcggcaccgcctttcttgtggatcataacagttctcatcaatcacaagctgacaccgaggccattgccaatatttttgccgaaatctcgccggagcaagggcacacaaacaccagcctggagactctcagcgccgtctcctcctacgagaccattcacaaggacatctacaacatcgccgacgagaaacgcgcctcgttgattctcatcccgtttcacaaacactccagcgcggaaggtaccctagaagtgaccaaccccgcattcaaggagataaaccaaaacgtgatgaactacgcgccatgttcagtgggaatcctggttgatcgtgggcacgggtcgttatcgaaggtaagcctgcgtgtctgcgtcgtcttcatcggtggccccgatgatcgtgaagccttggccatttcttggaggatggcgaagcaccccgggatccatctctccatggtgcatgttcttttgtacggaaaggctgctgaagtggacacaaatgcaacaacaaatgatgaatcgcatgggatattgtctacaataattgatagtgggaaggagaaggagttggatgaggagtatgtgagtttgttcaggctcatggcggtgaacaacgaggattcaatcacatattctgagaaggaagtgcacactggtgatgatattcctttggtgcttaatgagttggatagagggagctatgatttgtatattttagggcatggaaaaggaaggaactctttggtgttgtcgaatttgatggaatggactgattgccctgaacttggggtcataggggacatgcttgcatcgaatagctttgattcttgctcctcggtgcttgtggtgcaacaatatgggtttgggggaatgaactttaataagggttccaacgaagctacttcttcaaaacatggggatgttgaagccctttttgggaagggagagtag

SEQ ID NO: 34329 - DNA, 2103 bp, Glycine max
  Peptide Sequence Number=SeqID_126014
atgacagttacatggacaagtggatatgacataaatgaagctgtgccttttgttgagtggggaccaaagggaggaaagaaaacacgatctcatgctggaacattgacatttaaccgaaacagcatgtgtggtgaacctgcacgaactgttggttggcgtgaccctggttttatacacacaagtttcttaaaagaactgtggccaaattttaggtacacttacaagttggggcatatgctgtctaacggttcttatgtatggagtaagaagtattcattcaaggcatccccatatcctggacagaactctttgcaacgtgttatcatatttggtgacatgggaaaggctgagcgtgatggttcaaatgaatatgctgattatcaaccgggttctctaaacaccacagaccaactcgtcaaggatttagaaaattatgacattgttttccacataggagacatgccttatgcaaatggatacatctcacaatgggaccaattcacagctcaagtgcaagaaatttcgtcaacagtaccatacatgattgcaagtggaaatcatgaacgtgactggccaaacacaggatcattctatgatactccagattcaggtggagaatgtggagtccctgcagaaaccatgtattattttcctgctgagaatagagccaaattctggtataaagcagattatggcctgtttcgtttctgcatagcagatagtgaacatgactggagagaaggatcagaacaatacaaattcattgagcattgtcttgcaacagtagatagaaagcatcaaccatggctaatcttttcagctcatcgtccccttggctactcctctaatctttggtatggcatggagggttcatttgaagagcccatgggaagggaaagtttgcagaagctttggcaaaagtacaaagtagacattggattttatggtcatgtccataactatgaaagagtatgccccatttatcagaatcaatgtgtgaatgaagaaaagcatcactactctggcactgtgaatggaacaattcatgtggttgttggtggagggggaagtcacctgtcagacttcacaccatcaccccctatttggagtctttatagggacgttgactatgggtttggcaaattgactgctttcaatcattcatatctcttgtttgagtacaagaaaagtagtgatggagaggtctacgactcctttaccatttcaagagactacagagatgttttggcctgtgtgcacgatggttggttttgtattgctcctcttctcaggtacacttacaggttggagcatgtgcggtctaacgattcttacatatggagcaagaagtattcgtttaaggcatccccatatcctggccaaaactctttgcaacgtgttatcatatttggtgacacgggaaaggttgagcgtgatggttcaaatggatatgctgttatcaacatggagacatgccttacgcaaatggatatctcacagtgggaccacttcacggctcaagtgcaagaaatttcgtcaacagtaccatacatgattgcaagtggaaatcatgaacgtgactggccaaacacaggatcattttttgatactccagattcaggtgcagagtgtggagttcctgcagaaaccatgtattattttcctgctgagaatagagccaaattctggtataaagcagattatggcctgtttcgtttctgcatagcggacagtgagcatgactggagaaaaggatcaaaacaatacaaattcattgagcatggtctcgcaacagaaggctcatttgaagagccaatggcaagggaaagtttgcagaagctttggcaaaagtacaaagtagatattgcattttattgtcatgtccataactatgaaagaatatgccccatttatcagaatcaatgtgtgaatcaagaaaaccatcattactctggcactgtgaatggaacaattcatgtggttgttggtggtgggggaagtcacttgtcagacttcacaacaccccctatttggagtctttacagggatctcgactatgggcttggcaaattgactgcattcaatcatccatctcttgtttga

SEQ ID NO: 34330 - DNA, 696 bp, Glycine max
  Peptide Sequence Number=SeqID_126015
atggagcaaacgatatggggtcatttgccggtgctggtaagggcaaattcaaaagaatctattgaatacattcttcaggccctttggagaactcgaaaaactggtcttggcactaccgaccgatgcatcatccaagaaatgctccagctccaaaatgaatctgatctcgacccacttctggtttgcctccgaatgttaatcaggaggtgtgtttatgagaacactagcaaggaggatattccgaagctgttccccagtgaggttctgcctgaattgcaaaaactgttgacacttttgttgcacaagtttcagcgagagtggcaggaagatgtgatgaaagatcagaatattgtgcctcgattaaaggcgatgacatggaatatggcaaatctcgataaagaatcagcagaccctgcagctgttatcaatttgaagttttcactgcatccttttcagcttcaaaatgatggtcaatttcactcgggagagcaagatgtgaagttcaagttggctacagattctatagatatgatgctgaaagccatgcactgtattagagaccagttttctactgtggtaaacactatgttgaagtttgttcttttatccggattgaactttatacttgtattcgctgtgtggttttctaatgagcccgttatatgttgtcaggatgaggcactgaatgggcattag

SEQ ID NO: 34331 - DNA, 477 bp, Glycine max
  Peptide Sequence Number=SeqID_126016
atggagaagcaagtaattactagcagccaggcttcaattcataaaacaaattactataagccaattaagcacacctttccaacgagcagcaatggaacaacgaaagcaggaacagccgagaccaatccgatgagcaagtactccagctctgtgaatttctaccaaattgaagggaataacaatgccgagacaaagggtgagccagaaaggggtgtagagaaggaagaagagttcgccccatcttttgctggggtttggagccagccacggactggaagaagcagaagctgcagcaatcaatcgccaaagattagagaaagagaaaggggatcttggttcagtggatgcgagagagatgagatgagatgtgaagatgtcgccatcactaataatgtgacaccagtttcgctcatggaaggggcgagacagggtgagatggaggcagtctcgtcaatgggagggagcgagacaggctga

SEQ ID NO: 34332 - DNA, 300 bp, Glycine max
  Peptide Sequence Number=SeqID_126017
atgggaaggaattgtattgggtgttcacctgggattgcagagagtgaagcggaaagtgtggttggtttgggacggagggagagtgtgcgaagagagagtgagagagatgtgagagcggacattccgactcggaaaagcgaaaaccctttgcagtttgaagggttttacaagttggaaggagctccaccaagaagcagaagcatagcgggaaatggagttttgttcattcgtttcgtgaaatatctttcttatcgagttctctattacggaacgtgcctcgcacacgtgtggtgtgtgtaa

SEQ ID NO: 34333 - DNA, 999 bp, Glycine max
  Peptide Sequence Number=SeqID_126018
atgtggcttttagcagcagttgcttcatttatatcttgcattatacacctgaagcataaagaacatgcgaagtacaccacagatcttacaaccataaaccctcgtattttactctcaggacctgcagggtcggaaatatatcaggagatgttggcaaaagcacttgcaaaatactttggagctaaattgctcatatttgatagccattcacttttgggtggtttatcctccaaggaagcagagctgctcaaagatggatttaatgctgagaaattctgcgcctacgctaaaagtccttcatcctcagacatggccagatgcatggatccatcagctagtgaaccagatacaccaaactcctcaaatgcacccactccatatggctttgagtctcaacccaagttagaagctgataatgtaccatctacctctgggacagctaaaaattgtgtgtttaaactaggtgacagggtaaaatatagttcatcttctgggggcttgtatcagcttcagacaatttcttcaaacaattgcttatacaggggtccagctaatggaagtcgggggaaggttgtcttactttttgatgataatcccttgtcaaagattggcgtaagatttgataaacccatacctgatggagttgatcttggaggtttgtgtgagggtggtcaaggatttttctgcaatgtcaccgatcttcgattggaaaacagtggcattgaagaacttgacagattacttattaatacattgtttgaggttgcctttcactccactgatctaataaaagttgtggttagtgagagcagaaatgcacctttcattttgttcatgaaagatgcagagaagtctatagtaggaaatggagatccattttcatttaaaagtaggcttgaaaatcttccggacaatgtggtggtaataggttcacacactcacactgacagtcgaaaggagaagaaaaatattttagcagccaattacatgataatttga

SEQ ID NO: 34334 - DNA, 1998 bp, Glycine max
  Peptide Sequence Number=SeqID_126019
atggcggcgaagctagacacccacgccgtggcttccgatctgatcgacttcctcaacgcttctccaacggctttccacgccgtcgacgaggcaaagaggcgtttgcgtagcgcggggtaccaccaactctctgagagggaagtgtgggaactgcaaccgggcaacaagtacttcttcaccagaaatcactccaccatcgtcgccttcgccatcggcaaaaaggcctttggtttcccggtggatcccgagctatccccagaagcttcggttctttggctggctatgtacgttgctggaaatggattctacataattggggctcacacggatagtccttgtctcaaactcaagcctgtcaccaaggttgttaaggctgggattttggaggttggtgtccaaacctatggaggtggtctgtggcacacgtggtttgatcgagacttgactgtggcggggagggtcattgtgcgggaagagaatgctggttctgtttcgtactcacatcgccttgttagaattgaggaacctataatgcgaataccgactttggcaattcacttggacaagactgttaatgatggattcaaatttaacaacgagaatcaccttattcccatcttggcaacatcgctgaagggtgagctcaataaagtgtcctctgaaaatggtcctgttgaaagtggaaatcagaccgatggaaagaaagcaaatgataaaacaggcaccagcaatacgaagcatcaccttcttcttctacagttgcttgcaagcaagcttgggtgtgaaccagatgacatatgtgattttgaattgcaagcttgcgatacacaaccaagtactattgctggagctgcaaaggaattcattttttcaggacggctagataatctctgcatgtcattttgctcgctgaaggaagtgggcatatttgacgaatatgtctactatgaccatgatattaaccactatggtgtgaacacagagccttacccttgcatatgcaaagaggctgtttccggatttgaacccatgaccaacaagtcaccaaggcacaactttaccgctgcaccagggctcaccctcacccaagacactataatacaagagtatatttgtggcactgagtgcgtgccatacaacaaaactatttctgtagttatgatccattggagtctcacagtagcagggatacttggtgtcaacatatataaccttgggctcttcccttcattagcttctgggggtggactctgtcaagcttatctcaaatgtgggcttcataagggtacgtatggccttgagctatttacctcttcccctcaactggtgaattttctgggtgaagtctctgaaggttatattatcggtggctttgatgctttgtcagcattaatagatgctacatcttctgacagcagtcttgaggaagagtcaggtgttagaatggtggctttatttgaccatgaggaagttggatctaactctgcccaaggagctggctctcctgttatgctaaatgctgtgactagggttaccaattccttcagctccaatcccaaccttctggagaaagcagcacaattaagctaccttgtatctgccgacatggcacatgcactacacccaaattacatggacaagcatgaagcaaaccatcagcccaaactacatggaggacttgtcattaaaaccaatgcaagccaacgctatgcaaccaatgttgtcacatccttcatattcagggagatagcatcaaaacataaacttcccgttcaggactttgtggtgcgcaatgacatgtcatgtggttcaaccattggtcctattcttgctagtggcgtaggtattcgcactgttgatgtaggtgcaccgcagttgtcaatgcatagcatacgagaaatttgtgctgttgatgatgtgaagtattcatatgagcacttcaaggcattttaccaagaattctctcatgttgatggtaagatggtcgtggatatatag

SEQ ID NO: 34335 - DNA, 2367 bp, Glycine max
  Peptide Sequence Number=SeqID_126020
atggcaccaaccttacctatagagtttgctggacagaaggaatccagaaagtactctcattcacagaatatggggaaatctagaaaatactccaaaggttatgctactggctttgttcctgattttcggcatgctgttgagactattgatgaatcagaagggctgggtagcttgggaagggttgatatggaactgacggctttggcagattcttgtgcaccaaaaaggaaacgccctggcttgaatacctgtggtggtgattatgctggtagtttcaatgtaccatttcgacatttctcattatccgcgatgtcaggttttgagcgaaaggatttgaaagtgaggttaacttgggaacttgaacaagtaagggaatttcagaagaaaattgatggtatgaactcaagtgttgttggaggattgtctctcttcagtgacataaggggctgcagtgcagggcagaagaggcctaagctggagagccagcatagtacaatggaagtatcagtgccacctggtaagaaaaggcccgtaccaggacataatggtcccaagtcaaagaaaagtatgtctgagcgtcttgaacatgcaaaacctgctgcgccagtgacttcatatgctatgttgatgaaatcgtgtgagaatgtactaaaccgattgatgtctcatcaatttgcttgggtttttaacgatccagttgatgttgttaaattgaacattccagattatttcactgtcatcaagcatccaatggatttgggtactgtgaagaagagaataacctctggcgaatattcaaatcccatggattttgctgctgatgtgcggctgactttcgataatgcaatgttttataatccagcaggcaatgatgtacacatcatggccgagacccttagtaaattttttgaaacaaggtggaaggccatagagaagaaaattcctgttattgattgtgttgcgtccgagccttcaagacctactcgtgttgaaacagaaatttctgaccgagttcctcccacaaaaaagaagaaaataacaccaaatgactctagtgtcaagccagagcctgttaaaagaatcgttaccgtagaagagaagcaaaaattgagtctagagttggagacaatgattggagagctgcctgatagcattgttgatttcttgagagagcaaagttataatgaagggcaaaccaatgatgatgaaattgagatcgatattgatactcttagtgatgataccttattcaaactgcggaagcttcttgatgattacatgctggagaagcaaaaatcccaggcaaaagctggacaatgtgaaatggagcttctgaatgaatcagggttcagcaattcatcaatgcaaccttgcaaagatgcaggcaatgaacaggttgaggaggatgtggacattgttggtgggaatgatcctcctatttccaattatccttcattagagattgaaaatgatgttaccaagagaaacagtaaatgcagtagctcaagcagctctagtagtgaatctggctcttcatccagtgattcagactcagttagttcatctggtagtgagttggatatggctaaaacatcagaacctcttagtgccaccaaggaaaacataggatttggcttgacttcagatcaaaacaaaggggatcctggtaattcagaaactggaaaggattcaacaaatgtgggaggccaagttgaggagagttcccagagtaggcctgttgctactgagccagaaagccatcaagagggggagagtgctgcatctaagaggcaagtctctcccgaaaagctctaccgtgcagctttattaaggagccgttttgctgacaccatacttaaagctcaagagaaagcacttgaaaaggatgaaaagcgagatcctgaaaaacttaggattgagcgagaagatcttgaaaggcggcagaaagaagagaaagctcggttgcaggcggaggcaaaggctgcagaagaggctcagaggaaagctgaagcagaagctgcagctgaagccaaaaggaaaagggaactggaaagagaagcagcccgccaggctttgcaaaagatggagaaaactgttgatatcaatgagaacagtcaatttttggaagatctagaaatgcttagtgctgtacatgatgaacacctgccaagtttcaaagaagagacaagcacagatcaacctcaagatggattgggtgggatcaagctacagggaaatcccttggaacagctagggttgtacatgaaggatgaggatgaggaggaggatgaggaggaagaggatgaactgcctccgagtggtgctgtaggaccatcaaatgatgttgaagaaggagagattgattga

SEQ ID NO: 34336 - DNA, 466 bp, Glycine max
  Peptide Sequence Number=SeqID_126021
gcaccctctggacccagataagtccaacagggccctgggatttcccgccttgatcacaggactctgccagtcgttcgacgtccccatcacacctagcaaggtgattcggccgcccatcacccgagcttttattgagaagtactgcacgcagagacaggttccggagcagtatttgcggcatttggttcgccagcaggcggccaaccaccgggcacatgtacagactcctgattgtctttatcagatgagtctcagcctacagagccagggctttacttcttttccgtgccctactctggaccagttcagggcagaggtcgcatggcctggagattggcctgaggcccaggcaggagaggcaccagcaggggcaccagcagaggcccccgacgaggcagatgaggcccgcgaggatgaagagatgaccgatttacttgatttcttaggagggagcagtgccacatga

SEQ ID NO: 34337 - DNA, 1134 bp, Glycine max
  Peptide Sequence Number=SeqID_126022
aattcaacatccaacccatacaaataattcctggtcaagcttctgtccctgagaaactggttcccagaagaccacagggagtgaagattgctgaaaaccctagctctgcaacgagttctagggaagtagacacggagatggacaagaaaatccgcagtattgtgagtagcattctgaaagatgcttctgtgcctgatgctgagaaagatgttccaacatcgtccaacccaaatgtttctgtgcctgatgtcaagaaagatgttccaacatcctccgctccaaatgctgaagccctcccttcatccagtgaagaggaatcaacagaagaagaggataacgcctcagaggagactcctgcaccacgggcaccagaaactgctccaggtgacctcattgacctggaagaagtcgaatctgatgaagaacccattgccaacaggttggcacctggcattgcggaaagacttcaaaacagaaagggaaaaactcccatcaagaggtctggacgaatcaagactatggcccagaagaagagcactccagtcactcctgccacatccagaagaagcaaagttgtaatcccctccaagaagaggaaagaaatttcctcatccgactctgatgatgatgtcgaactagatgtctcgacatctaagagggccaagaaatctggaagaaaggtgcctggtaatgtacctgatgcaccattggacaacatctctttccactccattggcaatgttgaggagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcttagtcagggaattcattgtcaacattccctctgacatatcaaacagaaaaagtgatgattatcaaagagtgtttgtcagaggaaacatcaaattgccaaggaaatcactgccaaacgagtccagcattggccaaagaaagggaagctttcagcagggaaaactaagtgtgaagtatgcaattctgcacaggattggagctgcaaactgggttcccaccaatcatacttccactgttgccacag

SEQ ID NO: 34338 - DNA, 144 bp, Glycine max
  Peptide Sequence Number=SeqID_126023
atggtgaccaaaggttggagctttgttggagcttcaatggtggaggaagaagaaaggaatagcaaccctcggtttgcgtgtcatttctctggttccagtccctcgcgtttctctgcacccgtcggggccagttttcgaaagtag

SEQ ID NO: 34339 - DNA, 417 bp, Glycine max
  Peptide Sequence Number=SeqID_126024
atggctgcaaccatgttctcaaagcttttcaatgtaatgaggttgaatgacaaacctgcttgcagcattacaagagtccgcaaactcatcttcttcacttccatcacatccaatcggttcaccaaattcaaaatctcttatatttgccatattaccactgccagaaccatatattccttcaactcttcgattacatttgggggagttttcttgcaagctgcaacgttgcccgacttcccaatcaggtgttgtttggctcgggttattcctcccttagtgatttttccacaaaaattacaaacaatggtgtttgtatctccttccactagtgaatggcaatatttccagcctgggtctgccttatttttcctcgttgcacttgcagtagcagcatcggatgatggtttagccatttaa

SEQ ID NO: 34340 - DNA, 990 bp, Glycine max
  Peptide Sequence Number=SeqID_126025
atggctacctcaccaaaagaaacttcagctcctggttcaccctctgtaccatcatccccatcatccaccaaagcgccatcaatccaggaacaacctgaattccatatccaacccatacagatgattcctggtcaagctcctgtccctgagaaactggttcccaaacgacaacagggagtgaagacttctgaaaaccctagccttgcaacaagtcctagggaagtagacacggagatggacaagaaaatccgcagtattgtgagtaacattctgaaaaatgcctctgttcctgatgctgatgaagatgttccaacatcttccaccccaaatgctacagtgcctgatgttgagaaagatgttccaacatcttccgccccaaatgctgaagtcctctcttcctccagcaaagagagatcaacagaggaagatgatcaagccgcagaggagactcctgcaccacgggcaccagaacctgctccaggtgacctcattgacctagaagaggtagaatctgatgaggaacccattgccaacaaattggcacctggcattgcagaacgattacaaagccgaaaaggaaaaacccccattaagaggtcaggacgaatcaagactatggcacagaagaagagcactctgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggagctcatcacgggtgctggactactgaagactgtcaccaagttgggagattgctatgagagtcta

SEQ ID NO: 34341 - DNA, 310 bp, Glycine max
  Peptide Sequence Number=SeqID_126026
atggcggtgcagctaatccatgatcgagtagagatggagtgcctagagggagcttgggagaccctcgaaggcaatgcgaggtgccgatttcggggcacgattcgatttacggctacttctttggcgcatccagatgaacccgtgcgcacgcttcagcgtactatggagtggatactacccacgcttacatcataccgtctagtggagccagtccaagtgatcgaggtgacgtcatccgaggaagaccctgaggaggatcccgaagagctacctcctgagcctgctgtagatactcttgactttctagagg

SEQ ID NO: 34342 - DNA, 210 bp, Glycine max
  Peptide Sequence Number=SeqID_126027
atggttatgggagatttcatcagcagactctcattccccggatacgtaggagcaagagcctcgcttttgtcgaccacaccgctttttgttgccatgactcaagagctgatacgcggagataccttacggttatccgcacccctttgctatgcagacacagttgtgtccgatggcacgcagagaccaagtttggtcattctgcacccatga

SEQ ID NO: 34343 - DNA, 396 bp, Glycine max
  Peptide Sequence Number=SeqID_126028
atggcacggaatggagatggaagagagagaggagcaccacttcaagagaagatgagtctagaagaaactcaccaccataggaggccatggataagagcttggaggaagaaggagatgaatgaagggagagggagagaagagcacaaaattttgtgctctaagagagctctgaaatctgaaataagtgggctcataatagcccatgggcctgaaatctaccctaaggctcatgagaaccctagggccttctcttgcatctctggcccaatcttcttggagtcttctatccaatgcccttggggggtaggattgcatcattccctcccccttgagaaggatttgacctcaaatcccgaggttcttgaaactcttggctttcttcctcaacacttgtga

SEQ ID NO: 34344 - DNA, 300 bp, Glycine max
  Peptide Sequence Number=SeqID_126029
atggtagcccgacctgggactcaaccttctcttcatagggaagatgaaggggaggaggcaggtgagacacaggtgagacaggtagctgctgccactcttgagagatatcttgagaccactttagagcctcttgcaccagtagtggacctaccctcacctcagcatacagcagacccctccactattattctagagatgcaagaggacccgaccacaccagtcctggctatggacacttctcctccagctactccagtacttcatctgacagatgaggaggatgttcagacacaggattga

SEQ ID NO: 34345 - DNA, 207 bp, Glycine max
  Peptide Sequence Number=SeqID_126030
atgggttttcccttgccagcagtcacttaccttgccgaaaatttatctggtctggaaggccaaggttcaacaaggtctaaggttgtgtctcccccgcggtcttttatcgtgggaaccccaatcttgatatctggggtgaaacaaatttgggtgtcaaggtgtcgatttcgggccgaacttccatattattccataaggcatgcgtga

SEQ ID NO: 34346 - DNA, 218 bp, Glycine max
  Peptide Sequence Number=SeqID_126031
atgggatcttgtcaaatgccttcacttaaaaagagtttctatcaagtcaaggtcaagagcctagggaccaccagtctaaaggagttagggcagttaatgggtcagctccagcggcaagcttttcgcaaagcttatggtaaaattcgggacttagccatggtagaagtctccacagaggccagtgcctccctcgcccagtattatgatcagccgatgag

SEQ ID NO: 34347 - DNA, 375 bp, Glycine max
  Peptide Sequence Number=SeqID_126032
atgggctcagaaatctaccctaaggttcatgagaaccctagggccttcttcagcagctctagcccaatcttcttggagcctcttgctcatggttcttgtgattggtcccttcctaaggaggattgcatcatgcatggttactttatggtctctcgcacctttcgtcaaccagggggaaacgagccggttgacgcccggagactaacatcgtcttcagcaccttttgtcatcttgacccgtgaagtcagtgacatgcggtgttacctaatggttacccccacctttggtcaaccagtggcaaacaagcccgttgacgcacagagactaggatcgtctgctgcaccttttgtcgtcctgacccgtgaagtcaggtga

SEQ ID NO: 34348 - DNA, 798 bp, Glycine max
  Peptide Sequence Number=SeqID_126033
atggcttcgagaaagctttccgcgaaaagatctaggagggacgccgcggttgaagggaccagtgccgcccccgagtttgatagccaccgtttcaggagcgccgagcaccagcagcctttcgaggccatcaaaggatggtcgttcccccgagagagacgcgtccagctcagggacgatgagtacaccgactttcaggaagagatagctcgccggcgttggacgtcgttggtcacccccatggctaagtttgacccagagatagtcctggaattttatgtcaatgcttggcccatagaagagggagtgcgggacatgcgatcatgggtgaggggtcagtggattccttttgatgcagatgccctcagccagttcctaggtgacccgctggtgttagaggaaggtcaggagtgcgagtttagtcaaagaaggaatcgggctgatggatttgacgaggaggccattgcccagctgttatgcataccgggtcaggattttgcccggaccgctgccgggaggcgggtgcggatcatgcgcaccagtatgaccactttgacacagatgtggatgacgttgctgctcagcaatgtcctacccagtgatcataactccgaccttcctctgccgaagtgtcaactggtgtatgccatcctgacacggatgagcatccatgtggctcagttgattgctgacaccatctatttatttgcaggtatgccacccaccaggcaccctctagacccggataagtctaacaggcccctgggtgatgcaatcctaccccgcaagggcattggatag

SEQ ID NO: 34349 - DNA, 75 bp, Glycine max
  Peptide Sequence Number=SeqID_126034
atggcgtttctgaggtaccgtccccgaatctttggttctataccgcgtcgggtcgttggcaatggcgtttactag

SEQ ID NO: 34350 - DNA, 119 bp, Glycine max
  Peptide Sequence Number=SeqID_126035
gttgccgtcctttgtgacagacgcgtggggtgctaataccttccccatgcgtaaatacaactcccgaacctttcacttaaaacgcacccgtgagtctcgcgttgccctcccgccgaagg

SEQ ID NO: 34351 - DNA, 384 bp, Glycine max
  Peptide Sequence Number=SeqID_126036
atgcaggttttgatgacgccgaaaagagtttgcttgataatgatcgtcatcatcaaaaaggggaagaatgtgaataatgcagtttttgatgatgctgagaagaattcacttgataatgattgtcatcataaaaaatggagagattgtgaatgttgttttcaagattacttcaacaagcattcaaaggttaagcattgcttcaagattaaggcaaggttgcttcaacaaacaagcattgcttcaagattcattgaagatcagcttttgcctcaaaacacattgtttccaacatatcaaggctctggtaatcgattatcaggcagtataatcgattaccagaagacaagtttgcaaatcagcttcttaaaagggtttgaaatttga

SEQ ID NO: 34352 - DNA, 494 bp, Glycine max
  Peptide Sequence Number=SeqID_126037
atggagttgtctcgtcacttccatcctaagaagctgtggatgggagtaacctgtgacaaggatggacatgttattggtcttgatctcagtggagaattcatctctggtggatttgacaattcaagtactcttttcagtcttcaacatctacagagtctaaatttagctgcaaattgcttcttgtccaagattccatctggattcaacaagttagagaatttaacttacctgaatctgtcagaatcttcctttatggggcagattccaatagagatttctcagttgacaaggttggctactctagatctctcttctatttcctatgcaagagggccaaagctgctacttgagaacccaaatctacaaaagcttgtccaaaatctcaccagtattaggcaactgtatctggatggtgtagatagaactgctccaggacatgaatggagcaatgctttgtcgtcgctgcatgacttgcaaggactgagcatgccagg

SEQ ID NO: 34353 - DNA, 963 bp, Glycine max
  Peptide Sequence Number=SeqID_126038
atgctttcctcaacattcgttcgtaccaaagcagggcgttccaagcctgtccgacttaccgcagtggtcgcggccgcccttttcctggcaggctgtccaagtcgggccccgcaaacgccgcccgccaatatacaggacgaagcgagcgccagctccgattactacctgcagcagttgcagcaaagcagcgatgataacaaggctgactggcaattacttgctattcgcgccttgctgcgtgaaggaaaactgccgcaggccggcgaccagttgaatcagctgccgaaaaacctcagcggcgcgcagcagactgaacgccagttgctgaccgccgaactgcagatcgccaacaagagctacgtcagcgcccgcagcacgctgggccacctggacagcggttcgctgtcgccgaatcagaaggtgcgctactaccaggcgcagatcgccgccaatcagggcaaagcgtcgctgccgttgatccgcgcctatatcgcccaggagccgttgctgaccggcaaaccgcatcaggacaacctggatcagacctggcaggcgctgctgcagctcacgccgcaggagatgaacagcctggtgatcaacgccgacgagaacgtgctgcaaggctggctggatctgctgcgcgtctatcaggacaacaagcaggatcccgatctgctgaaggccggcatcaaagactggcagaaccgttatccgaagaacccggcggccaaaacgctgccggctcgcctgaaccaggtgctgaacttcacccaggcctccacctcgaaaatcgcccctgctgctgccgttgaacggccaagcgaaagtgttcgccgacgccatcctccaaggcttcaaagcggcgaaaaacggcggttccatgccggcgccgcatcctcacgccgcgccaccggccagcgcaccggcccaaacggcgccggccaatcaggccgccacgggtga

SEQ ID NO: 34354 - DNA, 372 bp, Glycine max
  Peptide Sequence Number=SeqID_126039
atggcacctactaggcaccctctggacctagagaagtccaacatggccctggggtttccatctctgatcacgggcctctgccattcctacggagttcctgtcacccccagcaaggcggccaaccaccgtggacaggtgcaaatacataagtgtctctaccggttcagcctcagtcagcaggggcagggttccgccccttttgtatgccctaccccggagcagtttggggctgaggtcgcatggcctggagactggctcgatgcccaggcaggggaggagcctgcaggatcccccagtgaggcggatgaatcccatatggatgaagatatgactgacctactcggtttcttaggagggagcggagccacatga

SEQ ID NO: 34355 - DNA, 336 bp, Glycine max
  Peptide Sequence Number=SeqID_126040
atgcaggggtatcttatggttatccgcacatttctgctaatcctgaccagtgaagtcaggtggcaggcggagatacccgagtggttatccgtacaaagacaacttctattaatcctgacccgtgaagtcaagtggcatgtggggggttaccttatggttatctgcacatttttgttaatcctgacccgtgaagtgaggtggcaagcagagatacccaagtggttatccgtacaaagacaacttccgttaatcctgacccgtgaagtcagccggcatgtgggggtacattatggttatccgcaccttttgtcaaccagaggcaagcgagcccgttga

SEQ ID NO: 34356 - DNA, 266 bp, Glycine max
  Peptide Sequence Number=SeqID_126041
ggagtgcctgtcacccccagcaaggtcatcaggccccctaccaatcgagctttcatcaagaagtactgcgcccccaggcaggcgcagggcgaaacaccacatcagcattgggatggccggtagcgggcaatagacacactgccaccacctctagagttcacctcagctcatccacaaaaagtcatattgggacacacctagttgctcatgatcctgggaatttaaataaaacaagcgcaagctcggaaggtagaaagataccttag

SEQ ID NO: 34357 - DNA, 366 bp, Glycine max
  Peptide Sequence Number=SeqID_126042
atggagaaaggacaagggcggtcttgcttggcgcaaaggctgctgttgaccggaagagaacttcgattcgcccggccagcagcgggcggcgtgcttatcttgtgtgacaacactacagagcgagtggctcttctaggcgggcagctgtgtgacaacactacagagaaagcggcgctttcgtttaacatgctatggtctcaacgcccttacgagatagtgatgagtttcacgcgctctaagcccggcccgcgcgcggttaggaagattggccgcaatctgagcggtaccacccaccctaccctaccacctataggcggccgtccgttctacagccgcccgaaaaggaactgcagtgatcttgaatag

SEQ ID NO: 34358 - DNA, 291 bp, Glycine max
  Peptide Sequence Number=SeqID_126043
atgcatttgaaaaggacacacattctcacgctcaaggcattgcgtcatgtcgcaacctacccttcggcgggagggcgacgtgtgactcgcgggatgcgtgttccacgaaaggaatacgcgcggagtcgccaccaacgtttatttgaggaaaacgtcggaaaaactggtaaagacgcgatctatgaacttttaagcgaaaggttcgggagttgtatttacgcacggggaagggtgtttccctttgctcctacgtattcctcaatttgggatgagaaaatcagacctacgtag

SEQ ID NO: 34359 - DNA, 609 bp, Glycine max
  Peptide Sequence Number=SeqID_126044
atggttagaacacgaggtttaggtcgtgcgttaggagctggtagaggtagaggcattagtgaggatgcgcatgaggccgatgttcctcggcgttgcaggcctactgcttcagcacagatgacaggcgccgccgatgctgttcagacagagggagtggctactgatgggagcttggggtcacctgctgcagatgagggattccccagtggaccacgcgacccatcgattttgaccgattatgctgagcatgaacgacccgatctgaagttggtctcccacggtagaaaagtagataaaattgggagaccagcgcctgagatcgaagggttgattgctggcaccagattgagtccactgatcaggtgttatgttatcaccactgatcctggactcatatccgccttcgtcgagaggtggcatcgcgagactagcacgttccacctgccagtaggcgagttgacgatcacgttgggtgacatggcgtcactcctacaccttcccatcactggcgcgctgcatacgttcgagccgcttgtcacttcagacgccattggtctactgacggagcttcttgaggtcagtcatgaggaggctacatttgagacctga

SEQ ID NO: 34360 - DNA, 407 bp, Glycine max
  Peptide Sequence Number=SeqID_126045
tggcatatgcagatgatgttgtcagggtaagtgtagaaacagttattgatcctgaggctgaggtcccctatgccacctcagaaatacaatatgtgaagcaggccgtctatacatttgtagcttggcccacacaccttgtgaaagctgtattagatgaggatccacaaagtattccacacaacgaggatgcacatgtgccgaagccggctaatatggacgcagatgatccgttacgtgggattgataaagatagacgcagcgaatgcgaacaatatcttgaaagatggcttaaggaatctgaccgagaggtgtacattggaccttacttccatcatgtaatgacaaaattgaagaagaccttgtctcctgaaactaaggcggttgcacctaagtggattgaagtaaag

SEQ ID NO: 34361 - DNA, 650 bp, Glycine max
  Peptide Sequence Number=SeqID_126046
gcaatccatctgacttacaaccctttgatcctgagatagataggacatttcatagattagttaggcatcattttataccttttgatcatcgtgagcattccattactggtgaatctgtgcattcagtaattggtgattttaaacatcctaattttgagcattacaattttgagcattctaattttgaacattctgagaacatagcacaacctccaccctatgagaggactctaagggaaatggctgcacctgatttcacctacgaaagcttgtgcatccaataccctgataaggatgtcccatatgttcttaaaactggactgatccatttgcttccaaagtttcatggccttgcagagggagtggcaaaggactggctgtattaccttgctctaaggtccatcatgagctgggatgaccttaagatagtattcttagaaaaaaatttccctgcttctaggaccacgaccatcaggaaggatatctcaggactcagtaatatggagagaagtatgatagatgctgccagtggtggagcccttggagacatgactcctgttgaagccagaaacttgattgagaagatggcttccaactcccagcagtttagcaccataaatgatgccatagtcattagaggagttcatgag

SEQ ID NO: 34362 - DNA, 438 bp, Glycine max
  Peptide Sequence Number=SeqID_126047
atgaatttgctcagaacttcggtattcaattccgagcgtctcgacatattacgtgactcaatccgacatccgagtaaaaagttattgtcatttgaattttctcagagccttcggtattctatttcgagcgtctcgatatattacgggactcaatcggacatccgagtaataagttattgtcgtttgaattggctcagagcttcggtattctattcgagcgtttcgacatattacgtgactcaatccgacatccgagtaaaaagttattctcgtttgaatttgctcagagcttcaccgtattcaatttcgagcgtctcgatatattacgggactcaatccgacattcgaataaaaagttattgtcgtttgaatttctcagagcttcggtattcaatttcgagcgtctcgatatattacgtgactcaatccgacattcgg

SEQ ID NO: 34363 - DNA, 1446 bp, Glycine max
  Peptide Sequence Number=SeqID_126048
atggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcgcttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactcccagcccgatcgattctttgttgggatccttcctttcttcaaacggaacgtacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagggatttgctttttctattgattcctccggattgggtcaaaaacatttcttgaatgagttattcaactccagggatgaatcgaaaaatcactctttattggttctacctcctcttttttatgaagagaatgaatctttttatcgaaggatcataaaaaaatgggtccagacctcttgcgggaataatttggaagatccaaaacctaaaata

SEQ ID NO: 34364 - DNA, 523 bp, Glycine max
  Peptide Sequence Number=SeqID_126049
tctaagtgaagaacttcgtgactattatgaaggaaggcataggtcacatcttagacctcactcccatagcagagaaaaggaaagaaagtatcaagaggctaacattaacctcccatacttccatgggaaggacaatgtagaggctaacttagattgggaaataaggatagagcaacaacttaaaaggaagtctacttcaaaatcttatggctctcactcttatccaaagaaagaccaaggtcaaggcatttttggggtgacaacttctaagcccaaagatcataaagggaagacaatagaaaagcaaccccttaaggctagtatgcaagagaagactagctctatgaagtactttaaatgtcttggaagaggacacattacttctcaatgccccaccaagaaaaccatgattatgaggggccaagaaatttatagtagccaagatgaggctactacttcaccttcctctagtgaaagtgaagaagcaaaagcatctacccccaagaagaaggacaacctttaa

SEQ ID NO: 34365 - DNA, 450 bp, Glycine max
  Peptide Sequence Number=SeqID_126050
aaggacttgatttgggaggatattcaggcggaatttgaaatcccagaggcttctgacagtaggatgaaaaggaagttacttcagactcagaagctcctgactgagaagaccaggaagaagttggaggaagatgcacagtcaggaagcgttgatgatgtcatcgaccctccatcccccgtcagacgccacatgaagtcgaagatggtccgcaccaagaaaacaggggagatgacgactgaggctgcaaaggaaatcactgagaagatcggatccttcgtcccccgtggacatcaggatgttctcaccattgctattggacgtccagagcaccctggacgtgtccgtgctactggatctggtgtcaccatcaagaaatactttggatcggttccatggacgtcccacagctcttccttgttgcctcctgaagaattgcagcagctgacctag

SEQ ID NO: 34366 - DNA, 345 bp, Glycine max
  Peptide Sequence Number=SeqID_126051
atggcacgcagagaccaagtttggtcattctgcacacatgatacgcggagataccttacggttatccgcacccctttgccattcagacacagtcgtgtccgttggcacgcagagaccaagtttggtcattctgcacacatgatacgcgggagataccttacggttatccgcacccattctttgccattcgagacacagtcgtgtccgatggcacgcagagctgacacaggtcattctgcacacatgtttgttcctccgggaacaacaaagtcatttacatgcggaaatttcggtcgcccgcgactctcgtcaaccgagaggagcgaaattagtgtcatacactga

SEQ ID NO: 34367 - DNA, 267 bp, Glycine max
  Peptide Sequence Number=SeqID_126052
atggctaaaaagattagtaaaatatggatcaaatatggatggttgtcaaccacttatcaaaagaatatgaagatggagtggatgagttcattaggtttgttgttgatcatgcagaagacccaaggggggtctgtttctaatttgatgccgccagatgcattagcgagttcagggatgctgccagtaggagaagcgattccccttgtgctccacgtaggactcatgccaccattcttcttggcgaaatacatgctgagtaggcactga

SEQ ID NO: 34368 - DNA, 210 bp, Glycine max
  Peptide Sequence Number=SeqID_126053
atgaccattttccactgccattcattgaccagatgcttgaacgcctggcaggaaaagaccatattcacctgctccttcgacacttttgcctataggaggatgcctttcggccgctgcaatgcccctggattctacaggcgctttataagagattgtaacaaggtagcccttccactatccaacttgttgcaaaaggacatccccttttga

SEQ ID NO: 34369 - DNA, 243 bp, Glycine max
  Peptide Sequence Number=SeqID_126054
atggactcaggaaggttccaagttagcgtaccaggtcaatcaaagaatgagttcaagatgttcaagatagaatcaagaacacttcaagattcaagaggaaagttgaattcaagaatcaagaatcaagattcaagagatcaaggttcaagactcaagattcaagaatcaagaaaaggctattcaacaatcaagagaaagcttaatcaagataagtatgaaaaggttttttcaaaaactgagtag

SEQ ID NO: 34370 - DNA, 468 bp, Glycine max
  Peptide Sequence Number=SeqID_126055
atggagagaagtatgatagatgctgccagtggtggagccctcaccaccagatttctgaacagctgctcctccaatattcaaaaccttttcctcaacctcagcagcaaaatctgccacaacagaacaattatgacctctccagcaacaggtacaatcccgggtggaggaatcatcccaaccttagatggtcgaatccttcacaacagcagcaacaacaacaacaatagccttattttcaaaatgtcgggaaagcagtgtcaaggacctcaaccagtagcatcttcctcatccgcaaatgaacctgcccaacctcactctactctagaaaaagatgatgacaaaaatttaaagagtaagttacctaacaatttctatgcagaagcagcatatccctcttccattccctccaagagcaatttccaacaaaaaaatggaagaggcagagaaggagatcttgaaaacatttag

SEQ ID NO: 34371 - DNA, 168 bp, Glycine max
  Peptide Sequence Number=SeqID_126056
ggcgaaacaccacagcagcctggggatggccagcagcgggcaacagacgcaccgccatcacctctagagttcacctcagctcagcagcctggggatggccagcagcgggcaacagacgcaccgccatcacctctagagttcacctcagctcatccacaaaaaggttag

SEQ ID NO: 34372 - DNA, 369 bp, Glycine max
  Peptide Sequence Number=SeqID_126057
atgggatcaagtcaaaagccttcgcttagaaagaggttctatcaagtcaaaatcaagagcttagaggtcactagtttacgagagttggggcaattaatgggtcaacttcaacagcaagccttccgcaaagcctatggtgtcctctttccaaatatggaagggttagtggacctagcagcgattgacgctttcctcgcctttcatcatggcaagggaagcccggtcgtcgccattttggccatgcatgacacgttcgacaagagatgtgaaaagagcggcgcaagaattctttgttgtacaccggctctctatgtgtggctggtttcgcacctttttctccaagaaggtaggcccgtctatccgctataa

SEQ ID NO: 34373 - DNA, 438 bp, Glycine max
  Peptide Sequence Number=SeqID_126058
atgtacaatgtaggtcggctaggtttttttgtgcgagctcaaccgacgttttgttacggccgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 34374 - DNA, 183 bp, Glycine max
  Peptide Sequence Number=SeqID_126059
atggtgctggtagcggctattgcagccgcattgacctccattatctcttttatgctcatcatggcctccatcattgtggccatttgctctttcgaggcctccgtgtcgaccttcatctgctcttgcacctcctttacttcacccattactctagctctagcacgagttcggacatggggttga

SEQ ID NO: 34375 - DNA, 138 bp, Glycine max
  Peptide Sequence Number=SeqID_126060
atgtcctacgctgttaaggataatcgaggcaagtgggcctcgaattatgaaggacctttcgtgcaaggagcagaatcgtctcaggccacggtcagaagtcaagacaagtcgatggcagaaatcaaccaaggtacttag

SEQ ID NO: 34376 - DNA, 387 bp, Glycine max
  Peptide Sequence Number=SeqID_126061
atgtcaatttcaatcgtctcgatctactacggtactcaatcgtacatccgagttaaaagttattgcggtttgcatttgccacgagcttccgctttaacctacgagtgtctcgatatattacgagactcaaccggacatcagagtaaaaagttattgtcgttagaatttattctgagcttccgttttcaatttggagcgtctcgatatattacgggactcaatcggacatccgaagcttctgttttcaattacgagcatctcgatgtcttacgggactcaatcggacatccgagtaaaaagttattgtcgtttgaatttgctcagagctgcggtaatcaatttcgatcgtctcaatctattacaggactccatcggacatccgagtaa

SEQ ID NO: 34377 - DNA, 537 bp, Glycine max
  Peptide Sequence Number=SeqID_126062
atgatgtttatgaatgattggagtacaagcattggtttttctccagtgtacggtttccttgagccccagtctatacgctgcataaaggacacgcgtgaagaatgtcaaaagtacatagaaacgtgggtcaaggagtcacatcgagaaatctacttaggaccttacttcaatcaggcacattggcaacttcttgtgttgtgtccacgagagaacattatagtatggttatgttctatacgaagaaagcctgatgttcacattaagtttgcagtgaacaaaaaatatgcagtaatctccaaggcaaggacaatgcacctccacctccaccttaatggattgaggctaagccatgtacaacaaggaggatatgagtgtggatattatgtgatgcattggatgtggtgcatcgttagtgccggtttgaaaaatgaactccacaattatttttcagatggaacagcattagacactgacaccatgacgacaatacacaagaaatgggcagcctattttctagaagttggaaaatggatgtaa

SEQ ID NO: 34378 - DNA, 357 bp, Glycine max
  Peptide Sequence Number=SeqID_126063
atgtccaaggtccaatatggaaagaatttcagaggatttccaatcctagcaggaaaagggggggaacggatactcaatttcaacaatacgtggagtactcccgatatagcagtaaaagcaagacgcgtaggcggatcaactcatcaagttcccgttgaaataggatccacacaaggaaaagcacttgccattcgttggttattgggggcatcccgaaaacgtccgggtcgaaatatggctttcaaattaagttccgaattagtggatgctgccaaaggtagtggcgatgccatacgcaaaaaggaagagactcatagaatggcagaggcaaatagagcttttgcacattttcgttaa

SEQ ID NO: 34379 - DNA, 345 bp, Glycine max
  Peptide Sequence Number=SeqID_126064
atggcttcctcttcaagctcgattctttgtaggtcttcacatagcaaaatctctcaaactctctggaacttggacctttctctctctagaaaaccctacacatgcagaagcttcaagaagagcgcaactctagaccgcttgacgctcattagtggatttcggcttagcgcgtgcttttctcgcttagtggatggactgaagcagtgcgcttcactggatgacccttcgctcagcgaacatgcacaactcatccttcttccagattcttactcgcgctcagctgaaggagtggtgcgctcagcagatgccttgctaagccagcagattggcttagcgagagactga

SEQ ID NO: 34380 - DNA, 427 bp, Glycine max
  Peptide Sequence Number=SeqID_126065
cgccacgcttcccgaagggagaaaggcggacaggtatccggaaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagctggaggtgggttggttgcagttgccatcagcagagtgaactttggattgcagatgaagtggaggagagacggagttgcagatgaaggagaaaaggaaatttag

SEQ ID NO: 34381 - DNA, 584 bp, Glycine max
  Peptide Sequence Number=SeqID_126066
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgaccagcttggcagcttggtcgcaggattcgacgaaaaaggccatggaatcgaaggctccgaattcaaacttgagtccggcaaagagctcaagccgattcagcctggcgagttaggatttcacatagggagtgatgatgatgatgacaaggagacaaaaatttggcagagattctgtcactccggtttcagtgttgaagaagttgtgatcacacctagatag

SEQ ID NO: 34382 - DNA, 765 bp, Glycine max
  Peptide Sequence Number=SeqID_126067
atggccccgaggaagcttgcctcaaagaggtccaggaaggataaggcggccgaaggaactagttccgctcctgagtatgacagtcaccgctttaggagcgctgtacaccagcaacgcttcgaggccatcaagggatggtcgtttctccgggagcgacgcgtccagctcagggacgacgagtatactgatttccaggaggagatagggcgccggcggtggacatcactggttacccccatggccaagttcgatccagaaatagtccttgatttttatgccaatgcttggccaacagaggagggcgtgcgtgacatgaggtcctgggtaaggggtcagtggatcccgttcgatgcagatgctatcggccagctcgtgggatatccgttagtgctggaagagggccaggagtgcgagtatggccagaggaggaaccggtctgatgggttcgatgaggaggccatcgcccagttactatgtataccgaggcaggattttgcccggactgctgcagggaggcgagtgcgaatcatgcgcaccaacatgaccaccctgacccagatatggatgacgttgctcctcagcaacatcctgcccaccgatcataattccgacctccccatgtcgaagtgtcagctagtgtatggcgcctatatggcgcctaccaggcaccccttggacccagataagtccaacagggccctgggatttcccgcactgatcacaggactttgccagtcatttggagtccccgttgcacctaccaag

SEQ ID NO: 34383 - DNA, 281 bp, Glycine max
  Peptide Sequence Number=SeqID_126068
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgcttaattttggtggaattgttgcctttggagctttgggggtaccgagctcgaattcgtaa

SEQ ID NO: 34384 - DNA, 222 bp, Glycine max
  Peptide Sequence Number=SeqID_126069
atgttacggaaccttgcggattacataatcatcccttttttgacttacggaatgttacggaacctcactaattgtgcaacgatgcttccatttgatttccgtgatcaaggggttcccatgaaccctaagagaataaaggtcattcctgagtggcccactccaccaagtataagaaaattttggggcttccatgacttaacaaacttttacaaaaggtgttga

SEQ ID NO: 34385 - DNA, 490 bp, Glycine max
  misc_feature (28)..(28): n is a, c, g, or t
  Peptide Sequence Number=SeqID_126070
gaacgatccagaaacgggtgactcagancaatgcgggttgtacatcgaagaaaatccttcccgcctggttgccctaggaagagtttatgagggatccacaaacattcacaacatccctttgttgcatgatcaagtgaaggtcggtgtagaggaggttaaagatgcagatgctcccattcctatacccactaacgaggttattttagtggggcagacacttaacaccttccttgcttggctgacacatctcgtcaagcatttatcagaacaaggagctgtgggaccagcaaaacctgcaaatagactggatcatgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34386 - DNA, 942 bp, Glycine max
  Peptide Sequence Number=SeqID_126071
atgtgtgacaagcaagaaggccaagggcatattgtggcattgtcacaattacgtttggcattgtcacaaatcagaggactacacgtcctcaccttcagagcactgcacgtcctcgcaatcagagggttgcacgccctcaccatcagaggactacacgtcctcgtcatcggagagctgcaagccctcaccttcagaggactacacgtccttaccatcagaggactgcacgtcctcatcttcagagggctgcacgcccttgccttcagagggctacacgccttcgcctttagaggactacacatcctcgccttcagaggactacacgtcctccccttcataggactacatgtcctcaccttcagaggactacacgtcctcaccttcaaaggactacatgtcctccctttcagaggactacacgttatcacctttagagggctacatgccctcaccttcaaaggactacacatcctcgccatcagagggtcgcgtaccctcaccttcagaggactacacatcctcgccatcagagggtcgtgtaccctcaccttcagaggactacatgtcctcgcctacagaggacaactcgtcctccccttcaaaggactatatgtcctcaccttcagagggctacacgccctcgccttcaaaggagtacatgtcctcgccatcagagggctgcatgccctcacctttataggactacatgtcctcgccttcagaggactgcacgtcctcaccttcagacgactacacatcctcacattcaggggactgcacgtcctcaccttcagagggttgcatactctcgcctttagagaactgcacgtcctcgtattcaaagggctgcacgccctcaccttcaaaggactaaacatcctcgccatcatagcgcttcacgccctcaccttcagaggactgcacgtcctccccttcagttga

SEQ ID NO: 34387 - DNA, 159 bp, Glycine max
  Peptide Sequence Number=SeqID_126072
atggaggaatctcagggaattgctagagatgccgctatcactgtcggaagacacgtgagcctgcttaaaggaattaatgaaacattgggcttaatctggattttggttgtggacttgaagagggcaaataaagcagcacttaccttagttaatttctaa

SEQ ID NO: 34388 - DNA, 314 bp, Glycine max
  Peptide Sequence Number=SeqID_126073
ctgaggtgaactccagaggtggtggcggtgtgcctgctgcccgttgtcatccatccccaggctgttgtggtgtttcgccctacgcctgcctgggggcgcagtacttcttgatgaaagctcgattagtaggggggcttgatgaccttactgggggcgacaggcactccgtagaactgatagaggcccataatcagagatggcaactccaagaccctgttggactatttcgggtccactgggtgtcttgcgggtccactgggtgtcttgtgggcacgatccctgcaaatagtggatggcatcagaaatcagtttga

SEQ ID NO: 34389 - DNA, 226 bp, Glycine max
  Peptide Sequence Number=SeqID_126074
gattttcaactttcaccggaattgggtgcaagccattggtctatttgctcaagcgacctgtgctcctgagtttggacttccaagaccattcaatcagagattactcgtcttgcacgttggtggggctaccggacaacccttcccttgtgttcaagaatcccctacaacaagagacccacggtctcttaatcccttttcagaaataagaagaagaggtctctcttaa

SEQ ID NO: 34390 - DNA, 315 bp, Glycine max
  Peptide Sequence Number=SeqID_126075
atgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccacccaggagtggagcctgcggctttaaatttgactcaacacggggaaacttaccaggtccagacatagtaccccccccgtaa

SEQ ID NO: 34391 - DNA, 331 bp, Glycine max
  Peptide Sequence Number=SeqID_126076
atgtctgcagatgtaaccttctttgaagacacacccttctttccatcatctacgaaccattcttcttccatccaggatgttcttccgattccctctccatgtcctctaggtacctcacaccaagatgtcagtgaagttccatcctctccagcacatccacctgaagttgctcctccaccacttcttacatatcaacgcaggatacagccagttggttctatagtatctgaagatcctcctgattctcatccttcctcaatcaatcctcaggccatggatcctgctacttctcatccgtctgattcagactggcccattgccatccgcaaag

SEQ ID NO: 34392 - DNA, 309 bp, Glycine max
  Peptide Sequence Number=SeqID_126077
atgggtgccaagtacctcgaagtgatcaaacgaggttcgcatcccaacaacggatggtccccgaacgaaattaggacgcagaatgaccataatttgtctctgcgttttgtcggacacgatcaagcctgggcggcgagacacagaatggccataatttgtctctgtgtgccaccggactcgatcgcctctgggtggcgaaaagggcgcagaatctgtctctgcgcgtttatcacccactcagcttatctgaatgataaagggcgtagaatctgtatctacgcgtttacccactcagcttgtcgttcctga

SEQ ID NO: 34393 - DNA, 1099 bp, Glycine max
  Peptide Sequence Number=SeqID_126078
atgggaacgttattgaaaaacccgactgagcacgtcatgaggtcatgtcaccctggatatggcggacgatggcggctacttcgcccctttggtggccgagcgctcggccttggcggccttcttgaccgcatgcttcaccgccttctaggcggcttgcttgccggcggccttgcgcttggcggcggcgggcttgaccttctggcccttgccggcggtcggacccgaacgcaccagttggccggccttccaggcttcgacgtattccgtggcggcgtcgaccatgtgcttgccgatcttggaatagtcgccatcgtccaggttggccagcgaaatgcggatggaccagggcggcccgccgaacccgccgccgtccatcagcaccacgcccgacttctcggccaggcggaacaggaagtcgaccggctcgtagttggacgtcatgtatttgcagaaggcgtcgccataggtgttcttggcccagaccatgaagtccagttcgacgtagtaccagccacgcatcggatcctcgggcggcaacggcacgcccagcccgcgccacagcgcatcgcgccgcgcccgcacgatctgcatggtcaggtgcttgtacgcgtccttcaggtccagcaggtgcgacagggcgaaaaagcccatctgcacctgttgcggcagcgacaggccggcagtgtggttcagcgccacgttgcggctgtcggccaccatgcggtcgatgaacttgagcttctcgggctccatggtcatggcgccatagcgcttgttcaggcggttcttccacgatgccggcagttcggcgatgcggcggtccatggtgttcttttcatgggtcgcgatcacgcccaggcgccagccggtgcagccgaagttcttcgagaaggaatacacgcagatggtgttgtgcggcacttcggccatcaacgaacggaagttcggcacgaaggtgccgtacacgtcgtccgtcaccagcaccaggtccggattcttgcggagtcagtcccacgatctgctgtcagtgtcgaccgggctgaaggccaccgacggcggattgctggggttgacggtcaccgccagtttgagtcttcgg

SEQ ID NO: 34394 - DNA, 156 bp, Glycine max
  Peptide Sequence Number=SeqID_126079
atggaccctaagagcataaaggtcattcttgagtggcctactccaccaagtgtcgaggaaagaatccatgagtttcaagaacctttggatttgaggtcaaatccttttcaagggggagggaatgatgcaatcctaccccctaagggcattggatag

SEQ ID NO: 34395 - DNA, 432 bp, Glycine max
  Peptide Sequence Number=SeqID_126080
atggatattaacccggcttatagctgtcttttggggacgcccgtggatccacacggtaggagtcgttccctctacactccaccaaaactgaagttcgtagtggagggggtatttggtcattgtatcgggggaggaagacgtcttggtaattgcccgtcctctatgccatatgcggaatccgcggaggagtcattggaaacggccttccatattttgaggttggggaatggctatgagcccagaatgggtttaggcaagaacaacggcagcagaaccagcctggaagagcagaggccaaggttgcaattgggacgacaagtcgaagggatcccgccttgccacatcagtaggagcttaataagtgtgggtctaggacacgaaggccaagtcgtcgcgatatgcgaggatgactctccgagtgggtcagctttg

SEQ ID NO: 34396 - DNA, 672 bp, Glycine max
  Peptide Sequence Number=SeqID_126081
atgagaaagatagagcccctgtatcttgaatgtgctttggtatacttagtaacataccaagctagctctaaaggttactgttattctgtgcaacagcagggaactcaatttgaaaggaaccagtcttctgtaggttatcaatgggagtcataccaacaatctgattatcacaatgaagcagaaagaggatccaatctggataaattgttgatgcaattcaaggaaacaactaaatcaactcaacaagcactccaaagtgtagaaatccaggttggtgtgctggcagaagaagtaactcaatttatgaccagacgagaaaaatactttgtaaaggttgaagctcaagaggaaaaccctgtaaaagagcatgagtcaagagaaaaagatgaggaacaagcacaacaacaatgggagaagtactcaatagtagaaaacaatcaagaaagtattctccaaatcaataaccttcctcatcaacggattgacaagaaaagaaggcaaggagagcatgaggaaaccttaagtgccattctttctttaatcactaccacctttcttgaaataatttggattgtacttccattctacatgaaatgccaccttgaaggtattacgctatgcgtcaagctaatgaccttaaagaagtgcttcctgggaggcaacccagtttaa

SEQ ID NO: 34397 - DNA, 366 bp, Glycine max
  Peptide Sequence Number=SeqID_126082
atggatgattttagtgaggatgaggatcaacagttctttgattatatcaatcaccaaagtgatgaccaaagcgatgacaagggtgttggcagaccaacgacaccttcgtcaccttcgttgcaatatcaccaacctagttgtccagtagacttgaactttgaccacctaccacattacattgatcgacaccattttgttcaacagcaacataatgtacaaccaccaaccggtgcacttgaggttggcatgaccttcgatgaaaaagcacaatgtattcgagcaatcaaagaatacaacatcagaaatcattttgattgtagaacaatttactttgaccagagaaggctaaaactttcgtggtggtaa

SEQ ID NO: 34398 - DNA, 770 bp, Glycine max
  Peptide Sequence Number=SeqID_126083
gcctacgcgccctcgccttcgtagggctacacgcccttaccttcggaggactacatgtcctcaccttcggaggacaacatgtcctcgccctcaccttccgaggactacatgtcctcacctttagaggactacacgtccttgcctttagaggactacacgtccttaccttcagaggactacacctcctcgccttcaaagggtcatgtaccttcaccttcgtagggctacacgccctcacctttagaggactacacgtcctcgccaatagagggctgcacgccctcaccttggagagggctacacgtcctcgccaacagagggctgcacgccctcaccttgagaggtctacacgtcctcgccaacagagggctgcacgccctcaccttggagagggctacacagggctacacaccctcgccatcagaggactgcatgtcctcaccttcagagggctacacgccctcgccatcagaggactgcatgtcctcaccttcagagggctacatgccctcgccatcagagaactgcatgtcctcaccttcagagggtcacaccccctcgccatcagaggaccacacgtcctcaccttcagagggctacacgccctcgccatcagaggagtgcatgtcctcaccttcagacggccacacgccctcgccatcagagaaccacacgtcctcaccttcgtagggctacacgccctcacctttagaggaccacacgttctcaccttcagagggctacacgccctcgcctttagaggaccacac

SEQ ID NO: 34399 - DNA, 366 bp, Glycine max
  Peptide Sequence Number=SeqID_126084
atgtctcttgccactttatttggaaagctgcaggaacacgagatggaactattgagattgcaccaaaatgaagaaaatgacaagaaaaagaaaggaattgctcttaaagcatcatcctcaattcaagaagaaagtgatcaggataatgatccagatgatgatgatgatctaagtttttttgtaaaaagattcaacaagtttcttaaaaaaaagatggaaaaatctgaaaagaaaaatcatagtgaaaagaaactgaagaaagcatacatcacatgggatgaaaatgatttggaatcctctgaagattctgaaaatgaagagataaatctctgccttatggccaaaagttacgaaagtgatgaagag

SEQ ID NO: 34400 - DNA, 635 bp, Glycine max
  Peptide Sequence Number=SeqID_126085
atgccctcgccttcagagggctgcacgtcctcgcctttcgagggctccacagggctacacgtcttcgctgttagaggactacacgtcctcaccttcagaggcctacacgccctcgccttccgaggactacacgtcctcgccttccgaggactacacgtcctcgccttcagaggactacacgtcctcgcctttagaggactacacgtcctcaccttcaaaggactacacatcctcacttttagaggactacacatcctcgccttcagagggctactcgctctcagagggctgcacgtcttcaccatgggtactagtaacctcaccttcagagggctacacaccctcgcctttagaggactacacgtcctcaccttcagagggctgcacatcctcgccatcagagtgctacaccccctcgcctttagaggactacacatgctcgccttcagaggactacacatcatcgactttagaggactacacatcctcgccttcaaagggctgcacgccctcgccttcatagggctgcacgccctcgccttcagagggctgcacgccctcgcctttagagggctacacgccctcaccttcagaggactacacatcctcgcttttagaggaggggatcctctaga

SEQ ID NO: 34401 - DNA, 249 bp, Glycine max
  Peptide Sequence Number=SeqID_126086
atgaagaacgtcgaagaacggtcgaaaaccttcgcgaaatcactcgtggaaacgttacggaagcgcctcggcttggattttcttcacggaactaattttcctcagttatttcgagaaagagagaaaaaattaggggagaagcttgccacccagctcgcccaggcaagcaaggttgcttcctccagaagcaacacccttctggagggcccaagtgggcctggttgctatttgcacccccatttttactaa

SEQ ID NO: 34402 - DNA, 294 bp, Glycine max
  Peptide Sequence Number=SeqID_126087
ggtgatgcaccacaggccgcggatgcgccgccaccacatcaggctggtccagccggatcatttgacaccgagcagtatttgcggcatttgagccagggctttacttcttttccgtgccctactctggaccagttcagggcagaggtcgcatggcctggagattggcctgaggcccaggcaggagaggcaccagcagaggcaccagtagaggctcccgacgaggcagatgaggcccgcgaggacgaggagatgaccgatttactggatttcttaggagggagcggggccacatga

SEQ ID NO: 34403 - DNA, 174 bp, Glycine max
  Peptide Sequence Number=SeqID_126088
atgggtttgtttgcacaagcgacctgcgctcctgagtgttggcttccaagaccgttcaatctgaaattactcgttggttgtgaaaacaaaacaacgattggtacctcaaagccctacactggggcaatgaaaggcaccatgcaaaaacctcaagcgaacctaggggcagattag

SEQ ID NO: 34404 - DNA, 585 bp, Glycine max
  Peptide Sequence Number=SeqID_126089
atggatatgaatgttagctacatgatctcagctcagatttccatgatagctcagcatgactcctctcggctgggtttccctaccctcaccacttctttatacaaagcccgaggagtcacttcttattcattatcttttgaaagccttagcccaaccataaatttggcttatgtgaagaaaaactgttggaaccttgatgacctctcagtcacttttcggggaccccgaaagaccaagggcaagaggtctgaggctctaccatcttctactctccctaccccagctccttctacttttactgcagctccatctactctagcttcatctttactagctccagctttagctccttcgacttctacaacagctctttctgccccagctacatccactccattatcagctccagcttctactccagtttctacaggatcttcctctttcagctctgatactttatatgctatgttgcagagcctgcacaaaggccagatcatcatcatgcagagattacagagctcaggcctgcatcttatgattagcatggaggagttccttagccaggtggcttggccaggagtctag

SEQ ID NO: 34405 - DNA, 198 bp, Glycine max
  Peptide Sequence Number=SeqID_126090
ctggattgcttctggaggaagcaacccagctcgcctgggcgagctgggcgacaacctcctccccctttttcctataaataggctgaagggggttgttctaaggatcccggatgcccctggtgaggtttccgtaagcaaatccatgaaagttttcctccgttattcaccgttcttcattcgttcttcgttcttcaacgg

SEQ ID NO: 34406 - DNA, 285 bp, Glycine max
  Peptide Sequence Number=SeqID_126091
atgactaaccgcctgagatatcttttgtttccccttacaaagattcaagggactaaccgcctaagaattctttgtcttaacacattggagggtacatcctttatggtacaagtagagcgtacatctacttgggttgtaatactgagaacaagagagggtacatctcttgtggatcagttcaagtggagcatacatccacttggtgtttcaaagagaacaagggagggattttacaaggttattggaaatttcaagaaccgatggttgcttggggactggatgtag

SEQ ID NO: 34407 - DNA, 137 bp, Glycine max
  Peptide Sequence Number=SeqID_126092
atgtttctcctagcctttgacgccgccggccgtgaggccggagatgatgcgtcgctggaagatcagaacgaggacgacgaggggcgcggtaacgatgacggacgcggccatgatcgttccccagggaatttcgaact

SEQ ID NO: 34408 - DNA, 116 bp, Glycine max
  Peptide Sequence Number=SeqID_126093
aaaattacggcaccaagctgatgcaatcctatcccgcaagggcattgggtagaagactccaagtagattgggctagagatccaagggaaggccctagggttctcatgagccttagg

SEQ ID NO: 34409 - DNA, 273 bp, Glycine max
  Peptide Sequence Number=SeqID_126094
atggatgacaccaatccagttggcaccccgatggaatgtggcagcaagttgagcaagcatgacactctagacccccgtggaaccaactcttcacaaaagtttggttggaagtttacgttacttgacatgtacaaggccggatattctctatgctgtaggagtagtaagtcgctacatggaagctccaaccacaactcacttcaaggcggaaaagagaatccttcgatacatcaaaggtacaacaaactttggcttgcactattactcttctga

SEQ ID NO: 34410 - DNA, 1047 bp, Glycine max
  Peptide Sequence Number=SeqID_126095
atggtagaagtctccacagaggccattgcctccctcgcccagtattatgatcagccgttgagatgcttcacttttggggacttccagctattgcccatggtggaagaatttgaagagatcctaggatctagaatttctaagatagtccaaatctcggcgcaggaattagactacagaaagaaagtaaaaaatggggtggttggaataccgagaaaatgtttggaggcaaaagcaagaatctgggcaaatagaggcgaatgggccccgttcatagacattctcgcactgttgatcttcagaggagtcctctttccaaatgtggatgggttggtggacctagcagcgatcgacgcttttctcgcttatcatgaccacaaggaaagcccggttgtcgctatgctagccgacctatatgacaccttcgatcgaagatgtgagaagagcagtacgaggattgtttgctttactcgggctctctatgtatggttggtttcacacctttttcgccaggaggtaaggcatgcttgcccgctagaaagccatcgttcatgcacagagaaaggaggggcaaattgggaccgactcttagcaaacaaagaaggagcgtctgtcagctggttccttcgatggaaagaaggaggaaccgaggttcttatttcgtgcgaaggatttccgaatgttgccttgatggggacaaggggttgcatcagttacaatctcgttcttgctataaggcaacttggctaccctatgagagggacaccactagaggaagagctcacgcctgtcatttcacgaggttccaataagaccaacgtggaggtacttcagaaggtccgcaaggcctgggaggcggtgcaaaagaaggacaaagaactcagaggcagtaacaatgggcccatcggtggctaccataagtggttgaaagcccacgtgcaaggtttggattggctcccgagtttgagaaccgctaaaagggaggaagttgaggcaccagaggtagacgaagagatgcaggcccttagggcagaactcgagcaagcctaa

SEQ ID NO: 34411 - DNA, 1218 bp, Glycine max
  Peptide Sequence Number=SeqID_126096
atgtccgctggcaacaccgccaatgaagcgcgcgtacagggcttatccgaagtgtttgagcgccatattaaaaaccgcattatcgcggaatccatcagcctgccggaaattcctgaagcggtgatgcagcgctatcctggcgtggtggtggccatcaatcgtcttgaagcggaaggtttcccgattttctcctatgacgcttcgctgggcggcaactatccggtgatctgtgtggtgctgttcaacccggctaacggcacctgctttgcctcgtttggtgcccatccggactttggtgtcgcgctggaacgtaccgttaccgaactgctgcagggccgcggcctgaaagatctcgacgtgtttaccccgcccacctttgatgatgaagaagtggccgaacacgctaaccttgaaacccacttcattgattccagcggtctgatctcctgggatatgttcaaagacgatgccgactatccctttgtcgactggagctttgccggcacgacccatgaagagttcgatacgctgatggcgatcttccgtgcggaagataaagaagtgtatatcgccgactacgaacatctggacgtttacgcctgccgcattatcgtaccgggcatgtctgatatttaccctgccgaagacctgctgctggcgaataacaacatgggtgcatcactgcgtgaaacgctgttgtccctgccggcaacccagtggcaacccgaggagtatctggctctgatcgaacagctggatgaagaaggtcatgatgacttcacccgcgtgcgtgaactgctggggctggcgaccggcaaagacaacggctggttcacgctgcgtattggcgagctgaaagcgatgctggcgctggccggtggcgatttggatcaggcgctgatctggacggaatggaccatggaattcaaccagtcgatcttcagccctgagcgtgccaactactatcgctgcctgcagactctgctgctgctggcgatggaagaagatcgcgatccgctgcagtatcatcacgcgtttgtgcgcatgtatggcgaagccgccgtcgacgccgcttcggctgccatcagcggtgaggcaccattctacggtctgcaggtggttgaccgcgatctgcacgcgttcccggcgcatcaggcactgctggccgcatatgaaaaattacaggcggcaaaacgtcgttactggtctgcgaaataa

SEQ ID NO: 34412 - DNA, 399 bp, Glycine max
  Peptide Sequence Number=SeqID_126097
atggtggcccgggtgatgttggggaatggttacgagcccggaatgggtttaggcaagaacaacggcggcagaaccagcctgataagtgctagaggaaactgtgagaagtttaggttagactataaacccacacaagcagacataaggaaaagagttgcgggaagaaagagcggaagtcaaggcttgcgattgggacgagaagtcaaagggggcccgccctaccacatcagtaggagctttataagcgcgggtctaggacacaaaggccaagtcgttgcgatatgcgaagatgattctccgagtgggtcggatttggtacgaccatgccctcctggtttccgactaggaaattggcgagtggaggagcgcccggacatttacatgacaagtataatgtaa

SEQ ID NO: 34413 - DNA, 345 bp, Glycine max
  Peptide Sequence Number=SeqID_126098
atggagcattttcctgagcaagtagcctggcctgaagctcaacttctattgatgagacccaatgaggctgctccgcctgagcccacacttgtgcaggtcaattcagagccagctaacccacaatctctagtggtgaatccaccttcttcgcctgagcttgaagcagttcccccatctcctcctctgattgtcatttctgacgcatcatcagatgaagcagctactcctcctgattcaccagctacagaaatagctgacccccttgtttccccaattggaggaattcctaatctttctgattcgtcatctagagaagttgttgctctcaccgattcccctgtttaa

SEQ ID NO: 34414 - DNA, 159 bp, Glycine max
  Peptide Sequence Number=SeqID_126099
atggcaagttttgaagtgctgtttttcaccttctcgctaagccaatctgctggcttagcgagctccgctaagcgcaacactcattggctaagcgcaaggaagaatctggaagaagatgagttgtacaggttcgctaagtgcaccgcttcatctcactaa

SEQ ID NO: 34415 - DNA, 150 bp, Glycine max
  Peptide Sequence Number=SeqID_126100
atgtggatggaccgatttgctcttaccatgaatgggagtcaagaacttccccgattgctagccaaggccaaagcaatggcggacacctactccgcccccgaagagatccacagacttctcagctattatcttgacaaactttcagaataa

SEQ ID NO: 34416 - DNA, 396 bp, Glycine max
  Peptide Sequence Number=SeqID_126101
gcacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgagtggtggaaccctcttttgtaaaatcactcgtacacctaacatcttcatgagtgatcaaggggttcccatgaaccctaagagaataaaggtcattcctgagtggcccactccaccaagtgttgagggaaggagcccagagtatggagaacctcaggatttgaggtcaaatccttcccaaggtggaggggatgatgcaatcctaccccgcaagggcattggatag

SEQ ID NO: 34417 - DNA, 462 bp, Glycine max
  Peptide Sequence Number=SeqID_126102
atgccttatgtggaggccgcagaggagtcattagaaaccgctttccagtcttttgaggtggtaagcatttcctccgtggactccttctctgggcaagcttgcctatccgatgcagcagtaatgatgacccgagttatgttggggaacggttacgaacccggaatgggtttaggcaaagacaacggcggcataactggcctgataaatgccaaaggaaatcgtgggaagtatgggttagactataagcccactcaggcagatataaagagaagcatcgcgggaaggaagaacggtagtcaaagctcgcggttgagacaagaaggtgaaggaagcccgccctgccacataagtagaagctttataagcgcgggtctgggggacgaaggtcaagtggtcgcgatatacgaagatgatgttccgagtacattggatttggtacgaccacgccctcctgatttctag

SEQ ID NO: 34418 - DNA, 543 bp, Glycine max
  Peptide Sequence Number=SeqID_126103
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggccaatgttatacttagtccttggcgggtgctaaacctttttttacatgctgatgcaactgaatatgctaagctgccacaaattcctccgtttttacaaccaaatgttgattatagtaacggtatcaactttgcttctggtggagctggtgttcttgctgaaaccaatcaggggctggtgattgatcttcctacacaattaaggtactttgaagaagtgagaaaatcactagcagaaaagcttggaaagaagaaggcaaaggaattgatctcggaagcaatttatttcatcagcgtaggaggtaccgagctcgaattcgtaatcatggtcatagctgtttcctgtgtgaaattgttatccgctcacaattccacacaacatacgagccggaagcataaagtgtaa

SEQ ID NO: 34419 - DNA, 321 bp, Glycine max
  Peptide Sequence Number=SeqID_126104
atggcagacaacacacgcatgaaggagcttacaggggatgtcaaaaggatcctgaagatgatggaaaaccgcaataaagaatatgctgctcggtttgagaccttagaaacaacactggagatgacactcaaggataaaactagagatcctgggagtatatcactggctatgaacaatcacccttttaagtcatattacgtgcagttcacggctttagctaatcgagtacaaggaattacacaagaagctctattggattgctttgtgggaggattaaaacctgatatcagaagggatgtcattgcacaatcacctacatga

SEQ ID NO: 34420 - DNA, 452 bp, Glycine max
  Peptide Sequence Number=SeqID_126105
gaaatgccccaaggaagcttgcctcaaagagatccaggaaagacaaggcggttgaaggaaccagttccgctcccgaatatgacagccatcgttttaggagcgctgagcaccagcagtgcttcgaggccatcaaaggatggtcattccttcgggaaagacgtgtccagctcagggacgacgagtatactgacttccaggaagagatagttcgccggcggtgggcatcgctggttacccccatggccaagttcgacccaagacgtagtcctcgagttttatgccaatgcttggcctacagaggagggtgtgcgagatatgcgatctggggtgaggggtcagtggatccctttcgatgcagatgccctcagccagttcctgggataccctttagtgctggaggaaggccaggagtgcgagtatggccagaggaggaaccaggccgatgggtttga

SEQ ID NO: 34421 - DNA, 1654 bp, Glycine max
  Peptide Sequence Number=SeqID_126106
gattcaaagccatttgcaaccatttcatcgtgaaatttgagcacaatggaaacaacttcattgaggtagaggtcgttgatgagggtgttgagcatgacgacgtcataggggaggtcgtgcttgagaagcttcccgaagatgtagaatgcaagagcgaccttgtcgacgtggcaaaagcaattgatgaggatggggtgtggaatgaggaagagaaaacgatggtggtagaggttctaggtcaaggattgttcaattacttggtggtgaatttagttttgaacgagaatttgttaatggtgtttgggagtggcgagaatatgcaaaacaagttgtcaaatcttgaggaacatccgaacgcgtcgaactttagttggaactatgtcatctttaagcaatttttacaatcaaagtatggggattgggttttggggattgcaggttctttaaaagaagatctgacgagacatatatggtgggataagtggctcgaatcaaaatcgataattgataaatgtcctgatatggtacgcattccgttaaatgataggggagacacggctcttcatgtagcagtaagtcaatggagccttgaaactgtgaaagagttggttcaacgtatgagcccagaagacatgctaataccaaacttagatgggatgcttccagttcacttggctgctttatatggccgcaacataatggtgcaaattttgtcctctcagaaagtgcttgacaaaatggattccaagcatattgaactactgtttttaatgaccattaggttcaacatgtttgacatggaggacaacaaggaatcaaaagctggtccgctatttagaaaattatggactaaagttaaccaattggaacacaataggataatggacttgataactcatccttcgccagtgctgtttgatgcaataaaatcaggaaatgttgaggctgtgaagatgcttattgacaagaatcctgaattagtgacaataaaggaccccaaaaatggacggaacctactgcacttggttgtgctatttcgacaaaaaagaatatttataagtatgctatggggattggaagagcatatagtacgagcagtggaagtggacaatgaaggtaacaacattctacacttggctgcgcatcttccagttgaattccaagaattgtccagtttaagagcaagcattcaaatgcaaagagagctcgaatggttcaagacgtgtgttcctcgtgaactaagaagaatgagaaacaacatgggcaagagaccaattgatgtattttatgaagaacacaagaagttatccgaagaaataaaagatgcagccaaaggaatagccgaatatggcatgcttgtgtcaacacttgttgctaccgtagcatttgcggctgctctgacagttccaggtgataagaccaatgcgtggtttactgtcttcatattgacaaatgcagttgcattattcacttcttctgcgtctttgctctcattcttgtcaaatttcacttcatcaagattcgcacaaagcgaatttgtgaaatcactgcatcccagcttgacttttgggcgtgccttacttttcatctcggtttttgctatggttgtggctttcactgcagcctcctttttgatgtttgatcacaaatccaa

SEQ ID NO: 34422 - DNA, 387 bp, Glycine max
  Peptide Sequence Number=SeqID_126107
atgccatccagcttcgcggacctagtgttcgccagggaaagaagtgaagtagggttgaagagagggaagttcgattacgtttcctctacaagtgccaatgctaaaaggatcggaacaactggggcaaaaaggaaggagggagatgcccacgccatcacttcagcgcccgcatgggttaaacccccgcagacatctcatggtacgcatcagtacgctcaacatcatccgagcttctcagctcacgccgggaactcctctaattcagcacccatgcagcctaaggcacccgttcagagggaggccccccaagttccaactccagccacgactcgctcggccggaaatcccaacgcaacaaggaactttcccccgaggccaattccataa

SEQ ID NO: 34423 - DNA, 543 bp, Glycine max
  Peptide Sequence Number=SeqID_126108
atgaattcttttcaaaagaagaaatggctacgaaaaagcttttcgcaaagagatctaggagggacgccgcggctgaagggactagtgccggcgcccgagtttgatagccaccgtttcaggagcgccgagcaccagcagcgcttcgaggccatcaaaggatggtcgttccaccgagagagacgcgtccagctcagggatgatgagtacaccgagtttcaggaagagatagctcaccgacattggacgtcgatggtcactcccatggctaagtttgacccagatatagtcttggagttttatgctaatgcttggcccatagaggatggagtgcgggacatgcggtcatgggtgaggggtcagtggattccctttgatgcagatgctctcagccagttcctgggcgacccgctagtgttagaggaaggccaggagtgcgagtttagtcagaggaggaacagggccgatgggttcgaagaagaggccattgctcagctcttatgcataccgggtcaggatttcgctcggatcgctgcagggaggcgg

SEQ ID NO: 34424 - DNA, 384 bp, Glycine max
  Peptide Sequence Number=SeqID_126109
atgtcaaaagaagaatcaaacaaggctcattttgcttcaagattaatacaagattgtttcaacaaacaaagccttgattcaagatttcttcaagatcaagccttgcctcacaatgaaaggtttcaagtcattcaagggtcacaactgttcaagaaaaacaactgtgtaatcgattacactaattctgtaatcgattaccagagaggattttcaaggaatatcgccaacagtcacatcttatcatttggatgcgtctcgatatataatgcgtttgaatcggacctccttgtgataatttatgaccatttgaatttctcgagagcttccattgttcaatttcgagcgtctcgatatatgacgtacttgaatcggacctccgtgtga

SEQ ID NO: 34425 - DNA, 228 bp, Glycine max
  Peptide Sequence Number=SeqID_126110
atgtcgcgggggtcaggagaccttggggacgtcaggtggggtgctattgcccaaaagcttgaccaatcccgacccaccccgggcatagtcggtcagcttgaaaacgaagtcaggaaaactaagggagcctctggtaatcgattaccagcctgtgtaatcgattacacagagggatgggtcactggtaatcaattaccagatcgtgatggcggcacagctaatccgtga

SEQ ID NO: 34426 - DNA, 321 bp, Glycine max
  Peptide Sequence Number=SeqID_126111
atgtctgttgaatgggacacatggggtattggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 34427 - DNA, 594 bp, Glycine max
  Peptide Sequence Number=SeqID_126112
atgacggtgaaaacctctgacacatgcagctcccggagacggtcacagcttgtctgtaagcggatgccgggagcagacaagcccgtcagggcgcgtcagcggatgcgtaaggagcaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgttcctttattgtcttcacgcgcagctcattcatctttggtgagtggcgacataaaggagcaggtgcctacgggtcgggaaagctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaacccccccgttcagcccgaccgctgcgccttatccggtaactatcgtcttgagtccaacccg

SEQ ID NO: 34428 - DNA, 408 bp, Glycine max
  Peptide Sequence Number=SeqID_126113
atgccgggagcagacaagcccgtcagggcgcgtcagcggggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcctccttttcacgtccatatactgttgttggtagtatgagcaaagaagcctaa

SEQ ID NO: 34429 - DNA, 492 bp, Glycine max
  Peptide Sequence Number=SeqID_126114
atggagatgtttaatgcctgcaacctaaacatgtttccgaacatgtttggaatggagaaccagacaggaaattacatatcagacgagctgcccgagacacacacgtttcacttgagatgcggagaggctacgattactcttcaagatgtgtcagtgttgttaggtcttcatactgagggggcaccattaattggtcagactaatcttgattgggctgaattgtgtgaagaattattgggagtcagaccacaggaaggaggagttctatttgttgacaaaagcagcagtaaagtttccctaagagagatgtgcagcgccactgattacaaaataaaatcactcggaaggtatgtgcatcttaatccaaatgtgggcatgggaacgctgcacgacttggctccaaagaggactcctcctgtaatggaaaataaccactcggacataggtggctacgacgtggaaaccaacatattggcaatgatgatctcatag

SEQ ID NO: 34430 - DNA, 417 bp, Glycine max
  Peptide Sequence Number=SeqID_126115
atggcaagacacaaggcacaagggggaggaggggcttggtcgtccgtccgcccgggcacacacctagttagcaccaggcaggcaaaacgagagagagccgacgaacgggtttgtttggtgatttggaggggagggacgaatcaaagcgacaagggcttgaatcttcagtggatcgtggcagcaagggccactctggccactttacaataccccggcgcgtatttaaagtcgtcctgcaaaaggattctacccccccgcttcgatgggaattgcgcttcaaggcgtctcgtagggcttaatccgcctcacgagggttcaccaacggcacgtgccttttggggggccgaggccccctactgctggtcggcaaacggacggcgggcgcacgcgtcgcttctagcccggattctgacttag

SEQ ID NO: 34431 - DNA, 474 bp, Glycine max
  Peptide Sequence Number=SeqID_126116
atggtctgtgtcgtcccgacatggggatcgcacccacaaagacacccagtggacctgaagaagtccaacagggccctggggtttccagctctggttacgggcctctgtcggccctatagggcgcccgtccccccagcaagctcatgccatcatgacataggtaaggatcgtgcccgcaagacacctagtggacctgaagaaggccaacagggtcttggagttgccagctctaaatacgggtctctatcagttcaagggagtgcctgttgcccccagcagggtcatcaagccccctaccaatcgagctttcatcaagaagtgctgcgcccccaggcaggcgcagggcgaaacaccacagcagcattgggatggccggtagcgggcaatagacacaccgccaccacctctaaagttcacctcagctcatccataaaaaggttagagcgttgcctacgacacatggccgaccaatag

SEQ ID NO: 34432 - DNA, 687 bp, Glycine max
  Peptide Sequence Number=SeqID_126117
atgtgtcgctgtacagcagctataccgagtcgttcaagccgaactctttccatcgccacccaaattggttcgctgccgccggagcagggcaagtcgtgggaagtcggcggcaagctggcgctgccgaacggcgttaccggcacgctggcgctgtttgacatcaccaagcgcaacgtgatggtcagtgagctggtggagggcgaaaccgtgacgcgcaccgccgggcgcgtgcgttcgcagggcgtggagctggacgtggccggtaatctcaccgactcgctgagcctgatcggttcctatgcgtataccgacgcgcgggtggtggacgatccggacaacaaggggaaagagatgaccaacgtggcgcgccacaccgcctcgctgttcctgacccagaatctgggcagcccgggcctgtacagcggcgatgaggtgcgcatcggcgccggcgcgcgttacgtgggccgccgcccgggtgacgccgccaacagcttctacctggataattacaccgttgccgatgcgttcgccgcttataccatgccgatcaacggctatcgggtgaaatggcagctgaacgtgaagaacctgttcgataaaacctactacccgtccagcggcggcaacctgcgcgtggcggtgggggaaccgcgtgaggtggtgctgcgcggcagtgtcgatttctaa

SEQ ID NO: 34433 - DNA, 442 bp, Glycine max
  Peptide Sequence Number=SeqID_126118
attcgatgacgagtcccccgaaggtactaatacctgggacccgtctatcaacttcgagcaagaaatgaaccaaacggaagatgaaggagatgaggatgtgggacttccttcggaactagaaagaatggtcgcccatgaggaccaagaaatggggcctcatcaagaagaaacagagctagtagacttaggaattggcagtggaaagagggaagtaaagataggtacaggcattaccgcacctatcccaccggttgcctctaaatcccgggtgtcccccagtaaaacagaaattgaggaggatgaagcccgaaacgtccttgaagataaagaagaagtgaagaagcagtttgacgctggatttctggccgtcgctcggtatcagaatgggtggccaacatcgtaccagttcctaaaaaagatgggaaagggcgagtgtgtgtag

SEQ ID NO: 34434 - DNA, 723 bp, Glycine max
  Peptide Sequence Number=SeqID_126119
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcgccctcgaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcccacgccggccagtgccaagcttgcatgcctgcaggtcgactctagaggatccccacgggcctctgtcggccttacagggcgctcgttccccccagcaagttcatgtcgtcgtggcataggtaaggattgtgcccgcaagacacctagtggacccgaagaaggccaacagggtcttggagttgccagctctaaatacgggtctctgtcagttctagggagtgcctgtcgcccccagcaaggtcatcaggcccccctaccaatcgagctttcatcaagaagtactacgcccccaggcaggcgcagggcgaaacaccacatcagcattgggatggccggtagcgggcaatag

SEQ ID NO: 34435 - DNA, 423 bp, Glycine max
  Peptide Sequence Number=SeqID_126120
atggtgcttgctgaaggtgaatctttgcccgcctactcaaaatactgcaggatgcctactgacattagagaaattgaggttgcattatgcatacccaaccgagggtttattctaaatgctgaaggccacctggcgccgatccttagaaaagatctaaccacccttgctcaggtctggagtgttctatcctactccaacctggctccgacctcccacaaatcggatctggctgtggatcgagctaggttaatctttggcctagttactcagctggacatgaatgtcagagccctcatttttgggcagattacttctatcgctaagtctaactcctcaagactcgggtttcctgctcttatcacagctttatgcaggaccaaaggagttgcctccgacaatcttatctttgaacgtctgagccca

SEQ ID NO: 34436 - DNA, 375 bp, Glycine max
  Peptide Sequence Number=SeqID_126121
atgtttgcacattcgattaaaggctgccgtcccttggggcggacgtatggggtgctaataccttccccgtggcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggtaaatatttactcatttgttgcacacatacaccaacattatttcgcacacactgtgagtgaaaaagggccctatacccgggttcatgggagcataaggagtggaggtgaatctgtgatcatgctaggtctccgacttgcttga

SEQ ID NO: 34437 - DNA, 279 bp, Glycine max
  Peptide Sequence Number=SeqID_126122
atgactacacgtcctccacttcagaggagttcatgtcctcaccttaagaggagtaaaggtcctccccttgggagggctacacgccctcgccttcatagggctacactcccacaccttcagaggaaggactacactccctcgcctttagaggactacgcggtcctcactttcagaggactacgcgtcctcaccttcagaggactacacgtcctcaccttcataggacttcatgtccatgccttcagaggcctacacgtagttgcatttgtcataccctaa

SEQ ID NO: 34438 - DNA, 258 bp, Glycine max
  Peptide Sequence Number=SeqID_126123
atgttaagaagcatcctgtcgcaacctatccttttgcgggcgagcaaggcgaggctcacgggtgcgtcttccaaaggagggaaatgcgcagagtcgccaccaacgtttatttgtggaaaacatcggaaaaaccaaaggaaaccggtcatgaagaatattccagattcgggagttgtatttacgtttgaggaaggtcgacaaaagcggggctcttgctcctacgtacccttcatcgaagaggagatcaaacctacgtag

SEQ ID NO: 34439 - DNA, 273 bp, Glycine max
  Peptide Sequence Number=SeqID_126124
atgacgttgttacttagcaacattctgcccagcgaccgtaatgccgatctccccctgcggaagtatcagttgggatcgcgcccacaagacacccagtggactcggaaaagtccaacagggccctggggtttccagctctggttacgagcctctatcagtcctacagggtgcccgtaccccccggcaaggtcacgtcatcatagggatcgcgcctgcaagacacccagtggacccgaagaagtccaacagggtcttggagttgtcaagctctaa

SEQ ID NO: 34440 - DNA, 309 bp, Glycine max
  Peptide Sequence Number=SeqID_126125
atggttagaagatttcgaccgttctctcctcatcttcctgtcttccaacaatttctctattcattcctaatcattattcctttactggagttcttcggaaacgttctatactctggtctggagacttgcttgctcactgagcaaggaagccttatccagactcttacttcgtggctcctccgttactctcatcatggcaggtggattcgctctacgggcccttccttcctggcgaccgaaggagggctatccatgggagaattccatgatgcctcaccctcacggagctgccgaatccacccattctga

SEQ ID NO: 34441 - DNA, 516 bp, Glycine max
  Peptide Sequence Number=SeqID_126126
atgttcagcttagcgggcactgtccagctaagccaattttgtagaagctgcatttctgcaactttcgctaagcggcttcacatgtcgctaagcgatgcttggaccagatacacagataatattctggggagaaacattttaccagagaggaaagtagagatatatcattatgagctagatgagtttaaggctgaattggagaggcaaaattcccataaacgcctcaccaatttagtcgatgggagcatagacttagctttggtgaaagaattctatgcaaatttatacagttctgaggatcatccaccaaagcaatccagagtcagaggtcatttggtgaagattgatgctgacagtctcaacacattcttggagacacctgtggtattagctgagggggagaccttacctgcttactccagatactgtaggttgcctacagactacagagagatagaggctgccttatgcatacctgccaagagggttcatcttgaactcagaggggcatcctag

SEQ ID NO: 34442 - DNA, 775 bp, Glycine max
  Peptide Sequence Number=SeqID_126127
aaaatgcttgtgcattgctggttatgggaaagtcgatccaacggttaacgaatcagaacaaagagaatgttactggggggttgatggggacccggtgctgagaggaacaaggataagggctacgtgggggtacgtgagctcagttgaagagttgatttgcaccatcgcccaatcgccacctagtacaacatatgacggagtggtacctggagatatgtcgcaggggtcaggagaccttggggacgtcaggcgagctcctggcagtcaaccaataaaagaacaaagaccacaaagcaaggaggcttgtgtggtggctggccagctatggatcttgagtggtatctggaatttggcctctggtttccatgttcagaagctatgtaactcgagtttgggcactggtaatcgattacatactgtgatcgtgatggcagcacaattaatccatgatcgcgtggagatggagtgcctagagggagaacccacacgcatgcttcagcgaactgtggagtggatactacctactcctactccatatcgactagtggagctagtccaagtgatagaggtgtcatcctctgaagaagaccctgagcaggacccagaggagttacctcctgagcctgttgtggatgctcttgactttccagaggatgatgaggacccactccctgatttggattctccagaggatgtcatgtcagcatctgaggcagactctacgaaggagagcggccctggagggacgacgaatagtggagactcttcatcatag

SEQ ID NO: 34443 - DNA, 264 bp, Glycine max
  Peptide Sequence Number=SeqID_126128
atgattcatcaggcgcagggtgatgcacctcaggctacaaacgcaccgccaccacctcatcaggccaatcccgctggatcactaggcatggagcgttatctacagcacttggttcgccagcaggcggtcaaccaccgggggcaggtgcagatacatgagtgtctctaccggttcaacctcagtcagcagcggcaggatttcgctccttttgcgtgccctactccagagcagtttggggctgaggtcgcatggcccgtagactag

SEQ ID NO: 34444 - DNA, 330 bp, Glycine max
  Peptide Sequence Number=SeqID_126129
atgaaaagccttgagataccccttttacttgcatgtagtgatgaacccgcgcgcacgcttcagcgtactgtggagtggatactacccacgcctacaccataccgtctagtggagccagtccaagtgattgaggtaacgtcatccgaggaagaccctgaggaggatctcgaggagctgcctgctgtggatgctcttgactttctagagggtgatgaggacccactccctgagatggattctcccgaggacgtcatgtcggcatccgaggcagactctacggaggatagtggccctggagagatggcgatcagtggaggctcttcatcatag

SEQ ID NO: 34445 - DNA, 447 bp, Glycine max
  misc_feature (66)..(66): n is a, c, g, or t
  Peptide Sequence Number=SeqID_126130
atgccgggagcaagacaagcccgtcagggcgcgtcaacgggtgttggcgggtgtcggggctggctnaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcttgaacttgtttttcaatttaatctttgtggtggtgggcgtattgatatggacaatattgagttgggttgcaaggtgattgcgtga

SEQ ID NO: 34446 - DNA, 264 bp, Glycine max
  misc_feature (47)..(47): n is a, c, g, or t
  Peptide Sequence Number=SeqID_126131
atgccgggagcagacaaagcccgtcagggcgcgtcagcgggtgttgncgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34447 - DNA, 618 bp, Glycine max
  Peptide Sequence Number=SeqID_126132
atgggaacaaatcaaaccggcaagaggttctaccaagtcaaggtcaaaagcgtagataccaccagcatcaaggaattagggcggttgatggaacccctccaaatgcaagccttccgcaagacttacggaaagatcttagagttgaccatagcagaggtgtccatagaagccattgcatcacttacccaatactacgaccgacctttgagaattgcaactgtggtcaaggattcagcaagaggtttggaccgcataaaacagactcggaacggcatagcgggtctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatgtggggcgaggggtgcgagaagagtagcgcacggatcatctgttgcttacccgccctctgtgtttggttggtttcacacttgttccaacaagacacaagacatccatgtccgctcctga

SEQ ID NO: 34448 - DNA, 408 bp, Glycine max
  Peptide Sequence Number=SeqID_126133
atgtccaattccgagttgcaggcgctgtttctgcgccatatgcggccgctgcaagcctatttgaacgccaaactgcgcgaccctcagctggccgcggatttggcgcaggaaagttttacccgccttaccgagcagtatccgcagggtaacattctcgatatcgaagcctacctgtacaaaaccgccaaaaacctgatgctcgaccatgtgcgccagcagcagcggcggcagaccgaagcggtcgaagacgacattctggcgcagtatccctccggtgaaccggcgcttgaacaactggcgatcgatagccaattgctgcagctgttgcaacaggcgttagcggacatgccgccgcgcacgcagcagattttccgccttaaccggctcgatggcctgacccaggcgcag

SEQ ID NO: 34449 - DNA, 518 bp, Glycine max
  Peptide Sequence Number=SeqID_126134
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccataccg

SEQ ID NO: 34450 - DNA, 369 bp, Glycine max
  Peptide Sequence Number=SeqID_126135
atgacattgctacttagcaacattctgcccagcgaccgcattgccaatctccccctgcaaaagtatcagttggtttgtgtcgtcccgacgtgggtaaggatcgcacccacaaagacacccagtggacccgaaaaagtcaaacagggccctggggtttccagctctggttacgggcctctatcagtcctacagggtgcccgtacccccccggcaaggtcacgtcatcatagttctacggagtacctgtcacctccagcaagggcatcaggccccctactaatcgagctttcatcaagaagtactgcgcccccaggcaggcgcagggcgaaacaccacagcagcattgggatggccggtagcgggcaatag

SEQ ID NO: 34451 - DNA, 267 bp, Glycine max
  Peptide Sequence Number=SeqID_126136
gtgggtgtggaggaggttacagatgcatatgctccagttcctgtacccactgatgaggtttccttagtggggcaggcaattcataccttccttgcttggccgacacatctggtcaagtctttatcacagcaggcagctgtgtcttcggcaaaaccacctcaaaagcccgatccgaaggtcgatgatccgcttaatctaatgacattgaccatcccagagcttgtctatgaggctttatcaggttacatgggatgtgtcataccctaa

SEQ ID NO: 34452 - DNA, 204 bp, Glycine max
  Peptide Sequence Number=SeqID_126137
atgggtgaagtaaaggagatacaagagaagatgaaggccgacatggaggccatgaaagagcaaatggccacaatgatggaggccaccctaagcatgaaaaagataagggaagtcgatatggttgccgctaccaacgctgttgctaaggtgaacccgatgcccccatctggcctcaaccaaatgaattatccaacctcaaatatg

SEQ ID NO: 34453 - DNA, 225 bp, Glycine max
  Peptide Sequence Number=SeqID_126138
atgatggttggtatatttttgaaagggcaaaatagtttagagggacgccacacccttgatctcaaaggagggccaactgtgcgagcacaaccagaggaaggctatcgcgcaactactgtgcattccggggcaaggtttcacccgtgccactacaaagagacgagtgtggatcatgcgcaccaacatgaccactcttacacagatctcaatgacgttgctacttaa

SEQ ID NO: 34454 - DNA, 861 bp, Glycine max
  Peptide Sequence Number=SeqID_126139
atggtagccgatgagcagggtataaatattcgagccagccatgacgttgcccgtttcatgttgcaggtagcacatcgcagtaataatggctttgataatttccgcctcggtgcctcattgcgttgtccgccaaatgccccgttttttccgttttcccggcatgaaggtgagacattgaagtttagttttgccctcgaaactaccgatattgctttggaattgagtgagcaggtgcgggaaggcaacatgctgctggcggactttgctgaccagtttattcttcgactctgcgcacgcttacgcgaaattgatgcattcggtcatgagctggcgtctgattcagggcttgagtatgccggtctggatgcctcgctggcgccttttccggatggcagtatttctgtcggcaggttagttgaaaatcttggtgcgcgtcctggtggcgttcagggatcactctttataaccagtattctgacgaatgcgattaaaagcgcagtcgcaatcagtggtgctcgcgcaacgggtttcaatggcgtcatgttctcagtactggaagatgatgccctggcgagtaccaataatcgtcgtgcattaagcattgatacgcttaatgcatggtcaactgtttgtggttgtggattagatatgctcccggtgccaggttcgacactgcctgaagatattgccgcgattattcttgatacggctgcactcgcggtgcggttaacgaaaccgctcggtgtacgtttattacctattcctggcggagagggaaaacggtacttgatctcggcgccggggtcgggcagtgggcttttcgctttcagcatcagggcgcaaaaaaaatcaccgctgtag

SEQ ID NO: 34455 - DNA, 192 bp, Glycine max
  Peptide Sequence Number=SeqID_126140
atggatgaaatcgctccgaaaaagctttccgcaaagagatctaggagggacgccgcggctgaagggaccagtgccgcccccgagtttgatagccaccgttttaggagcaccgagcaccagcagcgcttcaaggccatcaaaggatggtcgttcgacagagagagacgcgtccagctcagtgaccaaatatag

SEQ ID NO: 34456 - DNA, 222 bp, Glycine max
  Peptide Sequence Number=SeqID_126141
atggaagcaaggaagaagaagaagggttcagaagcagagaagaagaaagagcaagagtctggtcaggacctgttcgaatcgaaaagagagaagagtcttttgaaagggattcccaggttcaaggaagtatttgcgaagtacaaggctaggacaggaaagagggcttcgaatcattgggcgattcgagttggtgtatggtcgagtcgaagtcaaggcagctag

SEQ ID NO: 34457 - DNA, 378 bp, Glycine max
  Peptide Sequence Number=SeqID_126142
cggtggtttgtttgccggatcaagagctaccaactctttttccgaaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaacgccagcaacgcggcctttttacggttcctggccttttgctggccttttgctcacatgttctttcctgcgttatcccctgattctgtggataaccgtattaccgcctttga

SEQ ID NO: 34458 - DNA, 492 bp, Glycine max
  Peptide Sequence Number=SeqID_126143
atggggccaaggacaatgtatggagaaatatggaataagtggctaaatcccaaaggaatagaggagcaaaggggaataacctttgagaacagcatttcattcagcatgtccacatttaaccaatatacaatgtacatcaagtatggcccaaaatacatcatgaagcatagccaacaaaacaagttgtccaatgaaacaaaaaccccccacacttattcccaaaacaattccaaagctccaaaattccttaaggatatgaatatcatggtttttcacttaaggcttgtagtgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggacacatcaacaagaatcaagccaaggctattgtgcaagcaatcaatggggcaaaacacaccaaatga

SEQ ID NO: 34459 - DNA, 378 bp, Glycine max
  Peptide Sequence Number=SeqID_126144
atgtttttatgcggcgctaacgatttaataactatctttgtagctctagaatgtttcagtttatgttcctatctactagctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 34460 - DNA, 486 bp, Glycine max
  Peptide Sequence Number=SeqID_126145
gacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaagcacttgctagcattgccacacctcttgggcttgagtttattcctcaagtaaagaagttgttggatgagggtttggttcgcaagagcttaaatccttgtgctttgttggtgcccaaaataggggttcccatgaatcctaagagaataaaggtcattcctgagtggcccactccaccaacaccactcattgagttggtgagaaaccatgttccttcatgggaagatgcccaggaaatgggtgttgagggaaggagcccagagtatgaagaacctcgggatttgaggtcaaatcctttccaaggtggagggaatgatgcaatcctatctcgcaagggcattgggtag

SEQ ID NO: 34461 - DNA, 727 bp, Glycine max
  Peptide Sequence Number=SeqID_126146
gtggtatagagatactttcctaactagggtttacacaagagaagatagtcaacaacctttttggaaagaaaaatttctagctggtcttcccagatcattaggagacaaggttagagataaaatccgtagtcaatctgccaatggagatattccatatgaaagtctaagctatggtcaattaatttcttacgtccaaaaggtagccttaaaaatttgtcaggatgacaaaattcaaaggcaattagccaaagaaaaggctcaaacaaagagagatttaggttctttctgcgaacaatttggtctaccggcctgtccaaaacaaaagaaaaaacaatcctctaaaaaagaaatccatgagaataaaccgatcaatacaaagagatttccaaggaggagatactcacacaaaccatcaaccaatagaggaatggaaaatcctaaacaaaaaacaaaatcaaaaataacgtgctacaattgtggaaaacaaggccacatcagcaaatactgtaggctaaaaaagaagttaagaaaccttaacctagaacccgcaattgaagagcaaataaacaatttgctcatagaaacctcggaggaagaaacaaaaacttcatcctccgtgctttccgatgaaaacctaaacctaatccaacacgatgaccaactatcatcaacagatgatgatgatgggaaaatcaatactctaacgagagaacagatctctgtttga

SEQ ID NO: 34462 - DNA, 576 bp, Glycine max
  Peptide Sequence Number=SeqID_126147
atgttgagcaacccatccagagctcagaagaaagccaaaacctctaagaggaagcagggtgaatgctcacaagctactttcaataggttggatacatggttcaccgacggaagcaagaagaatgactataagatgatttacattgtgaagaatatgaaaggaacattttattcggaactagtgaaagtcttccacacttgtgcacgcatcgacctagaagtccacaaattcgaagaaacaactgatgggtacaacaagatgcagacctataggggaatgcttctcgacctaacaaggaatttgaggaatctcctaggagtaggtggtctaagaacagaagacagaatgcttgtgaacctcattacctacattctcactcggaggtcaagtaatcacactcagatagtggactacaaatttccttatgttgtgcttgcctcaagattcagtaactacttcaatgtcgatgtatctaataagataatggattttaccaaagcatctaagccaccagcagcaagaaacatggaacatatggatgaagaagctgaagctccacaggagcctggaaattaa

SEQ ID NO: 34463 - DNA, 138 bp, Glycine max
  Peptide Sequence Number=SeqID_126148
atggataagagcttgaagggaagagaagatgagtggagggagagggagagaaggggcacgaaattttgtgcctcaaatgagcccactaatccaagatcaagtccaacattctccactaagtgtgcttacgtgtcatga

SEQ ID NO: 34464 - DNA, 581 bp, Glycine max
  Peptide Sequence Number=SeqID_126149
ttgaaggggagcctcctcgacagtctgacgaggttcatgaggatcatagagagtatgcccaagtagacgtcgatttctaccccccggtccccgtcgagggtccgacacccaacatactgcctcagcccaacctcccagcacagccaatatttttgtccacagaaggaccacccccggcggtggaagaaagaaggaaagtcgatctcatcgaagagagattgagagctgttgaaggctttggcgactatccgttcgcggacatggcggatctttgcttggtaccagacgtcgtcatccccccaatattcaaggtacctgatttcgacaagtacaaaggagaagttggtaggctatatgccctccagcttcgcggacttggtattcgtcggggagagaatcgaataggtttgaagagagggaagttcgattatgtctcctccataagtaccaatgctaggaggatcggagcaactggggcaaaaaggaaggaaggagatacctattcgtcacttcagcgcctgcatgggtcaagccaccgcagacctctcatggtacccatcagtacgcgcaacatcacctga

SEQ ID NO: 34465 - DNA, 639 bp, Glycine max
  Peptide Sequence Number=SeqID_126150
atggccaaattcgacccagacatagtcctcgaattttatgccaatgcttggcctacggaggagggcgtgcgagatatgagatcctgggtgaggggtcagtggatcccgttcgatgcggatgctatcagccagttcctaggatatgcgttagtgctggaagagggccaggagtgcgaatatggccagaggaggaaccggtccgatggttttgatgaggaggccatcgcccagttgctgtgtataccggggcaggattttgcctggactgctgcagggaggcgagcgcaaattatgagcaccaacatgaccaccctgacccagatatggatgacgttgctgctcagcaacatcctgcccagcgatcataattccgacctccctctgccgaagtgtcagctggtgtacgccatcctgacacggatgagtattcacgtggctcagttgatcgttgatgccatttatctatttgcaggtatggcgccgaccaggcaccctatggacccagataagtccaaccgggccctgggatttcccgcactgatcacaggactctaccagtcgttcggagtccccgtggcacctaccaaggtgattcagctgcccatcacccgggcttttatgagaagtgttagtgcttag

SEQ ID NO: 34466 - DNA, 183 bp, Glycine max
  Peptide Sequence Number=SeqID_126151
atgcctcaccccatagcggttgatactgctcaagtcatgacagtgaacgaagaggcggttgtctcttctgtgctaagtgcaagattggcactaagccaaataccacttactcgcgctaagcacgccttcgaggttcttagaggtggaggtagaggtggaggagacatccccattgctttgtaa

SEQ ID NO: 34467 - DNA, 123 bp, Glycine max
  Peptide Sequence Number=SeqID_126152
atgaccacaatgatggaaaccatgatgagtatgagacaattgatggaggtcaacatggctacagtcgttgccgcaagtactaccaccgaggtggacccgactcacccatctggcctcaatcaa

SEQ ID NO: 34468 - DNA, 233 bp, Glycine max
  Peptide Sequence Number=SeqID_126153
ggcgcgtcaacgggtgttgccgggtttcggggctggctaaactatgcggcatcagagcagattgtactgagagtgcaccatatgcggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34469 - DNA, 804 bp, Glycine max
  Peptide Sequence Number=SeqID_126154
atgcagccgctcgcgacgccggcgtgcgtgccaagatcgccgtggtggcatacgagtaagcgcatcgaccccatcggcacctgcgtgggcatgcgcggttcgcgcgtgaccgccgtgcgcaatgaattgggcggcgagcaggtcgacatcgtgctgtggtcggaagatccggcacagttcgtcatcggcgccctggccccggccaacgtcgagtccatcgtggtggacgaagacaagcacgcgatggacgtcgtggtggacgatgaaaacctgcccaaggcgatcggcgccaagggtcagaacgtgcgcctggcgtccgagctgaccggctggcagatcaacatcatgacgccggaagaaagcctgaaccgccaggaagtcgagcgttcgggcctgcgcgccacgttcatgaacaagctggacgtcgatgaggaagtcgccgacatcctgatcgacgaaggtttcaccggtatcgaggaaatcgcctacgtgcccatgcaggaactgctggagatcgaggcgttcgacgaagacaccatcaacgagttgcgcgcccgtgcccgcaatgcgctgctgaccgaggccatcgcccaggaagagcgtcttgaaacggcccaggatctgctcgaactcgaaggcgtgacgccggaactggccgccaagctggccgagcgtcaagtgcatacgcgtgatgatctggccgaattggcgacggacgagctggcggaaatcgccggcctgaccgagcaggaagccagcgacctcatcatgcgtgcccgcgcccattggtttgacgaagaataa

SEQ ID NO: 34470 - DNA, 66 bp, Glycine max
  Peptide Sequence Number=SeqID_126155
atggatatagtaagtcttgcttgggctgctttaatggtagttttgggttttcctcgtcgccgcgtt

SEQ ID NO: 34471 - DNA, 564 bp, Glycine max
  Peptide Sequence Number=SeqID_126156
atggataatgaagagggcatgcaagagcagatgaaggccgatctatcggccttaaaagatcaaatggcttctatcacggaggccatgctaaaactccagaaaactctagaggataatgccacgacaaccgcctccaatgcagttagggaagcagaaccagtgcttcagcccacgataaacttgggccgggatagaaatctgacggtgttcggtcagaggtacagtccgcaagcttatccttatggcttgtctctggacttcactccccgtgccgctccggaagatgtgagccaagcccctaccttcgaggggcaacttcctccttatgccgattaccccctgcaagaagacgaagaaggagatacccatctaggccctctacttcccctcaaggatccatccccccatgaattacctcaaccaaacatagtcggccatgtcccatcttcacccgcacccgtaaaagaatctgttcccttcacagaagataagggaaatattgatgcgcttgaagagaggctaagagtcatagaggcctcggcaattacccgttctcggatttag

SEQ ID NO: 34472 - DNA, 207 bp, Glycine max
  Peptide Sequence Number=SeqID_126157
atgaagaacggtgaagaatctttacgaaatcgctcacgaaaatgtctcagaagcattacggaagggcctcggggaaaaaagggaggtggttgccgccaagcttgccctggcgagctgttgcttccaccagaaggcaccgccttctgttggaacaccccggaaggcccaagtgggcctagtttctattttcacacccttttttactaa

SEQ ID NO: 34473 - DNA, 441 bp, Glycine max
  Peptide Sequence Number=SeqID_126158
atgactgggcagattagggaagaattgaggactcaaattaaggaagaattgaggactcagctagaagaggaaaatagaaggagcttggaaataatgaccaatgcattgaaagaggctattaaaaaagagttggaagtaatgctgttaccaatgcgcaggcttcacaagaacatcgatgctgatgccataccattgatgggactgtttgtgcagcgtaacgatggtacacaaaggttggtggccatggggaaaataatggagggggattcaatcatacacacagtggcatatgcagatgatgttgtcagggtaagtgtagaaacagttattgatcctgaggctgaggtcccctatgccacctcagaaatacaatatgtgaagcaggccgtcaatacatttgtagcttggcccacacaccttgtgaaagctgtattagatgag

SEQ ID NO: 34474 - DNA, 249 bp, Glycine max
  Peptide Sequence Number=SeqID_126159
atggcagcgcagctaatccatgatcgagtagagatggagtgcctaggagggagcttgggagaccctcgaaggcaacacgaggtgccgatttcggggcaccattcgattcacggctacttctttgagggtgatgaggatccacttctcgaggtggattctcccgaggaagtcatgtcggcatctgaggcagactctacggaggatagtggcccgagggagatggcgatcagcggaggctcttcgtcctag

SEQ ID NO: 34475 - DNA, 417 bp, Glycine max
  Peptide Sequence Number=SeqID_126160
atgccacctaccaggcaccctctagatccagataagtctaacaaggccctaggttttccagcattgatcacgggtctctgccagtcattcggggttcccgtcacacctagtaaggccgcagacgcatcgccaccacctcatcaggctgatccagctgggtcatttggcatggagcggtatttacaacacttggttcaccagcaggcgaccaaccacagggggcagagccagggttacactccttttgcatgccctactccagatcagttcaaggctgaggttgcatggcccggagattggcctgaggcccaggcaggggaggcgcccgcagaggctcccagcgacgcggaggaggcccgcatggataaagagatgacagatttactcggtttcttgggagggagtggagccacgtga

SEQ ID NO: 34476 - DNA, 468 bp, Glycine max
  Peptide Sequence Number=SeqID_126161
atggctcatggatgtcttgtgtcttgttggaacaggtgcgaaaccaaccaaacacagagggcggatctgccaagacagctaccaccggactttccttgctatggtggtaggcaaggaaagcgtcgattgctactaggtctatcaaaccatccacgtttggaaagaggacgaccccaaaaattagcaaagctaacacatccatacgggacccagtctcctcgattggccatacccctcgccttgtcttctaggtacttctgtggtaggcccgctatgccgttccgagtttgttttatgcggtccaaacctcttgctgaatccttgaccacagttgcaattctgctcaaagaggggagacacccggagggaagatatggctttcttcctccgagaggacatcctagaatttcctccaattcttcaatggttggtactaattggaagtctgcgaatgtgaagcacctctaa

SEQ ID NO: 34477 - DNA, 429 bp, Glycine max
  Peptide Sequence Number=SeqID_126162
atggctactccacctggctcgtctcctcctcctccctctccttcttcttctcctcctcctactcctcctgcagacccctcaacatctccgtctactataaagcgaacatgcaaagccacatggctacgatccttggccactagaccacctggggcagagagaccagtggtccacgtcgatcctgtgactagcaaggccgacgatccccaaaagaagaaattaagaacatatttgggaggatatacagaatttgaaatccttgaagcttctaacaataggacaaagaagaaagttcttcagacagtgggtgagcggtggaggcagtttaaatccgatttgaccaggaaatgggcacctgcagcccacaaggatgatgtggacgacactatctgtgaaaaatacaacattagcaaggagaaatgggcctag

SEQ ID NO: 34478 - DNA, 1123 bp, Glycine max
  Peptide Sequence Number=SeqID_126163
cgaagcattgcgaaatggccgtaattatatggataatgttgaaaaacgccttttggaaaccgaactgcgcttaaaggatatggatgcttgtggcatccgtcatgctattttgtcactgacatcgccgggggcgcagtcgattcttgatgttgctgcagcaactcatttcgtaacctgcaccaacgactatattgccgaatattttgttcagcctcatcccgatcgtttcagtgcttttgcaacagtggcgctacaaaatcctcaggcggcagcggatgaactggaaagggcggtgaaaaagctgggtatgaagggggcattgatcaacggttataccaatatgagcggcaccgaggaagggcgctatttggatgatcctgcggtagaagtattttggcagaaagtgagtgaactgaatgtgcctgtctatctgcaccccagagagccactccctgccgcctgtggaatttatcgcggctatgaaagcttggtaggttcagcctggggttttgcaacggaaaccgcagtacacgctattcgtctgatgatgagtgggttattcgaccgctatccgaatattaccattatccttgggcatcttggggaggggctgacatttatgttaccgcgcactgcccatcgtctggaaaaacagtttgagggcatcggtctggggggcaaccagcagcccttaacggattacctgacgaataatttctacgtcacgacgagtggtcacttcacaaccagtgccctccataatgccattgaagtgatgggaaaggatcgggtcatgttttctgttgattacccttatgaggatatgtgccaggcggctgattggttcgatccattagtcctggacgccgacgttaaacaaagtattgcgtacggcaacacatggaaatgcggccgcacaccaggcggcaacttgtccgggaaccgtggccagcaactcagtactggctacaatgttccctacgcccaagaagctagggagcaacattttggttcgcagttgaataccgctgcgtgccaggcggggaaccagagcaatttggcttatatcagccattgcgatagtaaagcttcgctgactggtgcggggatcgaaaggcaatga

SEQ ID NO: 34479 - DNA, 281 bp, Glycine max
  Peptide Sequence Number=SeqID_126164
catccgctaagcgcaacactcctgggctaagcgcgaggaagactctggaagaagatgagctgtacaggttcgctaagcgcaccgcttcagtttatccgctaagcgagaaaggcacgctaagccaaaaatcactaacgtgtgctaagcggttcatacgtgcgctaagtccaagttccagagattttgtgaaggattttaccacattggcaacacctctcaatgaagtgctcaagaaaaatgttggtttcaaatggggagagaaacaagaagaagctttcaat

SEQ ID NO: 34480 - DNA, 396 bp, Glycine max
  Peptide Sequence Number=SeqID_126165
atgacttctcaacgtataaattcaggtagatacacaatattcaattccaaactaatagagcacatcttgcatgacactgatgacgaactcgatataacacagggagacattgttacaaattattcatttgacgatatagcaactgaggattttgctcataccgattatgatgacaatcttgaagctccatatgacaatgaaaataccggtttttacattcactgtgcaaattatgttgaattgtccttcattacctttgataatgtgcaagttacaaagatattggagatcctatttggcaatgcaagcaatgtaaagcgaagatgtggtatgatgagaggattaaccaagattaacagactaaaaatccaaagttttcattatgttgtggtgatg

SEQ ID NO: 34481 - DNA, 402 bp, Glycine max
  Peptide Sequence Number=SeqID_126166
atgaccctaaagataactgaccaaagcaggttggtgatgaggatggacatgaacattggagcattaatttcaggacaaatctcactcattgctcagtccaactcctctaggttgggatttcctgccttgatcacagctctctgtaaggcaaaaggagtcatttcttattccctctcttatgaatcactgagcccaaccattaatttggcatatatcatgaaaaattgttggaacctggatgaaacttcggtctactttccaaggactcgcaaggctagggccagagcagctgagatcccttcctcatccactcctcaggaccttcttgtacccacttctgctccaccaccagctccagctcatccaggaccttccatagaccttatcatggcgatgctctaa

SEQ ID NO: 34482 - DNA, 417 bp, Glycine max
  Peptide Sequence Number=SeqID_126167
atgccgatcataggtgccttccacagctttgagcctctacttgtggacgaggcagtcgtcttgttgatggagttgcttgaggtcttaggtgaggaggctagagttgagattgtatgggcacatggggcatatgtatgcctgtcgtggctacgggatatctatctgaggagacgcgaggccggacggtggattgtagcagctcgtgcttatctcttccacttggttggttgcactctttttgctaacaagagtgcaacacatgttcatgtaatgcatcaggaggctattcaagacctgggtgagagtgggagctatgcctggggagctgccgcattggtgcatattgctggatatatgagcactttcctagtgctcatgattgcgtcactgacgatgcgtacgatgagacatccccag

SEQ ID NO: 34483 - DNA, 414 bp, Glycine max
  Peptide Sequence Number=SeqID_126168
atgtcgggaataaggggggacatactggacgtaaccactcccttgggggcggctgtgccgccctgcctttcgatcgatacacagttgagtaggccgatcacgaacgctacaggtgtgggagcgatcctgcccaatagggacagcacaccccccacttcaagcgcacctctgtatcgactgaatcactctaagagtctagtcggtggaaccggtgaaccacgcgagctggggactctttcattaggggaagggaagaaggggcctaagcacggcagatgccgtacacttgagtggcaaaggaaagggagatcgtacctgtttttccaggcctgttcggacatatggttcccgcggaagatcaagttggtgagccgtgtgatgggaaaccttcccgcacggttcggagagcactga

SEQ ID NO: 34484 - DNA, 322 bp, Glycine max
  Peptide Sequence Number=SeqID_126169
atggcagaaccatcgaagaagcgaaagggcacttcgagtcggagtcaacgacattccaggtcacagaaaatgccaattccttcctccactccctctggatcattgttttcatcagaggaacaacgtatacggtacacaaacatcttttcctctcgttccattatagacccaaaattcatagatatggatttcttctcaagtgagagttttgaatgctttcaagcatttgaaaactcaaatcgtattccattcatgtctctgaaattacccgtttattctgatctagccaaagccttttattctaatttagaaatcaatgaag

SEQ ID NO: 34485 - DNA, 213 bp, Glycine max
  Peptide Sequence Number=SeqID_126170
gccaaagaagaaaaggtaaaagttgctgatgactcgcttagcgaggcagtttggctcagcgagactcatctgctcagcgaggcatctagctcgcttaatggatgggaaaccctagaagaggataagtcagagatctgtgtgcccagtgcacagcccgcccgcccagcaaggacgttgtatattctcacgcttagcacacccaagctcacttag

SEQ ID NO: 34486 - DNA, 222 bp, Glycine max
  Peptide Sequence Number=SeqID_126171
actcatcttctccttgaagtggcgtctcctctctctcttcctttctccattccgctgccattcatcttccaagaagcaaaggaatccattgatgaagaagatcctaggcctacaagctccaatggagcttgcatcagtatttccgcctgccccctaacttcacgggatgcagaagacgatgttagtctttgcatgctattaggcgttgagtcttacagatag

SEQ ID NO: 34487 - DNA, 411 bp, Glycine max
  Peptide Sequence Number=SeqID_126172
atgaacgcggcggaagtgagcgcggtggccaaggacctgaacgtgtccgagcgcgaggtcatggaaatggagtcgcgcctgtccggtcgcgatatcggtttcgatgcgccgaccgacgaggacaacgagcacgccccgccgtcgccggctgcgttcctggttgccgatgacgaagacccgtcgatggcctacgagcgcgaggacagcgaagacaaccagatgcagctgctgcgcgaaggcctggccgaactggatgcgcgttcgcgcgacatcatccgtcgtcgctggctggatgccgacagcaaggtgacgctgcaggagctggccgacgagtacggcgtgtccgccgagcgcatccgccaggtcgaggcgaacgcgctgaagaagatgaaggcgttgttcaccgcgtaa

SEQ ID NO: 34488 - DNA, 252 bp, Glycine max
  Peptide Sequence Number=SeqID_126173
atgtcaggatttacacgtgattctcctcaaatttcagccagcccgcatcaattagatcttgcaccttacgtttcagagccctacaatgctaaatggaataccccggggcttctccgtgacaagcacacgttgcgttcgagtcgtattctcggagaaatggaggttgatgaaccttggttggggctttctcgctgcaaaattcatttcttggttggtgttttggtttatgctaaaggtggtgtttttcattag

SEQ ID NO: 34489 - DNA, 114 bp, Glycine max
  Peptide Sequence Number=SeqID_126174
atgtcggtgtatatggaagatcgaaactctggaaaagcaaggaagcgtttgaaatgggagaatcgacgattacatttgtcgtggacacattctgaacgaagatgcctcaagtaa

SEQ ID NO: 34490 - DNA, 255 bp, Glycine max
  Peptide Sequence Number=SeqID_126175
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcttgtaacctggacacggttgatgctcgagatcacatctttttttttcgaaaaaggcgtgcgaaagaaagtgcacaagacctacacatttttttttgctacctaa

SEQ ID NO: 34491 - DNA, 311 bp, Glycine max
  Peptide Sequence Number=SeqID_126176
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccgtggcacgtattccgcaaggtccctgttgatatgcgaggagctatcgaggaagctatcatcggagttaatctcctccgatga

SEQ ID NO: 34492 - DNA, 321 bp, Glycine max
  Peptide Sequence Number=SeqID_126177
atgggggagacacatgaaattccccaccacaatctagccgacttcgagccttggctcggatatgccacggaagggcaagcagttggtggtatacccctacaaaaccctttggaaggccctcaatatcacccacaactacacctcttgcattccacgacaagtaaaaaccctcatgctatggcagaaatgggaaagttggattatctagaggaaaggctcagggccattgaaggaggtgaagattatgcctttgctaacctagaaaagttgttcctaatacccaaacatggtcgttcccaagttcaaggtgctggactttga

SEQ ID NO: 34493 - DNA, 123 bp, Glycine max
  Peptide Sequence Number=SeqID_126178
atggggctcccgaaaaaggttgagaatggagaattgcactatagcaatctctacgcaagcctccacaactcgaagatgggaggacacatgaacgaaaacgctattcatggggctcctaaaaag

SEQ ID NO: 34494 - DNA, 591 bp, Glycine max
  Peptide Sequence Number=SeqID_126179
atgggtcaacttcaacggcaagccttccgcaaagcctatggtaagatttgggaactagctagggtagaagtctccatggaaccgattgcatccctttcccagtatatgaccagcccccaagggttagtggacctagcagtgattgagactttcctcgcctttcatcatggcaaggaaagcccggtcgtcgccattttggccatgtatgacacattcgaccggggatgtgaaaagagcggcgcaagaattgtttgttgtgcactagctctctatgtgtggctggtttcacacctttttctccaagaaggtaggcccgtctatctgctacaaggtcaccgctcgtgcgtcgaaaaaggaaaggcgaattgggaccaactcttagcaagcaaagaaggagcatctgtcaactggttccctcgatggaaggaaggaagaaccggagttcttatttcatgcagaggatttccaaatgttcccttgatggggacgaggggttgcatcaactacaatctcgttcttgcaataagacaacttggctaccctatgagaggggcgccactagaggatgagctcgcgcctgtcatttcatga

SEQ ID NO: 34495 - DNA, 392 bp, Glycine max
  Peptide Sequence Number=SeqID_126180
tcagctttccagggacccgcaaggctagggctagaggatctgagggtccatcttctgctactccccagacatctactgcaccatctcctattccttcagcaccagttctcgctacttctggtgaggccttcgcagctcaggagcctcaaccagatctagagactacacctactgctcaagaggatgattcagaggccactcccctagagtcatttgcaccagaaactgatccaaaggcagacccagtgattgcggaggccagtccacaggcatcaccaatatctacaccagtgttggagctgagcaccccacaaggatcaccagttggcactcctgtgctgcatttgaccggtgatgaggccatggatcaggacccaccgcaggaccagtga

SEQ ID NO: 34496 - DNA, 716 bp, Glycine max
  Peptide Sequence Number=SeqID_126181
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccgtggttgatttagggattgcctttgtggataactgggcggtgggtaaggagaagctgggggtgatactgagggcgttccgaagtgtttcaaggggtataccaccaactgcttgcccttcagtggcatatcgagccaaggctcgaagtcggctagattgtgatggggaatttcatgtgtctcccccacggtttagagacatgtgcatgatcagttcggggttgttggctctcaatgggtataggagtggagttattgacattcttattgggagtgtacgccacattgggtggcgtatagttgagaggcaagccatatggcgggaaggcgtgctcgttttgaatttgcacatcatgggggccgcccgtacttcccaaatctttgcctaccatatctga

SEQ ID NO: 34497 - DNA, 123 bp, Glycine max
  Peptide Sequence Number=SeqID_126182
ggatggcctttgtggataactgggtgtcgcaacctacccttcggcgggagggcgacgcgtgactcgcgggatgcgtgttccacgaaaggaatacgcgcggagtcgccaccaacgtttatttga

SEQ ID NO: 34498 - DNA, 408 bp, Glycine max
  Peptide Sequence Number=SeqID_126183
atggcatcgttcagccagatgcagtcccagattcagtcacaaatgcaatctcaaggacttgcactacctaccgagcctttggttggtccctcaggtcctcgagtaaacacaaagcggagttgtgttgatcccttaggaaacgatcctaagacgagtgactcagataggtgcggcttatacatcaaagcagatcctgcccgcctggttgccctggggagagtttataagggatccactgccgttcataacactcctttgttgcctggccaagtaaaggtgggtatggagaaggttacagatgcggatgctccagttcctatacccactgatgaggtttccttagtggggcaggcatttcacaccttccttgctcggccaacacatctggtcaagtctttatcacagcag

SEQ ID NO: 34499 - DNA, 370 bp, Glycine max
  Peptide Sequence Number=SeqID_126184
ggaaaagaaggacaagcttgccacccagctcgcccaggcgagccagaacttcacggattgtgcaacaatgcttccttttgacttccggcatgtcacggaacttcatagattgtgcaacaataacatcacggattgcctaacgatgggtgccaaagacctcgaagcggtcaagcaaaagttgcatgctgtcgcaacctacccttttgcgggcgagcgaggcaaggttcacgggtgcgtcttccaaaggaggacaatgcgcagagtcgccaccaacgaaggtattagcacctctcacgtcctcaaaagcggggctcttgctcctacgtaccctccatcgaagaggaaatcagacctacgcagttctttctaa

SEQ ID NO: 34500 - DNA, 591 bp, Glycine max
  Peptide Sequence Number=SeqID_126185
atggctagaacacgaggtttaagtcgtgccataggtagacttgtaggcagaggtagacatgatgaccatgatgcagctgatgttcccgagaggcgtaggcctactgcctcagcccgtgggcaacgggttcatcagatgactgcggatgcacgtgatatggctgaggacgttgctgacatgattgacgatgtccctgatctggctgcaaaggcacctgagatgcgtgcggacgtacagggtgttgattgtgctgaggggtcagatgctgatgatgctgctgagggattccctggtgggccacgtgacccgtcagtgctggcatcatttgcggaccatgttgcacatgctgtttggagtggacaggaacgtcctgatttgaagttggtgtcacatgggaggaaggtgacattgattgggaggccagtgcctgagattgaaggactggttgctgccacaggattaagtctactgatcgattgtttagttattactagtgatcctggactgatatccgcattcgtggagaggtggcacggtgagaccagcaccttccaccttccggtagggagagttgacgatcacattggatga

SEQ ID NO: 34501 - DNA, 435 bp, Glycine max
  Peptide Sequence Number=SeqID_126186
atggaagaaggttcttccgtggagtcccacagaagaagcgccttgctattctctttgaaacccttattctctcgaacattctctctgttgttgctactttgtcgttggtcaccgccaccgcgtcactgccaaggaccatggcgtctcgcacctcctcaagtccatggccctcgacctctaggcttctgcaccaactcgatcgaggtcgtgttgccctcactcgccgcggggtcccttgctgaggacaagaagagcaatgcgctgcttaaaagggcggagctcaagatcacgatgagcgagcgacgcgttgactcagtgctggccgatttgaccgagtcggtgaaagctgagtctgcgaaacgcgaaggcatggtgcatgttgggggagtgctacgaaggaaacaaaatggaggaagaagcaaggaaggcttataa

SEQ ID NO: 34502 - DNA, 240 bp, Glycine max
  Peptide Sequence Number=SeqID_126187
agtgaggttgggcaggttcattggcggatgaggaagatgctactagttgaggtccttgacactgctttcctgaccttaatgattcgaccatctaaggttgggatgattcctctatccgggattgtacctgttgctggagagcataagcttcaggctgttcaattgcttcagattgttgcacagaagggcaaaggtgatggaagcttgcttgtggagcttctatggaggctggatctttga

SEQ ID NO: 34503 - DNA, 327 bp, Glycine max
  Peptide Sequence Number=SeqID_126188
atgcaatctcagggacttgcactgccttcggagcctctagttggtccctcaagtcctcgagtgggtgtggaggaggttaaagatccagatgctcccattcctgtacccactaatgaggtttccttagtggggctggcaattcacaccttccttgcttggccgacttatgtattagtggtgactcggcaactcatggcatcatcccctccaccttggaaaggatttgacctcaaatcccgaggttcttcatactctgggctccttcccttgacacctgtaaaaagaataaaaacatatgtattagtggtgttgggtatgttagagtag

SEQ ID NO: 34504 - DNA, 501 bp, Glycine max
  Peptide Sequence Number=SeqID_126189
atgagacaatttggaatgcaacaacctattccgggaccagtaatgcaacccaacaacatacatgacttgacattaaagggaaaggaaggaaaaaattggatgcgactaatgcaacccgcgcttaatgaatggaatagtcgttatgaaaggagagtagagcaaacgccgccacaaacagggaccctcagtctgaactctgaatatatgaggtggtacaggcgtaaaacaaaagtttatgtcgacccaaaacatgcaagaagaggactattgggtgaaatcgctaaaacactacattttatggtgtcgcctgtcgggagaagggtttgtacttttgacgatttattgccatgtatcgagaagatcactcttttgtctgaggaagaggataggatacttgaggcacatgaagatgctcccccttctcagccacaatttgaacatcaacagtttaatatactacggcaaagtgtggagactcgaggcttagcgcgacatcggtaa

SEQ ID NO: 34505 - DNA, 270 bp, Glycine max
  Peptide Sequence Number=SeqID_126190
atggggatcgcacccacaaagacacccagtgaacctgaagaagtccaacagggccctggggtttccagctctggttacgggcctctatcagtcctacagggtgcccgtacccccccggcaaggtcacgtcatcatagagtacctgtaacctccagcaagggcatcaggccccctactgatcgagctttcatcaagaagtactgcgtccctaggcaggcgcagggcgaaacaccacagcagcattgtgggatggccggtagcgggcaatag

SEQ ID NO: 34506 - DNA, 772 bp, Glycine max
  Peptide Sequence Number=SeqID_126191
agggctgctcgccctcaccttcagaggactacacatcctcgccttcagagggcggcaccccctctccttcagaggactacacgtcctcgtcttcagagggctgcacgcccacgccttcagagtactacacgtccttgccttcagaggactacacgtcctcaccttcagacgacttcacgtcgtcgccttcagagggatacacgccctcgtctttagaggactacacattctcgccttcagagggctagacgccctcgccttcagaggactacacgtcctccgcttcagaggactacatgtcctcacctttagaggactacacgtcctcaccttcaaaggactacacgtcctcgccttcagagggctgcacgccctccccttctcagggctgcatgccctctccttcatacgaccacacgtcctccccttcagaggactacatgtcctcactattagaggactacacatcctcaccttccgagcactacatagggttgcacgccctcaccttctgagggctacatgccctcaccttcagaaggctgcacgccctcaccttcaggaggctacatgccctccccttaagagtactacacgactacacgtcgtcgctcctagaggactacacgtcctccccttcagaggactacacgtcatcgcctttagagtgctacacgccctcgccttaagaggactacacgtcctccccttcagaggactacacgtcctccccttcagaggactacatatcctcacctttagaggactacac

SEQ ID NO: 34507 - DNA, 135 bp, Glycine max
  Peptide Sequence Number=SeqID_126192
atggccaataggatgcaggaaacctggacccatcatctgcagtcttccttcttgtctggaagctctaaactatgctttatcctacgatccggaagacgccgacagcctttgcctgatggggagaatatacagtga

SEQ ID NO: 34508 - DNA, 263 bp, Glycine max
  Peptide Sequence Number=SeqID_126193
ggctacacgccctcgccttcagaggactacacgtcctcgccttcatagggctacacgccctcgccttcagggggctacacgccctcgccttcagggggctacacgtcctcaccttcagaggactacacaccctcaccttcagaggactacacgtcctcgccttcagaggactacacgtcctcgcctttagaggactgcacgtcctcgcttttagagggctccacatctgcgccttcagagaactcaaggtcctctgcccttaa

SEQ ID NO: 34509 - DNA, 432 bp, Glycine max
  Peptide Sequence Number=SeqID_126194
atgactatgcagaacatgcagtttcagcaagagaccagagcctccattcagagcttaaccaatcagatgagacaattagttacccaattgaatcaacaacagtcccagaattctgacaagctgccttctcaagatgtccaaaatcccaaaaataagcagcacattccccctcttccattccctccaagagcagtttccaacaaaaaaatggaagaggcagagaaagagatcttggaaacgtttagaaaagtagaggagctgtgcactaataagcggaagcttaaaggaagtgaacgaattagcatgggcagaaatgtctccgcattgattggtaaatttgttcctcaaattcctgaaaaatgcaaagatccaggtcccttgcagtcaactgatgtgatggattttctcaaggatcagttcccatcattctag

SEQ ID NO: 34510 - DNA, 268 bp, Glycine max
  Peptide Sequence Number=SeqID_126195
gcgtatcacgaggccctttcgtctcgcgcgtttcggtgatgacggtgaaaaacctctgacacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34511 - DNA, 1014 bp, Glycine max
  Peptide Sequence Number=SeqID_126196
atgctggaagccctgaacgtcggcagtattgatctgggcagtacaggcgatattccgccaatattcgcccaggccgccggagcggacctcgtctatgtgggcgttgagccgcctaaaccgaaggccgaagtgattctggtaccggaaaagagtgacatcaaaagcgtcgccgatcttaaaggacataaagttgcgttccagaaaggttccagctcgcataatctgctgctgcgtgccctgcaggaagccgggctgaagttcaccgatattcagcccgtctatctgaccccggctgatgcgcgcgccgccttccagcaagggaatgtggatgcctgggccatctgggatccgtactactcggccgcactgctgcagggcggcgtgcgggtactgaaagacggtaccaccctgaaacagaccggctcgttctaccttgccgcaaaaccgtatgcggaaaaaaacggcgcatttattcagaacgtactggatacctttacccaggccgatgccctgactcaaagccagcgtcaggagagtattgccctgctggcaaaaaccatgggcttacctgaaccggtgatcgcgagctacctcaaccaccgtccaccgaccaccatctcccccgtagatgcacacgttgccgcacttcagcagcaaaccgctgacctcttctatcaaaatcacctggttcctaagcaggtggatattcgtgaacaagagggttcacgcccggttgaccacggctatctgcagcagatagcgcaggcggcggatcgcatcggtttcaccggggtactgatcccaaccggacgatcctgtgaagatgcctggctggtcgccgcctcgatgatcccggtgactcagcggctgaagttcctggttgcgttgcgcccgagcgtcgtctcccccaccgtggcggcgcgtcaggcggcaaccctcgacagactgtccaacggtcgcgccctgtttaacctggtgacgggtagcgatccccaggaactggcgggtgatggc

SEQ ID NO: 34512 - DNA, 360 bp, Glycine max
  Peptide Sequence Number=SeqID_126197
atgctgcccgccaccattctggccgccacgccggcggcgacgccggaaccgacgctgctgccgctgagcctggggctggtgatgcaggggaactatctcggccaggtgatcggcccggttgcgctgagcgccatcgtggccgcagccggttgggcggccccggcctggctggtgctggcggcggccgtgtcaggggcgctgttggcgctggcttttctcagccggcggcataaggcggggtgcctgcctatcgcgaaggataaggccaatgatgatcgagacccgacaatgacaaggcgccggtggccgcgaaatacaccagcaggccggcaaaggcgatcagtagcgtcttctcgatga

SEQ ID NO: 34513 - DNA, 165 bp, Glycine max
  Peptide Sequence Number=SeqID_126198
atgcaatcacagggactcgcactgtctcctgagcctgaggttatgtgggatgttatcgtgtttaggctgtttaataacaacttccccttgtacataaagcatgaagatctgtctgaaatagcacatggtggtcaatgtctcagcatctctgttatacaattgtga

SEQ ID NO: 34514 - DNA, 498 bp, Glycine max
  Peptide Sequence Number=SeqID_126199
atgggtgaagtagaggaggtaccagagaagatgaaggccgacatggaggccatgaaagagcaaatggccacgatgatggaggccaagatgatcatgaagaagataatggaagccagtgcggctgtagttgtcgctaccagaactgttgttaagtatggacgaccccatgatgtgcaaattcaaaacgagcatgccttcccgccacatggcttgcctcccaactatacaccacccaatgtggcgtacactcccaatgaggatgtcaataaatgctcattaagagccgacaacctcatcatatacatgtctctcaacccatgggggagacacatgaaattccccaccacaattaagccgacttcgggccttgcctcggatatgccactgaagggcaagcagttgttggtgtacccctacaaaaccctttggagggccctcagtatcatccccaactacgcctcttgcattccacaacaagtgaaaaccctcatgctatga

SEQ ID NO: 34515 - DNA, 228 bp, Glycine max
  Peptide Sequence Number=SeqID_126200
atgggctcaaaaatctaccctaaggttcatgagaaccctaaggccttctttatcaactctagcccaatcctcttggagcctcttgctcatggctctgggatcgtgcccacaagacgcccaatggactcggaggagcccaaaatgttcctggggtttccagctctggttacgggcctctgtcagtcctacagggtgctcgtttcccccagcaaggtcacgccatcatga

SEQ ID NO: 34516 - DNA, 497 bp, Glycine max
  Peptide Sequence Number=SeqID_126201
atgactaggggcaatccaggcgatttacaaccctttgatcctgaaatagatagaacctttcatagattggttaggcatagtatgcatcctggtcattctgtgcattttgagcattctgagcatcctgttgagggtgattttgaatattctgattttgagcattccactactaatttttatactgagaacatggctcaacctccacctcgtgagaggactcttagggagatggctacacctgatttcacttatgaaagcttgtgcattcaatatcttgatgagagtgttccatatgttctcaagactggactaatacatttgctccccaagtttcatggtcttgcaggtgaagatcctcataaacatcttaaggagttccatattgtttgttccaccatgaagccccctgatgtccaagaagatcatatatttctaaaggcttttcctcattctctggagggagtggcaaaagattggatgtactaccttgctcccag

SEQ ID NO: 34517 - DNA, 777 bp, Glycine max
  Peptide Sequence Number=SeqID_126202
atgactctgaaagtagggcttaagtcgtcgagccgaggtaatgagtgctattggtggtgtggctatggtattcttgaaagccaggaactaatgtttcccgacattatagagtatggtgtggctatggtagcacttctcggcgttatagagtatgttgctgcaacttgtaaaatggcttcgccttttcgacaagctttggcaggaacctacacagggatgctagcttaccgttcagcttctgaacttcttggatgttggtggggctacgcatctctagcacatgtcatatttgcagagttcctcaaagacttgttccaggtccgccacatgctggactatgctttgagacttgacgaccatgtcgcccatatatacctcgatgtttcatctgatctgttgtttaaagactcggtccatcagtcattggtgtctaggaagcttagcacctggaacccggacgctccatcgacgagcttgtcgatgttgggtagaggtgcacattctctattttccattggcctttttgaccatgacgacattggcaagccaaatggaatacctgatttctctgatgaacacgtcggtgatgtgccaatgctcatggctggtaaggtccctactaagccgtgtgcactgtctgagtttaggtttgagttgcagcttgacaagctcttcgatgggtttcaggcctctgttagaggctcccttgtaggaggatatgatgctacctcaggctctctgcatagcgttgtcgtgcttgcttttggtcagccttga

SEQ ID NO: 34518 - DNA, 249 bp, Glycine max
  Peptide Sequence Number=SeqID_126203
atgcatccaatgagtggtggattgactttgcttgtgtttgaggccttcaactttttgaaccaacttcagtgtgctcatgaagatagagcaggagttagatttgagggaacaactcctcagagaaccaatttgctttctctcacaaagatgatgatctttcaagctggggttcatcatatgagtccttgccacaagatgaggaggatcttgactttttttcaagatgccccattgatgggaagattttag

SEQ ID NO: 34519 - DNA, 336 bp, Glycine max
  Peptide Sequence Number=SeqID_126204
atggagaacaacagcggtttgtggtggctaatggtggctgtgggtgatggagaaagagcttggaaccttggaaatggttttggaagaaagaaaggagaagaaatggcgtttttcctaagctacacgaaagcaaaggctgaaacgctcaagcatcttctcaaagatcccaatagtcatatcgtggacaagtgtcttgtgaagctgcaaaccaaaattcgaaaagctccaacggttaaggaaggctgggcagcatttttaccgaggcaacttcatgtagattccttgagaagcttcattaagaggcttcctcaagaagcttcctcatggcttctttga

SEQ ID NO: 34520 - DNA, 318 bp, Glycine max
  Peptide Sequence Number=SeqID_126205
atggaggccatgaaggaacaaatgacaacgatgatggaagcaatgatgagcatgaggaagatgatggaggataacactgctatagttattgctgcgagtactgctactgagatggacccgattcacccagctggtttcaataaagtgaatcatccagtctcagatgtagtaggtcaagaaggtgaggtagtgaaaaatgcatatgggcctcatcatgttcaggttcagagcaagcatttcttcccaccatatgggttgcctcctaattatacaccgcccactgttatatgttggatcaagtggcctcagaataattaa

SEQ ID NO: 34521 - DNA, 129 bp, Glycine max
  Peptide Sequence Number=SeqID_126206
gggaagctcgcccaagcgagccaattgcttaggcttaaaggtatcagcttgcccaggcgagctggttatttaaggctgaagctttcccatggcccaggtgagctagatgctggcctgggcaagttttag

SEQ ID NO: 34522 - DNA, 582 bp, Glycine max
  Peptide Sequence Number=SeqID_126207
atgaaagtgcatcctttaacgtcaatgcaccagtgtaatagttgtctccccacacttcaaatggaatggtttgagttgtgtcatgaattattgggtgtcatgcctgacgatgctgcagttgatgggaactcacttttattgagttggctggcttctcattttgcaaatattcatgattttacaggcaaccaagaagggtttgaaagatttgctcgtgcttggatcttacgattcataggagggataatgtttgttgacaaaagcagcaaaaggaccttagagagtgcagcagttatgcatagtgctaaatcaataggcgatttcagtctcttgattcaattatgggcatggaaacgatgcccaacgttagccccgtcagttattcctccacaacaacaaaacgcgccacttacttacagatggttgggaggtgaattgcatcacataggcaatgacaatttacttgagtttcgtcataaattagatgtcatgaaacgcgacgagtttgtctgggtcccttattctggacatgtggaaatgaatttgagtcacgtttgtttttttgggtgtgggatcctctag

SEQ ID NO: 34523 - DNA, 450 bp, Glycine max
  Peptide Sequence Number=SeqID_126208
atgttagtttgtttgacaggttataggagagcattatggttcaagacaaatttgtgtagaagcaaagaatttgactttgatgttttgatgatgccatatgatcgtgatgatttgatgccttatgaaaatgtgcttctcaagtttaattcaagacaaaaattcaagaatacaagatacaacattaggaagatctctagtgttttaggaagggaattccaaattgaaactacaaaaggtttggccaagaaatttaagcaaaaatgtctttttcaagagatttactctctgggattaagagaccgagggtctcttgttgtaaagaaatctgaacacaaaggaagggttgtccttgtgtggttcagaacttgtaaagggattttgcaagaaagtggaactctcaagcgggttgcttggggactggacataggcacaagggtgtggccgaactag

SEQ ID NO: 34524 - DNA, 609 bp, Glycine max
  Peptide Sequence Number=SeqID_126209
atgtcccgcttagcggaagttgcagaccaattagagctgcataactcgctaagcatgcacctgtacgagcaaaatgtacactctaggaatatcctccccaagaggaatgtggatgtctatgtcacacagtatgacgagttccgaaaggagctcgagaggaggaggtggcacaaggccttgaccagacagcctgataaccaccgtgataagtcccctcagcagtgcagagtgaggggcaaattgataaagtttgatgctgagacccttaataccttagagaccccaatggttttggagccaggggagaggtactccacatactccaggaagaacctcactacccttgcccagacctggagtgtgctttcatactccaacctcgcccctacctctcatacgtctgatcttaacatggactgggctcagatttctggcgttatcactgtcaacccggatgatcccatgatcacttttccggggacccgcaaggatcaggctcggggaccttctgatggttccacctctgcccccgcttctacctcagcaccaacaccagctcctgctccagtccctccagcgatcacagcgccaattggcccctactcttag

SEQ ID NO: 34525 - DNA, 246 bp, Glycine max
  Peptide Sequence Number=SeqID_126210
attcaaaggactaaccgcctgagaatcctttgtggcacaagtagagggtacatctacttgggttgttatactgagaacaagagagggtacatctcttgtggatcagttcaagtggagggtacatccacttggttgttcaaagagaacaagggagggtacatcccttgtggatctttggctcgtaaaggattttacaaggttgaaagaaatctcaagaaccgttggttgcttggggactggatgtag

SEQ ID NO: 34526 - DNA, 1316 bp, Glycine max
  Peptide Sequence Number=SeqID_126211
atggagaaagatacaagtcttcttatggagaaaggctcagttgacacctttgccatcattggttgctccatcttctcttgtgcaacaacccttctcactagatgctcctccaacacacttcaatggccttctggtcgagttcctgaacttctacctaacaaattgaagcttaatgcaaaagataaagatgatattggagtgttgccatcatctggtaagcgattgaatgctggggatctaggattttattctcctacttgcccaattctaagtgtgaaccctcatgtttgtgctaaacccaagcaaagccttggtgacccttctaatgtgacatctcgtcttggcaaaagtgttgatgcttactcgttaacatgcattacatttcttggggactcttcttttattgctgttgggagcgaccatgcagacctctatcttacgaattatacttcgttgaagaactgtgaagagccctgttgtgaagaatgtcacaattatcccatgacacttattcagtcttttattactggtgacagccagctattgctttcttcaagctcccaagatattacgttgtgggatgcttcgtcaattttaagtgactatgtttgggatgaatgtgaaaaagaaatccatttatttcatgggtgcaaggctactaggtttagtcactctgggaatttttttgcagccttgtcacaagaatctgcacaacagggaatcttgttgtatgatatccagacatgtcagctagagtctaatttttcggatacttcaacaacttttgcaggtcaggctcatctttattctccaatccattttagccattctgactcaatgctgctttggaatggtgtcttacgggatcggcgggtttctgggcctattcatcgctttgatcagttcacagactttgggggtggaggctttcatcctgctggcaatgagttgtgttatggtgagcggttggtcatgggttcgaatttggaaacaatctcttggcatatgcaagtagacatggcaagaaaacccgtacccgttggggatacccgatacccgacgggtacccgacaggtacgggaatgggacaataaactcaaacccgtcggatatcgggtacgggtatggggatatgttgagaagtcgggagagcctctgagcaccgggggaatcagaggagtaaatttttatgaaatgactgtgtttgctttgcttgtaaaggagagttcttcccctgttccatacctcattgcttcaccatcctcgatgaccttctctaccatcagagaatggaattggttctggcaaactgattg

SEQ ID NO: 34527 - DNA, 897 bp, Glycine max
  Peptide Sequence Number=SeqID_126212
atggatttattttccaatgagagttttgaatgcattcaggcatttcagaactcaaatctcattccttttatgtctttgaaattgcctgtctattctgaattagttaaagccttttattctaacctcgaaactcaagaaagcactttgatttctgaggtttttgggataaaaatggtcattgaccaatccctattctatgacttgacccaattatctagtgaaggtgtaccatttgaaggtacactgaatgatgattggaaatttgatttctctgtgcatgatgcccgccagttggtttgcaccaaccaagcggatatgaccggaaggctgcttgccggttcattggcttttgaaagccacatccttcactatcttattgtgcgcattttacttccaagatcttcaaaccttgcacaggcttttcatactggacaacaaattgattgggcacacttagtccgatattgcatgcataaggcattgcgattaaatgctcatttaccatatccacatctagtcactcttttccttcaacactttaacatccgtcttgattttgaatcttatgttccaatcaagagatcatttttgattggtgctgctgtaattgcatcttttggttaccgcaaagagcatgatggctcttgggtaaaaaagggtgctcaacctcatgatgatgaaggacacttaccggtagaagaggattcctctctccttcagagtatcttggacaggtttgacggtcttcaaacctatgttagtgaaaggtttgatgctttggaactacaagtagacatgcgattcgacgagatggactcaaggatcaccaaggttgaaggagatgtcacttacattcgcacattctttgatctaccaccaccaccaccatcattttag

SEQ ID NO: 34528 - DNA, 693 bp, Glycine max
  Peptide Sequence Number=SeqID_126213
atgacaacaatgataatgataatgatattatcatcaacaacgacgatagagatcagtggtggtcgcagtggtactagtgatggtgatgatgacgttggtggtggtgatggtgacagaggtagtattagtcgtgatgataatgactgtgacaaagacactatggtagtggtggtggtgatgtcggtggcatcaatggtgacaatgatggtggtgttggtggtgacaccaagtgatggaggtgatattggtggtggtcgtagtgacaatgacaatggtagtgatagtggtgaggtctttgtggttgaaaatgatgattctgaagctagacatacttgggatataagggtgtgttgtgtgggggaagagaaccaaatcattcaactagtgattaagatggagggggtgggaggtaaggtgaaaacgagagccattagagaaatatttgcaactaaggatttggctaggaaggtggaggagaggaaaaaattttcaaatacgaatggtggtggaagggacattagggagtttaatggtttcattttttacatggagctagaggacatccctattgttcaaaggatgtatacatggtttaagccaaatagccatgtaaagagtaagttgggcagagtatttgtatctaaagaatgggttactcacttggcaagggagctctcatcatgtcttgaatag

SEQ ID NO: 34529 - DNA, 270 bp, Glycine max
  Peptide Sequence Number=SeqID_126214
atggacctggacaaggtgaaagccatccttgaaatgcacgagccacacaccgagaagcaggtgagtgtccatgtggcccagttgatctcagtgccaatcactcccaccaagcttattcggcctcccatcaatagggccttcatagaaaaatattgcatgccaaggcaggcacaacaacaaggtcaagcacaacagcagccagccgcagatgcgtcgccgccacctctacgacagccaccatcactggagtccatcttcgctcacctgtag

SEQ ID NO: 34530 - DNA, 340 bp, Glycine max
  Peptide Sequence Number=SeqID_126215
caagcaatgcaactcattcaagacgagggccaatcaggtgaaaaaaggactagagaaggcagacattggaatcactgtgattctgaaccctgagaagagatccttaagaaccttgatgttgcgactacaattgtggttgcaaaccatttttgaaaaccttattttaaagctgaagggacctaacaatccaagaaaaggttgttttgaaatacggcaagaagggagcggcaaaaagttcatcactctgttggatatgaagcgtccatttaaaagaatgaaggatctggacatggacaacgtcgtctcggatatcattgatgaaatatcaaaggctagttga

SEQ ID NO: 34531 - DNA, 774 bp, Glycine max
  Peptide Sequence Number=SeqID_126216
atggcagtcaaacgtccctcacgagactggcagcacaaaccgaaaaaagctcattgggttaaccatggcttcccgaaaccaaactggtggaagaataaacaaattggtacattaaacatgtgggtacaagtgtacaaccaaataaattgccgaactggaacgggaactggtgctaactcgaactccaactctaactcgaacgggaatggagttgacgaggacaaacgacctgagcgatttaggtcaatcaatgtgtggggggaaaaaggattttcgggctttgaacttatgaatgacacaacatcgagaagatgcattggcgacatgttggggatatccatgcgaataaggcaagtgcagctgaatgacttgatcaattacccaaataaaaatgggtacaatgcttcgatgaggggaaacgagacgtatttcaaaaccgcacaactctttgctaagagaggtcgacaaactcgggcaatgatgaactctggcacacagtattctggagttgtcttcgatactaaacacttactgtgttctcacgtcatggctgcctgtaaatctgtcaatgttgatcccatgaactatgtgccgatagataagtgggctcctgatctaaggagaatgaggactgcaaagggtcctcccgtttcaactcgcattcctactgagatggacgaagacgaaaatgaacgggcaagtagaaaaaaatgtggactttgccagcaacatggtcataacagaaacaattatcctaacatatcatcatcttaa

SEQ ID NO: 34532 - DNA, 765 bp, Glycine max
  Peptide Sequence Number=SeqID_126217
atggctgctacggcttcagcttccgctgcttctctctcccttcgctcttctcccttcaaactcaaccctccaaaactcaactccgttacgctccgtttccctcaccttaatcgccgttataacagcgccttcagagtcgtcgccgcttccgtttccgtctccaaccccaacgtgcaaaccggccccgacgatctcgttgcttccattctctcaaaggtggtgcaaacggatggaggagtattgctgaaggaggaagagcataaagaggtggccgaagtggctcaggaactgcaaaagtattgcgtgagtgagccagtgaaatgccctttaatatttggagagtgggatgtggcatactgttcacggccaacatcaccaggtggtggctataggagtgcaattgggcgccttttcttcaacacaaagcaaatggttcaagttgttgaagctcctgatattgtgagaaacaaggtctcactttctgttttaagctttctggatgtggaggtttctctgcagggaaaactcaaggctctggatggtgaatggatccaagttatatttgaagcacctgaattgaaggtaggatcatggcaggtccagtatggtggccagagtgaagttaaactcagaatcacttatgttgatgagaaaatcaggagcttgaaaagaccgctttactctttggctgcagagtttgtctcaaaatggactactgaaatttggtcaggggatgaagaatgtgggatggtttccaacctctag

SEQ ID NO: 34533 - DNA, 591 bp, Glycine max
  Peptide Sequence Number=SeqID_126218
atggtggatgctagacaatcagcttttttgggagataaaaatattcttgatggtatttttgttgccaatgaagtgatctatgaaatgagagaaaagaagaaatattgccttatttttaaagccaactttgaaaaggcatatgatttggggttgagtggattggttagggaagcggaagccaaggaattgttttatgaggtgaatgtgggagctagcaatttgaagataggaggcttagtagtttttcatcaatccttaattgtaaaaactatggaacttcctttcatgaacttaggactaccgatgggagcagatgcaagaaaagtgagcacttggcaactgattattgataagatgaaaatgaagctatcatcttggaagagacaacatctatcatttagaggttgttgtgatgagatgtttggaaacgaccttgggtggtttcaagtgaatattgtgaaagaggtagcggttgggagtgaggtgagtttttggcacactagaggaatggcagtgggaattgttgtggaaaagaccgtggttccaatggaaacttacactagtctagcaactatggcatactatcaatga

SEQ ID NO: 34534 - DNA, 600 bp, Glycine max
  Peptide Sequence Number=SeqID_126219
atgaaggggatcaagggagcgccgtacagggcacgtttagatgctctgatgatcatggacgtttcttggttgccttacactgagcaccgggcagttaggggctttgagcttatttcatgctaccaggggcagctcggatggggtcatgttgtggtctatgtcaaaccaaagagggtggtacgacagttcgggtacatccagaccatccctccgccgccggttactggttcgttgtcgtatgaggacatagacgacaggtggatgcattttggggatcatctagcacccgcggatatctaccctttcgtcacgccgacccaggaaggtgatgagcccagacatccacctgccccagatgtggatgcatacgtcgagccacatatcctggaggttccaatcgtagttgatctccctagacattcagtggttgcttgtgaaggttgcgaagcgatcgcagaaaggttggaccgtgtgctcaaccttaggatggtcacattaggaacaaagttacatgaaatcatggaagattgcttgcggatctctaggggtgacgcgtctgatggaagtcttagggcacgatgtagacaacacatagattag

SEQ ID NO: 34535 - DNA, 489 bp, Glycine max
  Peptide Sequence Number=SeqID_126220
atgccagcaaagccaccaagcatggaggaagaaggagaacaaggcacaccgcggaagaaggagatgagacaagcgcaaaggaactccggaagccacacggaacaaagagcacttcctatacgtatattgtcagtggggaagaagcgatcacgtggactgcaactcatggttgatgagtatgctgataagctcagtgaccaaagggctcaggttgatgccgaagatgaggcagtgatgaaccttataaggtctgatgattgggttgtgatgttggatgaacgtgggcaagacattgaatctgagcaaatggcagagttggtgggtgatgcaggaaatactggtgcttcacgattatccttctgtattggtgggccctatggtcatggaagaaaaatgcggcaacgagctaacttatcaatcaagttatcttcactggtcttgaatcatcaaatagcattacttgtgctcatggaacagctttacaggtag

SEQ ID NO: 34536 - DNA, 936 bp, Glycine max
  Peptide Sequence Number=SeqID_126221
atggctgattttcagacctctacacaccgagccaagtggattttctctcctcaacagctggttgagaaatatagagctgccaatcagagagccaaacaaattctagagaagtgtggagcaacactaatggaagtagatgttaatgggtcgttgtcatatcctgaaccccatatgactgcaaaggatagtgctgaaaaacattatcgaacaaaacctcttagtattgaagaagaacaatgtataaaggtattttatgaaaacaagctacaagaagtatataacaatttccgcttccctcataagatccaggatgtttgcacctgcttctcagtatgtcagatcgaactttttcacaggttgacctgcgtatatgctgcttgtaaaatagaagaaaatcatgtgtcagcggaggagcttggtaaggggatatcgcaggatcatcaaatgattctcaataatgagatgataagtttggaatttgatcttattgtgtatgcaccatatcgctcagttgaaggttttataaatgatgtggaggtttgtctggttggccctgatgcagcggaattctgtaatgctggtgatgaccagcttgaaatgctcaagactttgcaagagacagcaagatttgaagttgataaaatgatgcttacagatgcaccacttttatttcctcctgggcagttggccttggctgctctaagcaactcaaatgcactccacagagtcattgactttgatagttatcttaggggcattttttcccatgagaattccatgcatacaatgtccgagctttctgaatcactgaatgcaattgattcttgggttagaaaatataaaagtccttctgagaaggaattgaagcatatcaaccgaaaactgaagtcttgttggggtcatagttctcatgacgagtactttctctacccttaa

SEQ ID NO: 34537 - DNA, 1350 bp, Glycine max
  Peptide Sequence Number=SeqID_126222
atggatatgaattggaaaatgagggcaatccgagttttgccaatgtttcttttgcctgccttgtcttcagctacatatactgcatttgtcagcttcaccaggatgtgtgatcgcaaggaccagaaaattcttgaaagtcttagagctgaaaggaaggcaaaaattgatgagctcaaagagaagacaaattattacattactcaacaactcattcagatcatagttgtcaatagcggccgttgcgaccgctatagcggcggagcggcacccatccgcgacagacatgtgtgtagtggcgcggtttcgtgttgcggctggagcagccgctatcgcggcagagcagcgtgggttgcggagcaaatagcggtcatcccgctatccgctatcccgctatcccacttttggggtccaccgctccgctacgccggtgttgacaactatggtatagatatacatcacaattcagctgaaagtcttagagctgaaaggaaggcaaaaattgatgagctcaatgagaagacaaattattacattactcaacaactcattcagaaacttgagagattagtgggggcatttccccccagtgttaaacctgcatccgtccctgactcagcatcatgctatcttgctgcttatgcaactggctcttgtgatccacagagatatgatacagatcctgcagcaaaggcagcagctgcaactgttttagcatccaagttgggtgcagattcgggtttgaaagtgtatgtgggggatgaatcttctggtgtttcaacagggaagaccaaggatgttgaagtcgttcagtctagtgggcttcgaaatcgcaaacaagtgacctctagatccactagtccagggacaactacaccaaattattctgatcaacaattagttggttctgggaaaattgatcaaacccaaactcatgagcataatcagcttgtagttgttgaacatcacaatcctcaaagttcaacaatgaacgatggaggatggattgctcgaattgcagcattgcttgtgggtgaggatccaacacagtcttatgcacttatatgcggtaactgccacatgcataatggtcttgctcggaaggaggatttcccatttattacttattactgcccacactgtcacgccctgaacaaaccaaagcaatcggatgagcgtatatctggtttaaattcccataacactcagtctcctaaaacagatgacggtgaagaagttaaaaatgctagtgattctgcagtccggagtgtaataagaagtgataatcccgtaaatactagccctgagattgaggaagtatctgaaccggctatttcagaggagaaaagctag

SEQ ID NO: 34538 - DNA, 702 bp, Glycine max
  Peptide Sequence Number=SeqID_126223
atggttagaattagaggattgcgtcgggctttaggtagacttttaggaagagccttagggagacatgttagttgtgatgcagaagaagcccctaagcttcgaaggccgacaacatctgcatgtagacagcaagcaactgtagctattgctgaggatgttaaccatgtggatcatgttgttgacgaggttcatgagcagcctcaggaaccagttacgaatcatgttggtgttgatatagagggttttccaggcggaccccatgatacatcaatgttgacgtcatatgttgatcatgaatgtactgagttgaagttggtctctcatgggaggaaagtagagaaatttgaatggcatgaacctgagattgaaggcatagtggctgctacaagattaagttctctgattacatgttcgttgaacattggtgacaagggacttttatctgcttttgcagagagatggggttcatctattgttagacaccaaccagagaggatagtgcgacaatttggttatgttcagaccattcctccactccctgttgctccatccttatccatagaggagattgacgatagatggcttcaatttttagaataccttgcaccagttggacaaatttgtagtgctcctggacagtgtgcagcggactacatggagtggttctataggatatctcaccccttcatgagtttgacatag

SEQ ID NO: 34539 - DNA, 312 bp, Glycine max
  Peptide Sequence Number=SeqID_126224
atgacattggaaaaggtaattgtggttgtggagatggttgatgagaatcctaaaattgcccaaatgcaaggacgtatgatcaggagtaggaccaaacagtcagtggataccctccaacaaatggtatcaaacatacttaacaaggccaaagtggagaaggatgaaggcctagaggcagagacactactaagaatattaattgttgctgaaggttccttgttgaaccaatctcagacttatcaaggtaattcttatggtgtctatcctgacttatctttcctctctggaagtggcgtcatccaaactttgtga

SEQ ID NO: 34540 - DNA, 258 bp, Glycine max
  Peptide Sequence Number=SeqID_126225
atgtgcaagcagactatcaaccacgaagtccccaagataaaacagctcagatcactgtataagattcccactgcactgagggaaccttttctagaattacaccctcttttgccggaactggatctgcggcaagaggaatcgcagcaaatgaggaaggatctgtgccagtgggatcggagtggcaagaattcgacgacgatggagctcggaacgaagcgggcactacaactcaaaaataactttgaacggagcgggtag

SEQ ID NO: 34541 - DNA, 1093 bp, Glycine max
  Peptide Sequence Number=SeqID_126226
atgtggtatgatgaaagaatttcaaaagatagaaatacaacaagtccaaaattcagcttatgttgtggagatgggaaagttgagcttccgttattacaaagtccactgaaatatcttgaacgacttctgtttgatggtaaagcaagtgatagtaaaaattatcaatgtaacatacagacatacaacatgatgtttgcctttacgtctgctggtattaagctagacaaatcaattaatgaaagtagaggacctcctacaattagaattcagggtcaactatgccatcgaataggcagcttattaccaatgcctggaaagcaaccaaaattttcacaattgtatatctttgatacgcagaatgaaggtgaaaatagaattaatacaatgagtcaacatgttggaattcaactagagattgtttcaactttaagtcaaatgctggatgagtacaatgttcatgcaaaaagttttagaatggtcagggacagattggcagatactcaagtcgataatgtaaaattgagattgatagctatacgtgagaaagatggtcatacgtacaatctcccaaatgtttatgaagttactgctctaattattggtgattttgatctagactcaagaagggatattattgttgaaactcaaaatggagaattacaaagaatccatgaattacactctagctatctaggactccaacaccctatactcttcccttatggtgaagatggatatagacctgatatatttctacgttgtacacttagcaacagaaaaaggaagagaaatcgtctaacaatgagagagtggtttgcttatagactacagtccagatcaaatgaagcacaaactttgttgcattctagaaaactattccaacaattcattgttgaagcatacacgatggttgagtttgaaagacttagctacattaggaataataaaaaaaaacttagagttgacaagtattgcagtttacaaacatcattagatgctggaagcagtaaaggttcttctaaaggaaaaagagtgattttgccgtcaacctttgttggcagtccacgctatatggaccaactttattttgatg

SEQ ID NO: 34542 - DNA, 264 bp, Glycine max
  Peptide Sequence Number=SeqID_126227
atggttgaaggctcggatgcaagggataacttggctcccgaactaaagatttcaagtggggaagaggctgaagtccctaaggaaagcgaagaagtgcaagctttgaatgtggaacttgaaagaatgcaagtggtcaagaaaaagttcaagatgacagccatcaaggttaggaaagagtgtgatgagctaagggatgtcaacaaggccacaaccgaagcattagaacgagaaatgaagagggcccgaagagaagaatggggctga

SEQ ID NO: 34543 - DNA, 66 bp, Glycine max
  Peptide Sequence Number=SeqID_126228
atgcaagaaggacgaagaaggaaaatacctgaaggcaaaccggtaaataaagggattactatatag

SEQ ID NO: 34544 - DNA, 498 bp, Glycine max
  Peptide Sequence Number=SeqID_126229
atgactagagacagacttaaaaaggcccaatacagtgatgaggacacaactaagggcaatgaccatgaagcacttgaagggcccatgaccagaggcagacttaaacagacccaacacgtcatagagacaagactgaaagcttctctcagggtttctgttgaaccaaattctgacttatcaaggttgattccttgtggcgtcaccgtgacttatcttccatctctggaagtggcgcccctctccgtcaacattcctgtatcaaacgttctgccccgtagtaaggcctccttgatggataaatttcattcatctttaggaatctttcaccatgcatcggagggaaatgtacttaaggctattgagctcacagggcagctggcacaggatattctggaggacaataacgatttgctgtttgatcttctaagccttcatttggtagaccttgtctgctctaaggaatgggcagaagctttggagtttgctcagaccaagtag

SEQ ID NO: 34545 - DNA, 516 bp, Glycine max
  Peptide Sequence Number=SeqID_126230
atgctggaaagttttaaacaacaacaagaaatgtcagttctagaattgtacatagaaaaggatgtggctggtggttcaatgtttcattctgcaaattcgcttacatcatgtggaaattatttatctaatgatgagacacaaccgccaacaaatatgagcaatatacatcttgacgaagatgatgatgatgatgatgatgatgattatcttgtgtctaacttatacgttgaagagtctttagacaaagatgacagtgttgacgatatatctgatacagacaatgaagtcaccgagatgattccactagtacgaatcgttcacccagcagaaggtgtacaaggaattcagaatcaattttggaatgatgaggaggacatttgtggtttggagatgccatccagttttaatgttggccaagaattatatgttggcatggattttgatagtaaagatgcggtcaagaatgcagtcaaacaatatgttatgaaggtgcatcaaaatttcaaagtgatttga

SEQ ID NO: 34546 - DNA, 387 bp, Glycine max
  Peptide Sequence Number=SeqID_126231
atgggattgaaccaaacaccctattttaagaaaaggttctatcatgtcaaaatcaagagcctagaggtagccagtttgcaagagctagggcagtggatggaccaactccaatgtaaagccttccgcaagacatatgggaaaatctgggacttggctatgatagaagtttccgtggaagccatcgcatccctcacccagtactatgaccaaccgctaaggtgcttcacatttggggactttcagttggtaccaaccgtagaagaatttgaagggatcttgggatgcctgctagaggaaggaagccgtatctattttctgggttatacccctccatggcgagagttgctaaagtggtcaagatctcggcgcaagaattggaccgagtga

SEQ ID NO: 34547 - DNA, 146 bp, Glycine max
  Peptide Sequence Number=SeqID_126232
atgggatcaaatcaaacacccttttctaagaaaaggttctatcatgtcaaaatcaaaagcctagaagtagcgagtttgcaagagttagggaaacggatgggccagctgcaacgtcaagctttccgcaagacatatggaaagatctg

SEQ ID NO: 34548 - DNA, 696 bp, Glycine max
  Peptide Sequence Number=SeqID_126233
atggagggacttggcagcataagtggcaccccccatggtggaaagagaaatgatcactatgatagtagacacattgtaggcttaaggaggggaaagtttgattatgccgcctccacaagcacaaataataggaggtttggggcaagcggagcaaagaagaaggagggagatgcatatgtggtgactttagctctgacgtggcctaaaacccagcaaacccctcacaacacctaccaatatgccccacaccaaccaagcttttcggcccatgtcggaaacccttccaaaccgacgcccgtccaacaaagagtgcttgctcaaccacaaaggaatcccccacaaaactcagctcccgcacaatctcgtcctgccggcaactccaaccctagcacaagcaccaattcaggatggaattttccaacaaagaagcctgcaaaattcaccctgatctcgatgtcgtatattgatctgctatcgtccttgatcaccaaccagatggcggtggtcgaagttgatggaagatgtgttaacctcgaggaggttcatgttggaggcgctgcacgaagcgagcatgatttgcctcaaaaggggcaagggagatgcttgtttgatacacttaggagcagcacacgatgtagaggcatgccctgcggtagaggatttgctacaaggaatgatggacaaaggcgtgtttga

SEQ ID NO: 34549 - DNA, 318 bp, Glycine max
  Peptide Sequence Number=SeqID_126234
atgaagctgaaggtatatgcggaccgcatgtcccaaccatcccgtgcgattctcatattttacaaagtgaatggaatagattttgaggatgtcaaagtcgatttatcccaacatcaccagctatctccccaattccgagtgattaaccctttaatgaaagtccctgctgttgttgatggaaggttcaaactatttgagagtcatgctattctcatatatcttgcttatgcatttccagataaatatattttacagttgcatggtacaagtatacaaagagttttttcttacaaaaatcgatattgcagaattaattaa

SEQ ID NO: 34550 - DNA, 294 bp, Glycine max
  Peptide Sequence Number=SeqID_126235
atgaccaacaacaacaaaatcaaatccatcaggtggacatatgcatacgcgctttccacgggcaaacgacgcgaggtcagtatgagggagacagtcttcacgacgcgagctccactgcttcacggcgaggtttcaaggagagagtgcttgacgacgcgaggtagagtgttaactacaggggtttcagctagggcacgttggagttgcgggctagagtgttcatttgattatcgttcgaaatgttcgagtagctacaaagacggtcatagggatgtccgtcgttgtgttatttga

SEQ ID NO: 34551 - DNA, 387 bp, Glycine max
  Peptide Sequence Number=SeqID_126236
atggccttaagaaagagacacgcttccacctccaaacctcaagaaccctatgactcatctcggtttgtgtctgaggttgcctgggagcgatacgagcagaatgtccatgccaggaacatcctcccagagaagaatgtggagttggccttctcccagtatgatgagttcctctgggagctcgagaggtatttagccctggtcaatgaattctacacaaacctctatgatctagaggatcgctcccccaggcaatgcaaggtgtgggggaagctgatcaaattcaatgctgctactcttaacaaatttttggagaccctagtggtcttagatcttggggagaggtactcggcttactcccgattctgcagcacctatctagacccatag

SEQ ID NO: 34552 - DNA, 150 bp, Glycine max
  Peptide Sequence Number=SeqID_126237
atgaggccgaggcgctttcaaaacgttctcgtgatcaattccgtgatcattcttcaccgttcttcgtccgttcttcatcgttctttgttcatcgaccggggtcctctcttgcttttcgcatcttcatctttattcttctaccatcagtga

SEQ ID NO: 34553 - DNA, 366 bp, Glycine max
  Peptide Sequence Number=SeqID_126238
atgccttatgtggaagccgcagaggagtccttggagatgtcctttcaagccttggaaatggtaagcaacgcttatgtggagtctcccccagtacaacaacgctcatctgaggctgcattaatggtagctcgggtgatgttatggcatgggtacgagcccggaatgggtttgggccagaacaacgatggcatggagagcttggtagagttcacggagaaccgcagaaggttcggactagggtataagcctacgcgtgctgacgtgagatccgacaatgattcctatgaaggtaatgataccgaggacctagacgtcaattttgagcaaccggtaaaccaagctgaggatgaagaagatgaggattga

SEQ ID NO: 34554 - DNA, 339 bp, Glycine max
  Peptide Sequence Number=SeqID_126239
atgactaggggcaatccaggtgatttacaaccctttgatcctgaaatagatagaaccattcatatattagttaggcataatgtgcatcctggtcattctgtgcattttaagcattctgttgagggtgattttgaatattctgattttgaacattccactactaattttcatactgagaacatgactcaaccttcacctcgtgagaggactcttagggagatggctgcacctgatttcacttatgaaagcttgtgcattcaatatcctgatgagggtgttccatatgtgaagatcctcataagcatcttaaagagttccatattgtttgttccaccatga

SEQ ID NO: 34555 - DNA, 270 bp, Glycine max
  Peptide Sequence Number=SeqID_126240
atgacccctactcatgatgccatgctatattacaacgtgaggtggaacgtgtcacgccaatatgagtttgttggttactcgttcacaggaaaaaatccaaaaaagtttgacattccttctggatgtaccatcgatgaaggatttgatcaagtaatggaaatggaagacgacgtgtctcagtcgcaacaaacgtcaatgctaataaaattttatgttcatggttcacctaaatcaacaaattcggtattcagcctagacaaagttgtgtaa

SEQ ID NO: 34556 - DNA, 321 bp, Glycine max
  Peptide Sequence Number=SeqID_126241
atggggcgagtaaaatccattgcaaataaagagcaacttctcaattctctttgcaaagaaattaaagtaatgattgctagattcgattctggggagagtagcaggaggaacctgcattggttgagttggaacagacttgaaacatcaaagagtggtggagattcatgcaaagattttagacaaatccaaggtgttacaaccaccaccaccgtcatgaccgtttccatcacaactgccatggctgccatcacaaccaccaccatgattgtcaaccgtcacgatcaccgtgatcgtcgtcatgaccactatcgtcaccactaa

SEQ ID NO: 34557 - DNA, 189 bp, Glycine max
  Peptide Sequence Number=SeqID_126242
atgcagtacagactttcacgcttcattgtgactttgacggcgaagaaaagaacgcaaggcatgagcaactatatggcaggagtatgcatgagtgaacataacatgcgactaatgacaacagaaggtaacaacattgtggcgatagggactactagcgacaatgcattatcaagcgagtcagagacctag

SEQ ID NO: 34558 - DNA, 477 bp, Glycine max
  Peptide Sequence Number=SeqID_126243
atggctcctctcattgctctcaggtttgcttctataagagttggagatgtcagaatattcatcaaagttcttgttgattcactcttctcaactgtctttccggtttttgctcaaaagcatcttgatgttgttcttgatggtcatctagatggatataagtactctgtcacttcagtgaatgagtttattcttgcgcaattgatgagattgagtctctgttcatcactcgaagttcaattgaaaaggaacaagttggccactacgttggatcaaatgtccatcaatgtgacacagaagcagtttagatcatcgggcaatggaaaccgacatggtggaaataaaggaggccatagtggagcaccttcattgtgctggtgggtagcactaacatggactatttggcagcaaaggaacaggatagttttctctaatgagaccttcaatggaagtaagctgatggatgatgcagtattctag

SEQ ID NO: 34559 - DNA, 51 bp, Glycine max
  Peptide Sequence Number=SeqID_126244
atggcagaaactcaaccaaggtacttagggatggaggcaaatggaggatag

SEQ ID NO: 34560 - DNA, 210 bp, Glycine max
  Peptide Sequence Number=SeqID_126245
atggcatgtaacctttgtttgaccgcttcgaggtacttggcagcctttgttgcacaatacgtgaagttccgtgacatgatgttcctccagaaggcagttgcttctggaggaagaaacctggctcgcctgggcgagctgggtggcaagctcctcccctattttcctataaatagagggaagagtgaaggtgaaaggggttcagcccttctg

SEQ ID NO: 34561 - DNA, 537 bp, Glycine max
  Peptide Sequence Number=SeqID_126246
atgaagagatggtgggctatgcaccctcaaagctttgcggatttggtcttcgccagtgaaaggatcgatgtgggtccgaaaagaggcaaatttaatcatcctactaggacgactgagaaaactggggcaaatgaagagggtgagaaagagggagaaacccatgctgtgactgccattcctatacggccaagtttcccaccaacccaacaatgtcattactcagccaataacaaactttctccttacccaccacccagttatccacaaaggccatccctaaatctaccacaaagtctgtctaccgcacttcccatgacgaacaccacctttagcacaaaccaaaaacatcaaccaagaaccataaccctatccaaggttcatcaacctccatttctccgagaatatgactcaaacgcaacgtgtgcttgtcacggagaagccccggggcattccattgagcatggtagggctctgaagcgtaaggtgcaaggtctaattgatgcgggctggctgaaatttgaggagaattgcgtgtaa

SEQ ID NO: 34562 - DNA, 156 bp, Glycine max
  Peptide Sequence Number=SeqID_126247
gatgtggccagtggtttgccctcaataatgcacataaagtgggagcaagaaaaggagaaggcaaaggcactgttagatcgtagatatgctggtgttttgtgtatatctttcgaagatatgatgattgtccttggaatgcaggacaatgagagtcct

SEQ ID NO: 34563 - DNA, 1004 bp, Glycine max
  Peptide Sequence Number=SeqID_126248
gataatcttgtaggcaaggtgctcgtaaaaaaggcagggacaagttttgcaaaaactgatgatgtcacacaccaagtgtttgataatttttcggaatgcagtgctaaatctgaatcttccccagaggtttcttgcaccttaggggacaatgattcaaccaccgatgatgattcatctcactcctgtggctctaagtcatcaccgcagctagacgacaataaggctcccactccttgggtcaatctattcaaagataacagaagcccttccaaaggttttggaatgaagttctcccctccaccctctgatgatgaagtgttgttggaagaaactgatttgcaacccctggaagaggcttggggacatagccttattggctatgtggctggtcgattcccaggaaagaaagctctgtgggattgttgccaaaaatggggagtcaaattttcatactcagctcatgaaagtggttggctggttatgccagcattctttgactttggcaatgaggagctcagcaagatccccgtctgggttccactcagaaatctacctctggagctttggaatcctcaagccttagggaaaatcctagctttagttgaggttgatgcttctttggagctcatcgatgaagtgcaatttagaattcctatagggaagacttttgtgcaaaagattgagtatgaaaatagaccttctttttgcactcactgcaagatgattgggcaccgcctcactaattgtaaaactgtcactgcaaataagcctgttctcatcacagcctgccccacctcggatcagccacaagtgggtgattcagcaatgcccccacataccaatacagcaggcccctctgataacccaaagaatgtccagactaatttgtttgtccctcctcacagaaaacatgttctggttgcaaatcatgttcctgtccttcagaattcttctgacctcaaagaaacagggaacactgagttggatgatcctatagaagaggg

SEQ ID NO: 34564 - DNA, 190 bp, Glycine max
  Peptide Sequence Number=SeqID_126249
gaccgggaaacgcggcggcataggaaccacgggaccccctactagtaaagggaaaacggaagtgcgcgttagcgcaccagctgaaaaagccctttccccttactctaacaaagctaacgcgctttacttaaccaaggctttctctgataggggctcgttagccgttgtttgggtcgagctcaaaccttag

SEQ ID NO: 34565 - DNA, 576 bp, Glycine max
  Peptide Sequence Number=SeqID_126250
atgacattgctgctcagcaacatccctgccccagcgatcataattctgacctccctctgccgaagtgctagctggtgtatgccgcctaccaggcaccctctagacccagataagtctagcagggccttgggttttccggcattgatcacgggtctctgccagtcgttcggggttcctgtcacacccagtaaggtgattcgaccgccgatcacccgggctttcatagagaagtactgcacagctagcaggcacagggtggcgacccgtaggccccagacgcaccgccgccacctcctcaggctgacccagctgggtcatttgacacgaaacagtatttacggcatttggttcgccagcaggcagccaaccacagggcgcacgtgcagacccatgactgcctctaccaactcagcctcagcctgtagagccaaggttttgcctcttttccatgccctactccggatcagttcggggcataggtcgcatggcccggagattggcctgaggcccaggcaggggaggcacccgcagaggcacccggcgaggcagatgaggcccgcatggacgaggagatga

SEQ ID NO: 34566 - DNA, 438 bp, Glycine max
  Peptide Sequence Number=SeqID_126251
gttgtaccatctgtggtgaggctcatgaaacaggccaatgtattcccattaaagaaaacactcaagaaattcattatatgggaaatcaacagcgacaagggtatactcaaggaggattttcaggcttccagcaaggtccctataatcaacaaggacagtggaggacacaccctggcaatatgttcaacaaagaccaaagtaacaatgtcaaatcataaaagcaccgagtcagcactgaagaaccttgagattcccaaggaggaatgcaaagctgtgatgacaaggagtaaaaggtttgtggaggctgaggatgaggataatgttatgcataagaagaaaactactgacaaaaaaagtactgatggcaagaaaaatgaggaaattggaaataaccatgcccttcagagaagcattgtagcagatgccactttactctaa

SEQ ID NO: 34567 - DNA, 414 bp, Glycine max
  Peptide Sequence Number=SeqID_126252
atgccaatctccccctgcaaaagtatcagttggtctgtgtcgtcccgacatggggatcgcacccacaagacacccagtggacccggaaaagttcaacaaggccctggggtttccaactctggttacgggcctctatcagtcctacagggtgcccgtacccccccaacaaggtcatgccatcccgacatagggatcacgcccgcaggacacccggtggacccaaagaagtccgatagggtcctggggtttccagctctgattacgggcctctgtcagttctatggagtgcccgtcgccccaacaaggtcattaggcctcgcattaaccgggctttcatcaagaagtactgcgcccccagacgggcgcagggcgagacaccactgtagcattgggatggccggtagcgggcaatag

SEQ ID NO: 34568 - DNA, 519 bp, Glycine max
  Peptide Sequence Number=SeqID_126253
atggcccgggtaatgttggggtatggctacaagcccggaatgggtttaggcaagaacaacggcggcagaaccagcctagtaagcaccagaggaaaccgcgggaagtttggattaggctataaacccacgcaagcagacataaggaaaagtgtcgtggaaaggaagagcagaggccaaagttcgcaattgggtcgacaagtcgaaggggtcccaccctgccacatcagtaggagctttataggtgcgggtctaggacatgaaggccaagtcattgcgatatgcgaggatgactccccgagaaggtcggatttggtacgaccatggcctcctggtttccgactaggaaattggcgagtggaggagcgcccggacatttacgcgacaagcataatatccgacgacgagtccatcgaaggtactaatacctgggacccgaccatcgatttcaagcaagaagcgggtcagacggagagtgaagaggacgaggatgtggacttcccccggagttggagaggatag

SEQ ID NO: 34569 - DNA, 435 bp, Glycine max
  Peptide Sequence Number=SeqID_126254
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtgctggtcccttccttcaacccccctcatgcctatttatgggaaatgaggggtggaggttgcatagcagcttgcctaggcaagttgcttgcttcctccaggaagcaacctagcttacccaggagagctggttgcttcatcctaagctttctagtgggtccaggggctaaaaaatgtaccggtaccgagctcgaattcgtaatcatggtcatagctgtttcctgtgtgaaattgttatccgctcacaattccacacaacatacgagccggaagcataaagtgtaa

SEQ ID NO: 34570 - DNA, 294 bp, Glycine max
  Peptide Sequence Number=SeqID_126255
atgtctggttattccgtacgaacgaactcactgctaaatagctatgggagatgttctgggccgcacgcgcgctacactgatgtattcaacgagtctatagccttggccgacaggtccggatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtga

SEQ ID NO: 34571 - DNA, 285 bp, Glycine max
  Peptide Sequence Number=SeqID_126256
atggcagagccatcaaagaagagaagggatcatcctccaccgctaccgctgctgcccatcgccgtcacggcccatccggagcacccacagcacctattcctccttctttgtcatctccaagatcatcaacactgttttcaatccttgatgatcatcttacgtcattttttttctttagaatttacccagtcaagtgcacctagggcaccattgttgatgactggaaattcgattattcgagtcatgatgctcgtcgcatggtctgcaatgatcaagctgaaatga

SEQ ID NO: 34572 - DNA, 369 bp, Glycine max
  Peptide Sequence Number=SeqID_126257
atgggtacctcaaagccttacactagggcaatgaggggcatcacgcatgagcctcaagcgagcataggggcagatcaaaataccctcgccttttgtgggctacacgccctcgccttcagaggactacgcgtcctcaccatcagaggactacacgtcctcgcctttagagggctacacgccttcgccttcgtaggactacatgtcctcgccttcagagggctacacgcccttgccttcagaggactacacgtcctctccttcaaaggactacatgtcctcaccttcagaggactacatgtcctcgccttcagagggctacacgccctcgccttcaaagggctacaagccctcgcctttagaggactacat

SEQ ID NO: 34573 - DNA, 58 bp, Glycine max
  Peptide Sequence Number=SeqID_126258
atgcgtccgaaggaggaggagaaggaggatggaggaggaggaggaggagtggaggcag

SEQ ID NO: 34574 - DNA, 1254 bp, Glycine max
  Peptide Sequence Number=SeqID_126259
atggcttctaggaaatgcaagagtatcggttcaagacccacaacacaatatgatacaaggagatttcactccttagatgcttggaaccggtacatggataatgtcctagggagaaacatcttgcctgagaggaaggtggagctctaccacaccgagttggatgattttaagactgagttggagaggcgtaatttccataaacgcctcaccaatttggtcgatgggagcatagatttagctttggtcaaagagttctatgcaaatttatacagctttgagggcccttcaccaaagcaagccagagtcagaggccatctagtgaagatcgacgctgacaacctcaacacattcctggcgacacctatggtgttgacagagggtgagtctttgcccacatactctagatactgtaggctgcccaaagattatagagagattgaggctgccttatgcataacaggccgaggtgttctctcatactccaacctggctcctacctcctgtacctctgatttgatagtggacagagctaggcagatctttggcttagtctcttgcatggacatgaacacttgggttcctgctctgatcaccgccctatgtagagccagaggggttgtctctgacagcctaacttttgagagggtgagggcgaggccagctgagctcccttccacatctgtagctccgactctagcatccacttcaacagcttcgtcagtcctagctcagagtgattctcaacactttgaagccatgcttcagagcattcatcagggacaaatcattttactccagagcttacaggtgatggcgcctccaggatccattcctactgttgagcagtttttggcgagtgtaacctggcctggggcccaaccttctcttcacagggaaaatgaaggtcccacagcccaagtaccacaacatatggaggatgagtcatccgaggacaccattccagagccattcattgtagaggaggaggcaggtgagacacagattagacaggaagctgctgctactcctgagagatctattaaggtcactttagagcctcctgcaccagtggtggacctatcctcgcctcagcatgtagtagatccctccactcctatactagagataccagaggacctgaccacacttgtcctgactctgaacacctctcctctagctactccagtacttcatctgacagatgaggaggctgttcagacccaggacactcaggaccagtcacaggaattctaa

SEQ ID NO: 34575 - DNA, 534 bp, Glycine max
  Peptide Sequence Number=SeqID_126260
atggaacctctctcattctccacctcgcacttatccattcccaccaaaaccacccttttctcccccaaacaccatcctccctccgcctctgccgccaccaccaccgtatccttctcccacaaaccaccgtcagactccaacagcgctgccacccctcgccgcccctccaaaccccccaaagccacaccaataactcctccctcagaccctctcgctaacaagctatggctcacaagcaaactctgggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 34576 - DNA, 549 bp, Glycine max
  Peptide Sequence Number=SeqID_126261
cgaagcgcgagcggcgggaggaagcggcggaaggaagcggcgcaaggaggggagcggagggaggagagggggtgtgggagcgaagcgcgagcggcgctaggaagggggcgcaaagaagcggcgcaaggaaggtggcgcaagaaagcggcgcaaggaagcgaccgaggcgagaaagagaagcagggggaacacgtggtggaacggggaggaaggagaggtgtgggagacacaacgctaagggctaacggcgcgcccgggggcggccggcaagttgtgggcgccccccgcgcgcgggcgcgcccgcgggcggggccgccagggaagcagccggccaagcggcggagccaaggcgcagtgtggggaggaagcgcggggggccagggcggaggccggaagggagggcgccgccgcgcaccgcggcgccgggggcggccgcggcagcgccaggggggaaaagcacctaggaaaggagcccagggaagcgcaaagagccagccgccagagaagccccacaagcaagcggccagcaagggggaagctgagcagtaa

SEQ ID NO: 34577 - DNA, 555 bp, Glycine max
  Peptide Sequence Number=SeqID_126262
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgctatgacgatgatggccgtcttaaacgaacagggaccatttggactacaagctcccacataataacagctgtggtaggatctggggtgctctccttagcctgggcaatagctcagatgggttggattgctggtcctgcagtgatgatcttattcagcatagtcactttgtatacttcatcatttctagctgattgttatcgtactggtgaccccatattcgggaagagaaattatactttcatggatgcagttagcaccattctagggtaccgagctcgaattcgtaatcatggtcatagctgtttcctgtgtgaaattgttatccgctcacaattccacacaacatacgagccggaagcataa

SEQ ID NO: 34578 - DNA, 505 bp, Glycine max
  Peptide Sequence Number=SeqID_126263
ggcgcgcttagctcaacctccatgaaacataacaagggcttagcgcagcaggctgcgcttagccttatacaaaggttgaaaaatagaagcaaagtggcacttagcctgacagggatgaatgtgcttagcgcgatcatctggaaatccaaaaatttaacagttgtgatgaataggctaagcacagcaggcacgcttagtcgagcgtccgctaagcgcaacactcatgggctaagcgcgaggaagactctagaagaagatgagttgtacaggagacatcctgatgaggacatgaccaagagcaagggcaaggatccacttgaaggacttggaggacctatgacaagggctagagcaaggaaagccaaggaagatcttcaacaagtgttgtccatactatttgaatacaagcccaagtttcaaggagaaaagtccaagggtccaattggcaacctaggcatcagccttttgggagaccaaatggtggctgacttgttggctgttgggg

SEQ ID NO: 34579 - DNA, 474 bp, Glycine max
  Peptide Sequence Number=SeqID_126264
atgaccggacgtcttcttaccgggtcattggcttttgaaagccgcatccttcactatttaattatgcgtattctgcttccacggtcttccaaccttgcccaggtttctgaggaagatctaattatcatgtgggccttccatacagggcgtcaactcgactgggcacacttagtcagatatcgcatgcataaggcattgcgattaaatgctccactaccatatccacagcttgttactctatttcttcgtcattttgaaattcttcttgattctgaatcttatattccaatcaagagatccattttaattggtgctgctgcaattgcttcttttggttaccgcaaaaagcgtgatggctcttgggtcaaaaagggcactcaacccgctgatgaagaaggcttatggacaagtttgatggacttcaaacttttgttggtgacaagtttgatgccatggaattacaagttgacatga

SEQ ID NO: 34580 - DNA, 159 bp, Glycine max
  Peptide Sequence Number=SeqID_126265
atggcatgcaacctttgtttgaccgcttcgaggtactgggcaccctgtgttgcacaatacgtgaagtttcgtgacatgccggagatcaaaaggaagcattgttacacagtccggggaggagtgaaggagaaagggttcagcccttctggtacttcgtaa

SEQ ID NO: 34581 - DNA, 300 bp, Glycine max
  Peptide Sequence Number=SeqID_126266
atgcaacagggacaggcagatatcctcatagctaggttccctgaccctaactatggtgttaaagtgggttttcgttctctaccgaaaccgcaagccaagttggaaattctgcttcggttgaagggttcctctcggtgtgggttttcaatggagaacaatgatggtttgtggtggctaatggtggatgtgggtgatggagaaagtacttggaactttagaaatggatttggaagaaagaaagaagaagaaatggcatttttcctaagctacaagaaagcaaaggctgaaatgcttaaataa

SEQ ID NO: 34582 - DNA, 648 bp, Glycine max
  Peptide Sequence Number=SeqID_126267
atgatgcttactacatgcaaaggacctacttcatttgaggatattagaacagttgaaaatgttctataccctacatatagagaagtgccattactaaacctaaagaactttggaatcagacatgaaattgaattagacattgatgatgaccaacttaaaaatttaacattactggaaattgaaaaacttgtacatgcaaaccaaaaatcactcaaagactatcctacaatgccatatcctgagggtgcaaatcctgcatggtgtctagagaatagcttgatattatctgaacttaattacaacaatgatgaggctagatcagaattcgaaaatcttttttcatctatgacagatgaacaaaaacaaatttatcaaaaaattatgcaagatgtcaacaacaatgaaggtggcatgtttttcctatatggatacggaggtacaggaaaaacatacatatggagaacattagcaagttcactaagggcaaaaaatcaaattgtgattatggttgcttctagcagcataacttctctgttattgccaggaggcaggactgcccattccaaatttaaaatacttgtgccaattttcgaagactcaacatgcaacatacttcaaggaagtcagctaacagaattgttaaattag

SEQ ID NO: 34583 - DNA, 198 bp, Glycine max
  Peptide Sequence Number=SeqID_126268
atgacattaggtgctgaattcaatgtggaaagcttaacatgtggagattggaacacatcatcgaaagtatcccaaaaggtatgtgttcggttctatgcaagaaagaaaaggactacctatataagcatgaagtttagccgcttcaagaagctgggacttggctttgatatgcttatgaaggatagggacacaggctag

SEQ ID NO: 34584 - DNA, 127 bp, Glycine max
  Peptide Sequence Number=SeqID_126269
gcttgtttgcccctgcttgacaaaggggcgtctccgcgtgccaacagactcacaggtcacgatagtgaaaggtggggcagttgacaaaagcggggcttttgctcctacctatcctcaatcgcgatga

SEQ ID NO: 34585 - DNA, 102 bp, Glycine max
  Peptide Sequence Number=SeqID_126270
atgaccgatcgagaggaagttgatgtgaacctgagtaggagcggatcgtttgatacaggctacgaaggtttggatgacgccacttccggtgaaggaagataa

SEQ ID NO: 34586 - DNA, 261 bp, Glycine max
  Peptide Sequence Number=SeqID_126271
atggagaagagacgcgacgttgtccagcgtgatcgacacctcccccacaggaagatggaaactagaagtctcccgttgccacctctccacaaaggaggatataagtcctcgatcgttgaccatacactgcccgcaacatggtcagcacactctgtaagcactgatgggtccctgggtccaccaggaaatcccacaggctcgttgatgtgccatcattttcttctattttctaaaccctttttgcaccattttaattattga

SEQ ID NO: 34587 - DNA, 543 bp, Glycine max
  Peptide Sequence Number=SeqID_126272
atgacattggccatcccagagcttttcttgaggccttatcaggttagatgggatgccaccgtgttcggggtcgttaatccagatttccccttgtatataaagcacgaagacatctctgaaatcgcacacggtggtcaatgtctcagcatatcagtgttacagttgtggattctgcatctcactgaaacatgtatgcgagcggggaattctgatatctatggattcctcgagcctcagtccattcagaggtctgggcaatcgcaatttgaatctgaaagttacataaagagttggatgcagagttcacaatgcgatgtgtatcttggagcctacctaaatgggttccactgcagcggacactggcatatggtggtcatcctacccaaggaacacttagctgtctgtgctatcaagggtcttgatgatgctccacagcctaaatcaaaggctcctgctaggtggattgtcgtcaagtgtaatagacgaagaaagtacttgagtgcgactactatgagatacactggatgtccaccatcattttag

SEQ ID NO: 34588 - DNA, 153 bp, Glycine max
  Peptide Sequence Number=SeqID_126273
atgtttgcttgcagtcctttcgctaagcgcaagcctcgtgctaagcgcatctctgttcatgcgctaagtcgcgagtctcaagcgcttagcgcccaaaccttgcatttgaggctgatttggttcgctaagctggctgaggttgagctaagttaa

SEQ ID NO: 34589 - DNA, 731 bp, Glycine max
  Peptide Sequence Number=SeqID_126274
cagaattgcaactgtggtcaaggattcagcaagaggtttggaccgcataaaacagactcggaacggcatagcgggcctaccacagaagtacctagaagacaaggcgaggggtatggccaatcaaggagattgggtcccgtttatggatgtgttagctttgctaatttttggggtcgtcctctttccaaacgtggatggtttggtagacctagcagcaatcgacgctttccttgcctaccaccatagcaaggaaagtccagtggtagctgtcttggcagatctatttgacacatttgaccgaaggggagcaccgacggaagaaagcatgtctcctttccttgtgagggatttcggcgcacaaaattccaagactatacaaagaatccataaaggagttgccaaggagaagttcaagttggccgctacacacgttcggaaggagtgtgccgggttacgggaagagaatgcaattactgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaaggtccaaaagaagcttgtctcagcgtttatgcgagacggagaccaacatgctagctatcatcgccaagtaccaagaagagttag

SEQ ID NO: 34590 - DNA, 192 bp, Glycine max
  Peptide Sequence Number=SeqID_126275
atgtcatttcctgctttcaggtacttggggacgggcatgagtggaggctatgcccatgatccacagatcgccgtcccatgtccagctccggacaaggttagctcgcctgggcgagcaccccctggcacgaaatggtttaaaaagagagggggagtgcagttttcacccaaggaacttctccccctaacttaa

SEQ ID NO: 34591 - DNA, 374 bp, Glycine max
  Peptide Sequence Number=SeqID_126276
caccgccatacctcttgagcttgaggttattcctcaagtaaaggagttgttggatgagggtttggttcacaagagcttaaatccttgtgctttgttggtgcctaaaataggtattattaggcaccaaatccctatgataggtggtatgatgaatgtgttgagtggtgcaacactcttttgtaaaatcactcatgcacccaacatcttcatgatttgtgtacatagggactcattaggtaggaataatcaacatgaaaataaagaaaaaggtatgttttattccaatactttccctaactttgtaaatagtgataaagggcttcccatggaccttaagagaataaaggtcattcctgagtggcctactccaccaa

SEQ ID NO: 34592 - DNA, 549 bp, Glycine max
  Peptide Sequence Number=SeqID_126277
atggatgttaaacgtctcaaagtgatcaaccaagaagttgacgatcatcatcatcccagatattatcggacttgttcatatttggatggtaaaagggacttcgatagtctttggataggaagggtgtgggcgaccatatgttgtctccgcgtgtcatcagacttgttgtctctagatgacgaaggtgcagataaccatgaggtatctctgcatgctatcggaccctcgagtcacaatagcagagttgtgtgtacagataaccataaggtatctccatatgctatcggaccctcgagtgaccatagcagaattgtgtgtacggataaccataaggtatctccgtatgatatcagaccctcgagtcacgatagcagatttgtgtgtatgaataaccataaggtatctccgtatgctaccagaccctcgagtcacgatagcaaaggtgagtcttttttgcggtctcggctggaagacgccgacatctctgggaagggtgcagatgaccacattggtatttgcgtgtcaacgggctcgcttgcctctagttga

SEQ ID NO: 34593 - DNA, 552 bp, Glycine max
  Peptide Sequence Number=SeqID_126278
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgaaagaacaaaggcatcatggaaactgttgactttaaagacaaacccacatttgggcattgttccaatgactctaacttgttaaacattgtactcgagttatacatcgtgttacttccaggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 34594 - DNA, 447 bp, Glycine max
  Peptide Sequence Number=SeqID_126279
atgtctcttgccactctatttggtaaattgcaggaacacgagatggaacttcaacgcctcaatctgaatgaagaaaatgacaaaaagaagagaagcatagcccttaaagcctcatcttcaatacaagaagaaaacgaagaagaagatacagatgatgaagaagatttttccttctttgttaagaaatttcagaaatacatcaagaaaagaagaattgacaggcgtcagaatttcaataatggaagaaaatcacaagatgattctcaagtccttaggtgttacgaatgcaaccaaattggtcacatcaaggccaactgtccatcaaatgaagaatggctggagaaaagtgaaagaaaagatttgacgaaagaagaactaagaaagcatacattgcatgggatgataatgattcatccgatggttcaaaaaaggagattaatcttctaa

SEQ ID NO: 34595 - DNA, 348 bp, Glycine max
  Peptide Sequence Number=SeqID_126280
atggtgctggtagcggctattgcagccacattggcctccattatctcctttatgctcatcatggaaagctcgattgtcgctatcttagccaatctatatgacacattcgaccgaagatgtatggttggtttcacacctttttcgccaagaggtgagaaacgtttgcccgctagaaggccaccactcatgcatcaagaaaaaggaggcaaactgggaccaattcttagcaagcaaaaaaggagcgtctgtcaattggttcccccgatggaaagaatgaagaaccgggatttttatttcatgtggggaatttccaaatgttcccttgatggggatgaggggtttcattaa

SEQ ID NO: 34596 - DNA, 409 bp, Glycine max
  Peptide Sequence Number=SeqID_126281
atgagagaaaatgaaagaaagcctcaagaggctaacattaaccccccatacttccatgggaaggacaatgtagaggcttacttagattgggaaataaggatagagcaaaaacttaaaagaaagtctactttaaaatcttatggatctcattcttatccaaagaaagaccaaggtctaggcatcttatgggcagcaccttctaagcccaaagatgataagggaaagacaatagaaaaacaaccccctaaggctagtatgcaagagaaaactagctttataaagtgctttaaatgtcttagaagaggacacattacttctcaatgccccaccacaaaaaccatgattattaggggtcaggaaatttatagtagccaagataaggctactacttcaccttcctctagtgaaa

SEQ ID NO: 34597 - DNA, 147 bp, Glycine max
  Peptide Sequence Number=SeqID_126282
atggctcctcttatcaacatggcttctaaaatttctaaaattgggaaaaagcttctgatttttcatgcaacccaattaccatcttcttatcaaaaagtgtcctcaatccgttatagcctaagtgaccaaagcggcaatgccaaatga

SEQ ID NO: 34598 - DNA, 354 bp, Glycine max
  misc_feature (317)..(317): n is a, c, g, or t
  Peptide Sequence Number=SeqID_126283
atggataacgaagagggagtgcaagaacagatgaaggccgacctatcggccttaaaagattggatggcttctatcatggaggccatgctaaagattcaaaaaactatagaagataatgctacggcggccgcttccaatacagctagggaagcagaaccgctgctacagcccgcaataaacttgggccgagatagaaacgcgacgggtatcaatcggaggtatagtcctcaagcttacccttatggtttgcctccatactttactccccgtaccgctccagacgatttgagccaagcccctaccttcgagggggcagntccctcctcatgccgattatcctctgcaggaagatga

SEQ ID NO: 34599 - DNA, 220 bp, Glycine max
  Peptide Sequence Number=SeqID_126284
tacgctgccatttatcttccaagaagcaaaggaatccattgatgaagaagatcctaggcctacaagctccaatggagcttgcatcatgtggtatcagagcacaagagcttcaagtgttgagggaaggagcccagagtatgaagaacctcgggatttgaggtcaaatcctttccaaggtggagggaatgatgcaatcctatcccgcaagggcattgggtag

SEQ ID NO: 34600 - DNA, 634 bp, Glycine max
  Peptide Sequence Number=SeqID_126285
atgtctctaaaattgcctgtttattctgatcttgtcaaagccttctactcaaacttagaaatccaagaaggcaccctaatgcatgaggtttatgggattaagatagtcattgaccagtccctattctatgatttaacccaattgcctagtgaaggtgtaccatttgaaggtgcattgattgacgattggaaatttgatttttctgtgcatgatgcccaccggttggtttgcaccaaccaagtggatatgaccggaaggcttcttgccagttcattggcttttgaaagccgcatccttcattacctaattgttcgcatcttgcttccgagatcttcaaaccttgcacaggtttctgaagaagatctcattgttatgtgggcctttcataaaggtctacaaattgattgggcacatcttgttagatatcgcatgcacaaggcattgcgattgaatgctccattgccttatcctcatcttgttacccttttccttcaacacttcaacatccctcttgattatgaaccctatgttccaatcaagagatccttccttacaggcgcttcagtcatagcatcctttggttatccaacccagcatgatggctcttgggtgaagaagggtgctcgacatgttg

SEQ ID NO: 34601 - DNA, 201 bp, Glycine max
  Peptide Sequence Number=SeqID_126286
gaacatgaaatggagttgcaaagactaaatcaacatgaagaaaatgataagaagaagaagggaattgctcttaaagcctcatcttcaatccaagaagaactttgtctctttgtcaaaagattcaacaaatttcttaggatgagagaaactcaaagaacacaaaacttcaaacctaaaagaaggattgaagaatcatcttaa

SEQ ID NO: 34602 - DNA, 318 bp, Glycine max
  Peptide Sequence Number=SeqID_126287
atgattataaaatcctctaatatcttcgccctcatttgtattcctacttccccatcaggctctgaaaatagcaagcagtatccaccattgcaaagacacgcctttgtaaagtggtggtcacaattcgatacctcaaaggctgctccagaacaagtcaagaactggtttcagagcaaccctaagtttctcaaacctgctgatccagagacatctttgtttctgaatcagaagtctcaacttgcagcattcatggcaagctcaaaatctaaagaaagtcttgctcaaaatcttaaggaggttctccaattacttcaatag

SEQ ID NO: 34603 - DNA, 1061 bp, Glycine max
  Peptide Sequence Number=SeqID_126288
ccgccggtgctgaggttggcgttgttgcgcaggaagatcagggtgcccggggcgggtaccgaatcggcgtcgaagccctgctttttcagcgtggccagcgcgatgtcgtcgaagcggatcttggtgagcgacgtggcgtggccgtcgccgcgcagcgggtcggcgttgacctggtcgaccagttggcggatggtgtgcacgccgtcgccggtcacctgcggcggatcgcggcgcgaggccgcgaccagcgcgccgcccaccaccagcaggcggaagtcgtggccggggatgtagcgctcgacgatgacttcggagctgatctcctcggccacttcgaaagcctggatcacgcgctcgcgcgtctcgatgttgaccgccacgccgcggccctggctgccgtcgcgcggcttgaccaccaccgggccgcccagctcctgggccgcggcccaggcgtcttcggccgtggtgaccgagcggcccagcggcacgggcacgccggccgcgtccagcagcatcttggtcaggtccttgtcctgcgcgatcgattcggagatggcgctggtcaggtcggtttcggcggcctggatgcggcgctgcttgctgccccagccgaactgcaccatgctgccttgcgtcaggcggcggtagggaatgttgcgggcggtggcggcgttgacgatggagccggtgctggggcccaggcgcacgtcctcgtccagctcgcgcaggcgcttgagggcgtcggccaggtcgaacggcgcatcgtccagcgccgcctgcaccagctgctgcgccaggtccatggccaggcggccgacttcttcctcgctgtattccaccaccacctggaacacgccgggctcgatgggcgacgatctgcagcacgtgcgcgatcgagacggcgccctggtggccctcgggacgcagcaggccggttgtcgatggagcattcggcgtcggcgcacgacacgatggcttcgatcgccgtgttcttgctccacaggttggggccgcgcagcgctcggatacgggaaacttccatggcaggtattcctgtctag

SEQ ID NO: 34604 - DNA, 226 bp, Glycine max
  Peptide Sequence Number=SeqID_126289
taaagcaagttccaaagaatcaggagtcaaaaagcttcaagaatcaagtttcaaagaatcaagattcaagaataatcaagtttcaaagaatcaagattcaagaataatcaagtttcaagattcaatcaagtttcaagaatcaagattcaagaataatcaagatcaagattcaagactcaagattcaagaatcaagagaagactcaatcaagataagtactaaaaag

SEQ ID NO: 34605 - DNA, 306 bp, Glycine max
  Peptide Sequence Number=SeqID_126290
gtcaggacgacaaaaaggtgcagaagacgatgttagtctcggcgctccaacgtgctcgtttgcccctggtgcggttaaccatatggtaaccccgcatgtcactttagctcacgggtcaagacggaaaaaggtgccgaggacgatgctaatctccgcgcgcgaacgggctcgtttgaccctggttgaccaaaggctcgtttgcccctggttgaccaaaggtgtggataaccataagttgaccaaaggtgcgggtaaccataaggtaaccccgcatgtcattgacttcacgggtcaggacgacaaaag

SEQ ID NO: 34606 - DNA, 261 bp, Glycine max
  Peptide Sequence Number=SeqID_126291
atgtggtgtaaactttcacgcttcattgtctttcttttgtcctttttttttgttttttgttttttgaagaggaaaatgcaaggatcatgcatgagtggacataacatgcgaacgatgaagagatgcatgatgcgatcaaggaacaagccagacgacaatgcatcaccaagagaggaaactctagatgaggcttcactggtatcaagcgagttggagacccggcatgaccacaaatcagcttcactccgatggctcacatag

SEQ ID NO: 34607 - DNA, 531 bp, Glycine max
  Peptide Sequence Number=SeqID_126292
atgtatgaatatccaaggagaacccgcgcacgtaagcattcctttcaaaattcgtgtggatattcatgctttgttggaaaaagggaaatggctccgaagaaactcgccacaggagaagggtccagtgccgccccagagtttgatagtcatcgtttccgtagtgccgaacaccagcagcgcttcgaggccatcaggggatggtcattccacaaggagaggcgtgtccagctcagggaggatgagtatacagactttcaggaggagatagctcacagacattggacatcgctggtgactcccatggccaagtttgaccctgagatagtcctagagttctatgctaatgcttggcccacagaggagggagttcgggacatgcgctcgtgggtgaggggtcagtggattccctttgacgcagatgccctcagccagttcctgggtgacctgctagttttggaggaagggcagcagtgtgggttcagccagaggaggaacagggctaacgggttcgatgaggaagccattgcctag

SEQ ID NO: 34608 - DNA, 180 bp, Glycine max
  Peptide Sequence Number=SeqID_126293
atggagggagataatagaatcacacgaagacaatacaaatggaggcttcaatcccttcttcttctctttaacgtttgggaaccctatcagagcaatcagaggaaaaaattgagaaatctcaggaaatttctagagatgtcgctatccctgtcggaagacactgagattatgaaatggtga

SEQ ID NO: 34609 - DNA, 318 bp, Glycine max
  Peptide Sequence Number=SeqID_126294
atggctgacgttccaagaggagggcccaaacgtaaagacaaatcctcttgcaagaggtttatattgaaggcgttgcgcgaggcggacatcatttgctttgatgggggtgagggaaacacctgcttggtacacccgggggcagcacacgacgtagaggcatgcccagtggcagaggatttgttgcaatggataatggatcaaggtcggtttgaggtttgtggcacgagcaaggaggagcaatatgtgtgcatgcaatcggctgacaaaagcccgagcaagcccaagcctgatggaagcttgcttatgaagtttcaatag

SEQ ID NO: 34610 - DNA, 627 bp, Glycine max
  Peptide Sequence Number=SeqID_126295
atgaccggccctctcgatgagtcgatctcttgctttctcataaaggtggacccttgggtactagtacctatcacctttagaggactatatgtcctcgcctgtagagggttgcacgccctcgcctttagagggctacgcatcctcgttttcagtgtgctccatatccacaccttaagagaatataaggtcctttgcccttatatgcttcaccgagacttgcgctcccggaatcgcacccacaaagacacccagtggacccggagaagtccaacagggccctggggtttccagctctggttacgggcctctgtagtcctacagggtgcccgttccccccggcaaggtcacggatcgcgcctgcaagacacccagtggacccgaagaagtccaacagggtcttggagttatcaagctctaattacgggtctctgtcagttctacggagtacctttcacctccagcaagggcatcaggccccctactaatcgagctttcatcaagaagtactgcgtctccaggcaggcgcagggcgaaacaccacagcagcccggggatggccagcaacgggcaacagacgcaccgccatcacctctagagttcacctcagctcatccacaaagaggctag

SEQ ID NO: 34611 - DNA, 204 bp, Glycine max
  Peptide Sequence Number=SeqID_126296
atgactaaggcaagtatgcaagcggggaatgcctttatgtatggattcctcgagccacaattcatggaaaaatctggacaatcgcaatttgaatcagaagattatattaagaaatggatgcagaattcacagagagatgtgtacctaggagcctacttgaatgatgttttaatgatcaaagactattggaaccaaagagaatga

SEQ ID NO: 34612 - DNA, 411 bp, Glycine max
  Peptide Sequence Number=SeqID_126297
atgattcatgtcgttgcaccgactccaaacacacttcctacagctcaagaccaaccaaatcctaactttgtaagggagtcaattcccactacccctattagagatgcttcaccttcaacactagatgattattttacacctgagtacccaccagatccaaattgtgaacatattgttgatcagaggcctttcattcgtgcatataaaggagagtttcaaccaacatatgggtattctaatatcatatcaaatatcattaggacaaaatttgatgaaccagctgcaagttggttgaaggtgtcagttgaccttcgcgataggtggtttggagagtttaagagaataggtggcacctacaagaagagcgagccattagagccatttttgagaccaaaggttcacgcattttga

SEQ ID NO: 34613 - DNA, 966 bp, Glycine max
  Peptide Sequence Number=SeqID_126298
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagcaagaagaaaaataatgaaagaaatgaaaagagaaaaacatgcctactatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacctagattgggaaataagggtagagcaacaacttaaaaagaagtctacttcaaaatattatggctctcactcttatccaaagaaagaccaaggtcaagacatcttaggggtgacaccttctaagcccaaagatgataaggggaagacaatagaaaagcaagcccctaaggctagggccaagatttatagtagccaagatgaggctactacttcacctttctctagtgaaagtgaagaagcaaaaggggaagaatctaaagaagaaatctacccccaagaagatggaaaaccattagtggttaaagagaagtgtaaggaggtaagtgtctcctccaagaggttagctaagaaggaaactcattttacaataaagacaaacattaaagaaactttccctcttagacaacctccacattttctcttttctaaaaagacacttgctagcattgccacacctcttgggcttgagtttattcctcaagtaaagaagttgttggatgagggtttgtttcgcaagagcttaaatccttgtcctttgttggtgcccaaaataggtattacttag

SEQ ID NO: 34614 - DNA, 540 bp, Glycine max
  Peptide Sequence Number=SeqID_126299
atgtcccatctttttgaatttggggtgaccgagcctctcaatgaatcaatctcttgctttctcaaaagggtggacccttgggtactagtaccctcacctttagaggactacacatcctcgccattagaagactacacgtcctcaccatcagagggctgcacgccctcgccttcagagggctacacgtcctcaccttcagagggctacacgtcctcaccttcagagggctacatgcatgccatcagaggactacgcgtcctcaccttcagagggctatatcccctcgccttcagagggctacacgccttcaccttcagaggactacacgtcctcacctttagaggactacacgtcctcgccatcagaggactacacgtccttgccttcagagggctacacgctctcatcttcagaggactacatgtccttacctttagagggttgcacgtcctcaccttcagagcgctacacaccctctcctttagtgggctgcacgccttcgcttttagagggttggacgccctcgccttcaaagggtga

SEQ ID NO: 34615 - DNA, 708 bp, Glycine max
  Peptide Sequence Number=SeqID_126300
atggggtggtcggaataccgaggaagcactggaggagaaagcgaaggctttggcagcaaagaaagcccggtcgttgctattttggccgatgcttatgacacatttgaccaaagatgcaagaaaagtggcacaaggattgtctgttgtacacccgttctttatgggtggctggcctggcacctcttttgtcatgaaagtagacccatttatcccctgcaaggtcaccacatgtgcaccgagaaagggaagacaaattgggagcaactcatggctagtatggtaggggcatccattaattggttcccccgatggaaggaaggaagagtcggggttttgtcctcatgtgaagggttctcaaacgtccctttgatgggaacaaggggttgtatcaattataattccatccttgccataagacaacttggctaccccatgagaggagcaccgtcggaagaaagtatcacgcccttcattgcatggggtttcagtgaccccaatgcaagaatatttcaaagggtccaaaaggcatggagcatgatgcaaagaaaggataaggagcttaggggaagtagtaatgggatcatcgacatctatcacaagtggctgaaggctcggacgcaagagctagattggctcccgaagctaaagacctcaagagaggaaaaggttgaaacctcagaggagagtgaggaggtgcaagccttatag

SEQ ID NO: 34616 - DNA, 271 bp, Glycine max
  Peptide Sequence Number=SeqID_126301
atgttggtggcgactccgcgcgtattcctttcgtggaacacgcatcccgcgagtctcgcgtcaccctcccgccgaagggtaggttgcgacacccgcacgaagaaaacaggggagatgacgattgaggctgcaaaggaaatcgctgagaagattgattcctttgaggagcaggccacacagggatccttcgtcccccatggacgtcaggatgttctcgccgctactattggacgtccagagcaccctggacgtgtttgtgctgttggagccg

SEQ ID NO: 34617 - DNA, 300 bp, Glycine max
  Peptide Sequence Number=SeqID_126302
atgaagggtggccaagcctatgatgccatgatgcagaggattctgttcgaatcgtgtggacggagggtgaggtggcgggccagagatagagtccatccacacatgagcctttatgggttgtgtgacccgtctgcaagtccttcacataaaaggagtttggcaggaaaacaacagcagatgagtcaggaccagtgtacggatgatgaagcgccagattatcgagatcattggttacgtgatgtgtcgctccactgtcaaacagaaaatcatgttgcgatgggccggcagttgcagtattga

SEQ ID NO: 34618 - DNA, 114 bp, Glycine max
  Peptide Sequence Number=SeqID_126303
atggcgtctatcctgacttatattccttcacctggaagtggcatctacccagacttatcttccttcaccggaagtggcgtctacccagacttggtgtcttcagactttgtgtaa

SEQ ID NO: 34619 - DNA, 389 bp, Glycine max
  Peptide Sequence Number=SeqID_126304
ccagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatgacccgaacctgggtgatctatccatgaccaggatgaagcttgggtga

SEQ ID NO: 34620 - DNA, 223 bp, Glycine max
  Peptide Sequence Number=SeqID_126305
aatgaccaaacttggtctctgcgtgccatcggacacgactgtgtctgaatggcaaaggggttcggataaccgtaaggtatctccgcgtatcatgggtatctccgcgtatcatgggtgcagaatgaccaaacttggtctctgcttgtcatcgggcccgccgcctctggatgacaaaaggggtgcgaataaccataaggtatctccgcgggctaccggctcttga

SEQ ID NO: 34621 - DNA, 234 bp, Glycine max
  Peptide Sequence Number=SeqID_126306
atgtcatcgggcccgccgcctctggatgacaaaggtgcagatgaccataatttgtctctgcatgtcaacgggctcgcttgcctctggttgacaaaaggtgttttgatgataacaatgatgacaacaaaagatgatgacaaaggtgatgaacaaaaagctcaaagatcaaagaacatctcaagtgaatcaagaacaagtcaagagttcaagaaaagaatcaagaagaaagcctag

SEQ ID NO: 34622 - DNA, 588 bp, Glycine max
  Peptide Sequence Number=SeqID_126307
ctggccttgaaccagaaatctgtacctgtcgcaagggtctgtggtttgtgctcctctgctgaccaccatacagacctttgcccttccatgcagcaacctggagcaattgagcagtccgaagcttatgctgccaacatttacaataaacctcctcaacctcagcagcaaaatcaaccacaacagaacaattatgacctctccaacaacagatacaaccctggatggaggaatcaccctaatcttagatggtctagccctcagcaacaacaacaggagccttctccttccttccaaaatgttgttggcccaagcagaccatacattcctccaccaatccaacaacagcaacagccccagaaacagccaacagttgaggctcctccacaaccttccctcgaagaacttgtgaggcaaatgaccatgcagaacatgcagtttcaacaagaaaccagagcctccattcagagcttaaccaatcagatgggacaattggctacacaattaaatcaacaacagtcccagaattctgacaagctgccttctcaatctgtccaaaatcccaaaaatgtcaaagacctcaacccgtag

SEQ ID NO: 34623 - DNA, 288 bp, Glycine max
  Peptide Sequence Number=SeqID_126308
atgtctcagcggttatgcgagacagagaccaacatgttagctatcatcagcaagaaaaacaccataactaaacgcgccccaaggcatacctatcacactagatccaaatctagaacgatgggtgatcaagaggagacacaggaacagatgaaagccaacatgttggctttgaaagaacaaatggcttccatgaggaaaacgtggccaccgctgccgctgttagttcggctgccgaagcagacccaactctctcagctaccgcgcaccatcctcccccaaacgcggtag

SEQ ID NO: 34624 - DNA, 327 bp, Glycine max
  Peptide Sequence Number=SeqID_126309
atgcgccgttcttggattttgcatgaactgtgcgagtttgttagtgctgagggcgatgtctggacgtatgaaaagagatgcatctgcagtggaattgacaaaaccaagggagagcaggaatacgcgaagctacgtataccaggcgcggggtgcttgcttcagcccatagagtgcctttttgaggcgacaaacatgatcaggaaagtttttgttgacaaaaccaggtggttgtatcatgaagacttcctccttaagtgtcccttgaagaaatgcattgttgacatcaagctgacgtatgggccacccttgacgaactacaagagttag

SEQ ID NO: 34625 - DNA, 843 bp, Glycine max
  Peptide Sequence Number=SeqID_126310
atgggtgaattagacgaggtgcaagcacggataaaagtcgacttagaggccatgaaagagaaaatagccacaatgatggaggccatgatgagcatgaagaagataatggaggtgaatgcggctgcaatcaccgctaccagtgtcgtcgctaaggtggacccgactccctcatctagcctcaatcaaataaatcatccaacctcggatatgagcaagcatgccttcctgccatatggcttgccccctaactttgcaccacctagtgtaatgcgccctcccgatgagaatgtcaataactccactcttgtactcatcaagaaccaacaacctctatccaatcatgcatatgtccctcaactcatgggggagacatgtgaaataccccaccacaatctagccgacttcgagcctcgcctcggatatgccgttgaagggcaagcagttggtggtgtgcccctgccaaacactttggagggccctcagttcctcccacaaccacaacccttgcattttgtggcaggaagaatccctcttgctatggcgaagaagggaaagttggatcaaatagaggaaaggcttagagccgttgaaagaggtggaagttatgctttcgctaacatggcggaattgtgcttagtgcctgacatcgccatccctccgaagtccaaggtgtcacaacatgcccttttgcgggcatgcgaggcgaggctcacgggtgcgctttccaaaggaggaaagatgcgtggagtcgccaccaacgtctatttgtgggaaacgtcagaaaaaccgaaggaaaccggtcaaaacgaaaattctaagttcgggagttgtatttacgtttga

SEQ ID NO: 34626 - DNA, 310 bp, Glycine max
  Peptide Sequence Number=SeqID_126311
atggttattcccaagttcaaggtgccggactttgacaagtacaaggggactacttgccccaagaaccatctaaagatgtattgtcggaagatgggggcatacgcaaaagatgagatcaaagtgggtctgaaaataggcaaatttaatcatcctgcttggacgaatgagaaaactggggaaaatgaagagggtgaggatgagggagaaacccatgctgtgactgccattcctatacggccaagtttcccaccaacccaacaatgtcattactcaacccttctccttacctaccacccagttatccacaacg

SEQ ID NO: 34627 - DNA, 264 bp, Glycine max
  Peptide Sequence Number=SeqID_126312
atgggtgcaaagccattggtctgtttgctcaaacgacctgtgctcctgaatttggacttccaagaccgttcaatcagagattactcgtcttgcgcgttggaacaacccttcccttgtgttcaagaatcccctacaacaagagacccacgatctcttaatcccttttcagaaataggaagaagagaagaagagatctctcttaaaagagatagattgtacaatgaagatcaatcaaaattccttattgaatatgcaagtggttga

SEQ ID NO: 34628 - DNA, 107 bp, Glycine max
  Peptide Sequence Number=SeqID_126313
aagcaaagcttcatggtgaatcaaaggtgattcaaaggtgttttgatgataacagtgatgatgacaaaaagctcaaagatcaatcaaagaacaactcaactgaatga

SEQ ID NO: 34629 - DNA, 390 bp, Glycine max
  Peptide Sequence Number=SeqID_126314
atgactccgagaaagcttcctgcaaagaaatccaggaaggacaaagcggctgaagggaccagtgccgctcctaagtatgacaaccatcgcttctggagtgctgagcaccagcaacgtttcgaggccatcaaaggatggtcattccaccgagagaggcgcgtccagcttagggacgatgaacatagtcctagaattttatgccaatgcttggcctacacaggagggcgtgcgggatatgtgatcttgggtgaggggtcagtggatccctttcgatgcggatgccctcagccagttcctgggataccctttagtgctggaggagggccaggagtgcgagtatggccagaggaggaccaggccgatgggtttgatgaggaggccatcgcctag

SEQ ID NO: 34630 - DNA, 294 bp, Glycine max
  Peptide Sequence Number=SeqID_126315
atttatcaaggtaatccttgtggcgtctaccctgacttatcttccttcaccataagtggcgtctaccttgacttatcttccttcaccggaagtagcgtctacccagacttatcttccttcactggaagtggcgtctacccggacttatcttccatcaccggaagtggcgtcatccaaaacctccgtagcctgtatcaaacgtttcgctcctactcaggttcgcatcaaatggtcataacttttaactcggatgtccaatttaggcgcataatatatcgagacgctcgaaattga

SEQ ID NO: 34631 - DNA, 423 bp, Glycine max
  Peptide Sequence Number=SeqID_126316
atgacattgctacttagcaacattctgcccagcgaccgcaacgccaatctccccctgcaaaagtatcagttgggatcgcacccacaagacacccagtggacccggaaaagtccaacagggccctggggtttccagctctggttacgggcctctatcagtcctatagggtgcccgtaccccccccggcaaggtcacgtcatcatagggattgcgcctgcaagacacccagtggacccgaagaagtccaacagggtcttggagttgtcaagctctaattacgggtctctgtcagttctacagagtgtctgtcgcccccagcaaagtcatcagaccccccctaccaatcgagctttcatcaagaagtattgcgcccccaggcaggcgcagggcgagacaccacagcagcattgggatggacggtag

SEQ ID NO: 34632 - DNA, 312 bp, Glycine max
  Peptide Sequence Number=SeqID_126317
atgaggcaggtcatggcatccttcagccagcttcagtcacagatgcaatctcagggaactcctgagcctctctggttggtcctggtgagtgtggacgaggttaaagatgcagatgctccagttcctgtacccactgatgaggtttccttagtggggcagacacttcacaccttccctgcttggccgacacatctggtcaagtctttatcacaccaggtagttgtgtctccgccaaaaccacctccgaagcccgatggtccgcttaatctgatgacattgaccatcccagagcttttcttaaggccttatcag

SEQ ID NO: 34633 - DNA, 369 bp, Glycine max
  Peptide Sequence Number=SeqID_126318
atgagacgtgatgaggttgttcttctagagccaattgtgccagttatacatgagagtgctgaagcaggtgagtcacagttgaggttggaggctgctactcctgagaggacatcacagaccccagaaggtccactctcactagggatggacctatcttttgctcagcaggtaacagatcctcctacaccagtacaggagagacaggtggatcctcctacacctatcatggagatgccagaagaccctactacactagtcctacgactatcatccactcctccagctaccccagttttacatctgacagatgaggaggatatgcaggaccaggacacacagggcacgcaggaccagccacaagaattctaa

SEQ ID NO: 34634 - DNA, 234 bp, Glycine max
  Peptide Sequence Number=SeqID_126319
atggataagccaaagtgttcatctcctagggagaaaacgagtgaagtcgtcaccaacgcttacttaaggaaaatgttagaaaaaccaaaaagagtggctaagcccagcacaagagtgcttagcgagtcaaaggaatctggaagggcatcttctatgcttagtgcgagattggcgctaagttcaaattcacttactcgtgctaagcgtgaaaatggcgctaagcgcgacgtctag

SEQ ID NO: 34635 - DNA, 243 bp, Glycine max
  Peptide Sequence Number=SeqID_126320
atgataacaaaagatgatgacaaaggtgatgacaaaaagctcaaagatcaatcaaagaacaactcaagtgatcaagttagaatcaagaacaattcaagagttcaagatagaatcaagagaagaattcaagactcaagaggaaagttaagagtcaagaatcaagattcaaggttcaagatctcaagaatcaagagaaggcttaatcaagataagtatgaaaagtttttctcaaaaattgagtag

SEQ ID NO: 34636 - DNA, 257 bp, Glycine max
  Peptide Sequence Number=SeqID_126321
gaaagaagaagacaaacacaagatttatactggttcggcgacaacccgtgcctacgtccagtccccaagcaaccaaccggttcttgagatttctttcaaccttgtaaaatactttacaagccaaagatccacaagggattataacaacccccaagtagatgtaccctctacttgtaccacaaaggatgtaccctctgatgtgttgggacaaagaattctcaggcggggaagggaagaatcaaaagaattctcaggcg

SEQ ID NO: 34637 - DNA, 156 bp, Glycine max
  Peptide Sequence Number=SeqID_126322
atggaccctaaaagaataaaggtcattcctgagtggcctactccaccaagtgttgagggaaggagcccaaggtatgaagaacctcgtgatttgaagtcaaatcctttccaaggtggagggaatgatgcaatcctaccccacaagggcattgggtag

SEQ ID NO: 34638 - DNA, 413 bp, Glycine max
  Peptide Sequence Number=SeqID_126323
gggaggaagacgtcttggtaagttgcccttcctctatgccatatgtggaagccgcggaggagtcattggaaacggccttccaatcttttgaggtagtgagcattgcctctatagattccctctctgggcagccttgcctatccgatacggtaatgatggtggcccgagtgatgttggggtacggctacgagcccggaatgggtttgggcaggaacaacggcagcagaaccagcctggtaagcaccagaggaaaccgtgggaagtttgggttaggctataaatccacgcaagcggacataaggaaaagtctaagacacgaaggccaagtcaccgcgatatgcgaggatgactccccgaggaggtcggatttggtatggctatgtcctcctagtttccaactaggaaattggtga

SEQ ID NO: 34639 - DNA, 126 bp, Glycine max
  Peptide Sequence Number=SeqID_126324
atggcctttcattggaaggaattggaaaggaggattgatgtcatacctgggggtgaagaatttgagtcaagaagcaaggggtcaaccaccttaagagctattggactaagaagcactccaaattga

SEQ ID NO: 34640 - DNA, 224 bp, Glycine max
  Peptide Sequence Number=SeqID_126325
gtgaaacaaaagatattgagctggtagaggaggaagaggcacgaattggtgctaattcttctagtgcaacctgtaataaatatgagaattataaggaggaaccacgaaatgcagcacagaagcataaagcaaagagggtggagagtgttaatgttgatgtagaagcctttggagatcactggaaagttcagattgctaaatgcattctaaagctgaagcactag

SEQ ID NO: 34641 - DNA, 171 bp, Glycine max
  Peptide Sequence Number=SeqID_126326
atgtcggccttcaccttctcttgcacctcctctgctttacccattactctagctctagcacaggttcgattttcaacatggtccatgatatcttgtcaaggcggaactggaagtaacagggacatcgacattcctaaaatgtgtttggcagtaaacgaagcagcgatgtaa

SEQ ID NO: 34642 - DNA, 339 bp, Glycine max
  Peptide Sequence Number=SeqID_126327
atggagattattatttatgttccaccaataacttgtgatttatgccgaagggagcattaccaggataattgttatatgtactccacaagtaactttgggtggagagaagagttaactccctataatcagtatgaagatgaaagagtccccaatcttgacattgtgtttgcagaattcatggcatatcatgctagttccaaagatacaattggatctattcaatgggcatttaaaagtgtagaaattcaggttggtaagctggtagaagaagtgactcaagctatgagcagaagagaagaagagattgtagaggttgacactcagaggagggccctgtga

SEQ ID NO: 34643 - DNA, 198 bp, Glycine max
  Peptide Sequence Number=SeqID_126328
atgtttgcttacagtcctttcgctaagcgcaagccttgcgctaagcacatctttggtcatgcgctaagccgagagtttctagcacttagtgctcaacccttgcatctcaggctgatttggtccgctaagctagccaaggctgagctaagcccatttcaattcgacctgaattgggctaagcgacggcctgctcgctaa

SEQ ID NO: 34644 - DNA, 156 bp, Glycine max
  Peptide Sequence Number=SeqID_126329
atgggctcaaaaatctaccctgaggttcatgagaaccctaaggccttctttatcaactctagcccaatcctcttggagcctcttgctcatggctctggggatgatacctctagaaaccatcaagagagatatgactaccttgggggttatcactag

SEQ ID NO: 34645 - DNA, 509 bp, Glycine max
  Peptide Sequence Number=SeqID_126330
tctgtgtaatcgattacacagaggaatgggtcactggtaatcgattaccagggatgaaaagccttgagataccccttttacttgcatgtagtggttatgagacgcattgtgttgcggcggagcttgggagaccctcgaaggcaacacgaggtgccggatttcggggccccattcgattcacgactacttctttggtgcatccagatgaacctgtacggacgcttcagcgcacggtggagtggatactacccatgcctacaccatatcgtctagtggagctagtccaagtgatcgaggtgacgtcatccgaggaagaccctgaggaggatctggaggagctacctcctgagcctgccgtggatgcccttgactttctagagggtgatgaggatccacttcttgaggtggattctcccaaggaagtcatgtcggcatctgaggcagactctacggaggatagtggcccgggggagatggcgatcagcggaggctcttcatcacagtggaca

SEQ ID NO: 34646 - DNA, 252 bp, Glycine max
  Peptide Sequence Number=SeqID_126331
atggcatacaccaactggcacttaggcagcgggaggtcggagttgtggttgctaggcaagacattgctgagcagcagtgtcatccatatctgggtcaagatagtcatgatggtgcgcatgatccgcacccgcctccctgcaacagttcgggtgaaatcctgccccgggtcactagacgtgctcatgcctgcgagttatctctccctggaagtcggggtactcgtcttccctgagctagacatgcctctccct

SEQ ID NO: 34647 - DNA, 285 bp, Glycine max
  Peptide Sequence Number=SeqID_126332
atggtctctttagatactttgtcttcaaaagtatttcaggaacaggatatccatgatgatgatgaagaccaagtcaacttgtatctcatgacaaaatctgatgagaataacaaagaagattctgtaaggaagacatggtacatagatagtggatgttccaagcacatgacgagtgatgtatccaaattcacaactatttcccccaagaaaagtggacatgttacatacggtgacaacaatattagtaaaatctcaaaagaggcaacatctaagccatctctatga

SEQ ID NO: 34648 - DNA, 346 bp, Glycine max
  Peptide Sequence Number=SeqID_126333
atggagaggagtgtgattgatgctgccagtggtggagctcttggagtccatgaggtggccacggattcatcttcatctactgaaaataaaaagcttgaaggaaaacttgatgccttggtcaacctagtaacccagcttgccatgaatcagaaatctacacctgttgcaagagtctgtggtctatgttcttctgcagatcaccattcagatctttgtccttctttgcagaaatttggagtcaatgagcaacctgaagcttatgctgcaaacatttataatagacctccacagcaacaaaaccaacaacaaaataattatgacctttcaagcaatagatacaatccag

SEQ ID NO: 34649 - DNA, 159 bp, Glycine max
  Peptide Sequence Number=SeqID_126334
atggctccgaagaagctctccatgaagaggtctagaagagatgttgcagcagaagggcccagtgccacccccgagtttgatagtcatcgtttccggagcgccgagcaccaccagcgcttcgaggccatcaaaggatggtcgttccacagagagaggcat

SEQ ID NO: 34650 - DNA, 962 bp, Glycine max
  Peptide Sequence Number=SeqID_126335
atggctacctcaccaaaagatacttcatctcctggttcaccctttgtaccatcatctccatcatccaccaaagcaccatcaaaccaggaacaacctgaattccatatccaacccatacaaatgattcctggtcaagcccctgttcctgagaaactggtccccaaaagacaacagggagtgaagatttctgaaaaccctagccttgcaacaagtcctagggaagtagacacggagatggacaagaagatccgcagtattgtgagtagcattctgaaaaatgcttctgtccctgatgctgataaagatcaaagagagatcaacagaggaagaggatcaagccacagaggagaccctgcaccacgggcaccagaacctgctccaggtgacctcattgacctagaagaagtagaatctgatgaggaacccattgccaacaagttggcacctggcattgcagaaagattacaagcagaaaagggaaaacccccattactaggtcttggacgaatcaaaactatggcacagaagaagagcacaccaatcactcctaccacatccagatggagcaaagttgcaatcccttccaagaagaggaaagaaatttcctcatctgattctgatgatgatgtcgaactagatgttctcgacatcaagagggccaagaaatcagggaaaaaggtgcctggaaatgtccctgatgcaccattggacaacatctcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgattatcagaaagtgtt

SEQ ID NO: 34651 - DNA, 69 bp, Glycine max
  Peptide Sequence Number=SeqID_126336
atgggcttctctaggaattttctcaaggaagcttctcaaggaagtgtctcaaggaagcttctcaaggag

SEQ ID NO: 34652 - DNA, 676 bp, Glycine max
  Peptide Sequence Number=SeqID_126337
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttatggaagctgacatacccttggggtggaaaccactcaacctggagcggtatgatgggaccacagatccaaatgagcatctagatgcctttctgactcaggcgaatctatataccaatgacgatgtgaccctatgtcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34653 - DNA, 105 bp, Glycine max
  Peptide Sequence Number=SeqID_126338
atggccgaccagcagacgaccaagtccaaagccaaagctcaagacgttaaagaagcgctactaggaggcaacctagtaccttttaaatctatgcttgttatttga

SEQ ID NO: 34654 - DNA, 243 bp, Glycine max
  Peptide Sequence Number=SeqID_126339
atgacctccccctctatgccctgcggtaatgattcctctggcattacggccttttaccacaacgatgctgtccatagatcaaatgatttcgtggattggattttacttgactgtctacggctccattgcgtgtgcttggggtcgtactcttctaccctttaccgggagtcgatgactattcatagctattactttgacatcaaagaagagttcgacccaatgcttgatttctgtcctagttga

SEQ ID NO: 34655 - DNA, 2094 bp, Glycine max
  Peptide Sequence Number=SeqID_126340
atggctaatattacagcagcagataacgcgaccgttatctcgaccaaagatcagttttataaatggattgataagagcgtagcaggtgccaacggcggcaagctggagattacaatcgatggtgaagtgcacatggttgatatcagcgaggacggtaaatggtcattcgacccgaaaaccagctggttagacggcacccatgtcattcagctggtatcgattgataaagcgactaacccgagcccaccgcgtatcttcattcttgatatggatacgacgcctccggcaaaaccggaaatctggcgcgtgattgatgacgctgcggcggaagatcactacctgacgccgggtgaagccaccagcgataaaacgccggcgctggctggtgtggcagagcctggcaccattgttaccctgtacgataacggtaaagagatcggctcagtggtagcagacaaaatgggcgcatggagcatcacgccggagctggcagacggcgagcaccaactgaccgtgatggcgaaggatacggttggtcatgaaagcccgatctctgatgctttcaacctgacgattgctgacggtgtggtcactcaggcggttaacgaagcggtatctgtaacgccagcagaatcaaccactatggacgcggttccgtttccgggtaaacccattaaaaccatcaataaaaacattatctcgttgagtgctgataatgctgaacccaatgcgttagtacagatcgttattgatcaaacagtttacactacccgtgctgatgccagcggcaaatggcagtttgactcgccggaaatgaaagaaggtttgcacgttgcgggcattcgttatctggaccgcgccggtaactggggaccatcaactcagcttatccgcaatatcgacacctctgcaccagaagcgccgcagattatgcgcgtgatcgataacgaaggcagcgcagatacctatctgacgccgggcaactacaccaatgacaaaaccccaaccctgtacggtgttgctcagccagacagcgtagtcaaaatctacgatattcgctccaacgtgattggcagcgttaaagccggtgccgatggccgctggagctttacgccggaactgaccaccgacggcacccacgtgtttagcgccagctacactgaccgcttcggcgccgagagcccgcgttctgacaacttcgcgctgacgctggatacctctgtgccgggcacgccatcactgagtgaggtgttggatgacgaaggacgcgttaccggtccgctgaagtcaggtgacatcaccgatgacaaaaccccaaccctgtcgggtaaagcagatgctggcgtgattgtgcgcgtatgggacggcgacaaactgatcggttctaccaaggcggacaatcgcggtgagtggaaactggacgttgagctgggtgaaggtgagcactcgctggttgtggattccatcagcaaaggcggcaccgtttctgagaaaaccgatccgttcaaactggttatcgacagcaacatcctgccggcaccggtggtggatgagatggtcgccaacaacggtgatgaagagcgtgttctgcagccaggcgattccactaacgacaccacgccagtgctgcgcggtgaaggcaacgacggcgacatcatctatgtaattgttgacggcgaaaaagagccggtggcttcaactgtcgttaaagatgggaaatgggaaattgaattgccagagctggcagaaggttcacacgatattgaactgatcgctaaagatccggccaccggcaaagagtcaccgacctcagatccaattaacgtgattatcgatattacgcctccggatcagccgcaaccaccaacgattgtcgataacgaaggtgacaacaccggtccggttgaaccaggtaagcccattgatgacaaccgtccaggtttcggcggcgaaggtggtaccccgggcgacaaagtggaagtcatcattgatgacggtaaaggtaatccggtggtgattggtaccggtatcgtgggcgaagacggcaagtgggaagtgaaacctgagaacccaatcgatgacggtaactatcag

SEQ ID NO: 34656 - DNA, 1876 bp, Glycine max
  Peptide Sequence Number=SeqID_126341
atgaacgtttcacccgtaagtgtggcggttatcgataagaaaaccataaccaaagcggaagtgctgcgcgccggtaaagacggcaaagcagtgaagattcaggcaattaccaacggtaaatatctgctgacgcagaaccaggacggcaccgcgcctgaaaacatcaccgttaaacgcgcagggaaaaacctgctggtgatgctggaaggctcagacgccagcaagccggatctgattatcgaagatttcttcgctaaatccggcaccttagtgggtaaagcggaagacggcgaaatgcacgcttacgtcgcgacggacggcaatgccgaccacgaagcggccgcgctggccgacggcgaaaccaccgcgctggcgctgggtgaaggcagcgttgatgataattccggctacgcactggccagcggctttgaatggtcgccggcgctgattgcgctgggtggcctggcggctatcgcggcagcggcaggcctcggctatgtcgcggcgaaacaccactacgacaataacgacggcagccacagcggcaaaggtgaaggcggcggtggcagcggcggcggcgatatcagcaagcccaccatcagcgatgtgattgatgatatcggcgacgtaaccggttcggtagcaaatggcggccgcaccgacgacaccatgcccaccttcaacggcaccggtacgccaggcaataccattgaaatatgggatggtgagacgctgctgggtgaagtgctggtggatgacgagggtaactggacctttacgccggaaaaaccgctggcggctggcaatcacagcatcgttaccgccgagcgtaacgccgaaggcgtggtgggtgaagagagcgatccgtgggaattcatcatcgatctgactgcaccagccaaaggcaccatcggcagcgtgatggacgatatgcaggatccgccggtgctgatcgaaaaaggcggcgtgacgaaagacaatacgccaacgctgaccggtaaagctgaagcgggctcgacggtagaaatctggaacgatggcgtgaagctgggcaccgcaaaggtggacgccgagggtaactggacctttacggctccggcgctgcaggatgggcgacacgagctgagcatcgtggtggtcgatcaggtgggtaacaaatctctgccatccgatccgttcatcgttgatgtggacaccgtggcgccggaaaatccgggcattggcgtgataaaagacagcgaaggtaatccgctggaagacggttccaccacaaaagatctgcgtccgacgctggaaggcagcggccaacgatggcgatatcgtggtgattatcgacaacggcaagccaattggttcgaaaacaatctgcaaccgggcgagcacgagctggaaatcgtggtgcgcgatccggcaggcaacgaatcgccggcctctgacaaggtcacgattgggtttgaaggcgacacgcaagtgccggtcgatcctgaacctgtcgatggcctgcccgatccggacgttccggtttctggcgtgattgagcatatatttaaagacaataacgacgccggcgtgcgtacgccaatcgaaaacggcggcgcgatgaacgatccgagcatcattgtgtccggtaaaggcgcgccgggcgaactggttaccatctacattgtcggtctggagaacagctacagcttcactaccacgattggggctgatggcaaatgggagctgacgacgacggatctggcagacgatatctatcagctacgcggcgtgttctccagcgatggcgaagtgaccggcaaaacggacatttatgaagtggaagtcgacaccattccaccgccgccgccagaaattaatgcgcttgagctgcccg

SEQ ID NO: 34657 - DNA, 1896 bp, Glycine max
  Peptide Sequence Number=SeqID_126342
atgagccaatctagctataatgctgacgccattgaggttttaaccggcctcgaaccggtacgtcgccgtccgggcatgtacaccgataccacacgccctaaccatctgggccaggaagtgatcgataacagcgtcgatgaggcgctggccggtcacgccaaacgcgtggaagtcatcctgcacgccgatcagtcgctggaagtgatcgatgatggccgtggtatgcccgtcgatatccacccggaagagggcgtgccagcggtcgaactgattctctgtcgcctgcacgccggcggtaaattctccaacaaaaactatcagttctccggcggcctgcacggcgtggggatttcggtggtgaacgctctgtcgaagcgcgtggaagtcacggtgcgccgcaacggtgagatttaccagatcgccttcgaaaacggcgataaagtgcaggatctggcggtgattggtacggtaggcaaacgtaacaccggcaccagcgttcacttctggccagacgaaagcttcttcgacagcccgcgcttctcggtctcccgcctcaagcatctgctgaaagccaaagcggtgctgtgcccgggcgttgaaattgtctttaaagacaaggtgaacgataccgagcaaacctggctgtatcaggatggcctgacggattacctgagcgaagcggtgaacggcctgccaacgctgccggaaaaaccgtttgtcggcagctttgccggtgatgtggaggcagtcgactgggcgctgctgtggctgccggagggcggcgagctgctgactgaaagctacgtcaacctgatcccaaccatgcagggcggaacgcacgttaacggcctgcgtcagggcttgctcgatgcgatgcgcgaattctgtgaataccgcaatattctgccgcgcggcgtgaagctgtcggcggaggatatctgggatcgctgcgcctatgtgctgtcggtcaaaatgcaggatccgcagtttgccggacagaccaaagagcgtctctcctcacgccagtgcgcggcgtttgtctcagcggtagtgaaagatgccttcagcctgtggctcaaccagaacgtgcaggctgccgaaatgctggccgagctggcgatctccagcgcacagcgccgtatgcgcgcggcgaaaaaggtggtgcgtaaaaagctgaccagcggaccggcgctgcccggcaagctggccgactgtaccgcgcaggatctgaataaaaccgagctgttcctggtggaaggggattctgcgggcggctccgccaagcaggcgcgcgaccgcgaatatcaggcgatcatgccgctgaaaggcaagatcctcaacacctgggaagtgtcgtcggacgaagtgctggcgtcgcaggaagtgcacgatatttcggtggcgatcggtatcgatccggacagtgaagatctcagccagctgcgctacggcaaaatctgtatcctcgcggatgcggactccgacggcctgcacattgccacgctgctgtgcgcgctgtttgtgaggcacttccgctcgctggtgcagcagggccacgtctatgtggcgatgccgccgctgtaccgcatcgacctcggtaaagaggtgtattacgcactcgatgaagacgaaaaagagggcgtgctggagcagctgaagcggaaaaaaggcaagccgaacgtgcagcgctttaaaggtctgggtgagatgaacccgctgcagctgcgcgaaaccacgctcgatcccaacacccgccgtctggtgcaactgacggtcgacgaagaagacgtcgagcagacgttacggatgatggacatgctgctggcgaagaaacgctcggaagaccgccgcaactggctacaggaaaaaggcgacctcgccgacctcgaagtgtga

SEQ ID NO: 34658 - DNA, 1002 bp, Glycine max
  Peptide Sequence Number=SeqID_126343
atgatgcgtctgtgcgaaaccaatttcgctcagctgcgccgcctgctgccgcgcagtgacgaggcaggtgcgtcggtgatgtatcaggtgaacggcgccagttatcagctgactattgaagagtcgacgcgctataccacgctggtggagatccgccaggtggcacccgcagtgagctactggagcctgccgtccatgtcggtgcggctctaccatgatgcgatggtggctgaagtgtgttccactcagcagatctatcgcttcaaagcgcgctatgattatcctaataaaaaattgcatcagcgcgatgaaaaacatcagattaaccagttccttgccgactggttgcggtactgcctggcgcacggcgcgatggccgtgccgcgtggagagaaaggaaacgctttggatagcctgctaactcttcctgcggcaaatgggtccgatatcaggattttacaaattacggatacccatcttttcgcaggaaaacatcaatcgctgcttggagtgaatacctggtcgagttttgatgcggtgctggacgccattgcggcgcaacagcgcgattacgatctgattatcgccactggcgatctcgcccaggatcacaccgtcgaagcttatcagcattttgttgcgggcattgcacgtctgccgaagccgtgcgtctggctaccgggcaatcacgattttcagccggcgatggtcgatacgctggcgcaggccggcatcgctgcggacaagcatgtgctgctcggcgagcactggcagctggtgctgctggacagccaggtgccgggcgtgccgcacggcatgctgagcgactatcagctggagtggctggaccgcacgctgcgtcagttccccgatcgctacacgctggtgctgctgcaccatcatccgctggcctgcggctgtacctggcttgaccagcacagcctgcgcaatccgcatcaactggatgcggtgctgcaaaacttcccgctggcgcgctacctg

SEQ ID NO: 34659 - DNA, 1371 bp, Glycine max
  Peptide Sequence Number=SeqID_126344
atgaagataatgaaacggacaaaaaatattcgtcatgccgctttccgtaaaagctggcaggcacgccatttaacgccggtcgcactggcggtcaccgccgtgtttatgctggcaggctgcgaacagagcgatgaaacggtttcgatgtaccagaacgccgatgattgtgcgaaagccaatccgggccagagcgctcagtgcaccaccgcttacaacaacgcgctgaaagaggctgagcgcaccgcgccaaaatacgccacgcgtgaagattgtgtcgcggaattcggcgaaaaccagtgtcagcaaaccccggcacaggcgggcgttggtaccacggcgaacaacgctgaagcgcagcagagcggcagcttctggatgcctctgatggccggctacatgatgggtcgtctgatgggcggcggcgctggctttgcgcagcaaccgctgttctcgccaaaaacccctaatagcccggctaacggccagtttgttgatgcttccggtaagaactacgacggtagccaaacagaacaccatgcagcgcagcagtgccaccagcaccggcagccgctcgctgggaggctaagcccgcgcatgcaacgtattgctatcagcgaacgtccgaactggcgcgaaaaggcgaccgagtacggctttcagtttcacaccatgtatggcgaaccctactggtgcgaagacgcttattaccagtttacgctggcgcaaattgaacagctggaagcggccaccgcggaactgcaccagatgtgcctgcaggcggtagaaaaagtggtgaacagcgaagcgctgctcacccgtttctgcattccgaaacacacctgggattttgtgcgcgaatcctggcagcagcgtcagccctcgctctattcacgcctcgatctggcgtgggatggcacaggcgagatcaagctgctggagaacaacgccgatacgccaacctcgctgtacgaagcggcgtttttccagtggatctggctggaggatcagctcaacgccggcaacctgccgcagagcagcgatcaattcaacagcctgcaagagcagttgattgagcgcttcgccacgctgcaccagcagcacggttttaactggctgcactttgcctgctgtcgcgatacggaagaggatcgcgccacggtacagtatctgcaggattgcgccactgaagccggtctgccgagtgaatttctctacattgatgagatcgggctgggcgaaaaaggtcagtttaccgatcagcacgatcaggtgatcagtaacctgttcaagctctatccgtgggaattcatgctgcgcgagatgttctcgaccaagctggccgatgcccggcgtgcgctggctggagccggc

SEQ ID NO: 34660 - DNA, 2492 bp, Glycine max
  Peptide Sequence Number=SeqID_126345
ccagcaccgggcagagcctgacgcagctcagcacgctggcggaagtgctgattaccgccgcgcgcgactgggtgtggcaggattgctgccgcgatttcggcacgccgtgcaacgccgccggcgaagcccagccgatgctgattctgggcatgggcaagctgggcggcggtgaactcaacttctcttccgatattgacctgatctttgcctggccggaaaacggcgtcacccacggcggccggcgcgagctcgacaacgcgcagttctttacccgcatggggcagcggctgattaaggtgctggatcaacctaccgtcgatggctttgtttatcgcgtggatatgcgcctgcgcccgttcggcgacagcggcccgctggtgctgagctttgccgcgctggaagattactaccaggagcagggccgtgactgggagcgctacgcgatggtgaaagcgcgcctgatgggcgacgatggcggccactggagccaggagctgcagcagatgttgcgcccgttcgtctatcgccgctacatcgatttcagcgtgatccagtcgctgcgtaacatgaaaggcatgattgcccgcgaagtacggcggcgcggcctgaaggacaacatcaaactcggcgccggcggcattcgcgaaaccgaattcatcgttcaggtgttccagctgattcgaggtggacgtgagcgctcacttcagctgcgttcgctgctgcccacgctgcaggccatcggtgagctggcactgttaacgccggagcaggttgatcatctgcgcgccgcctacctgtttttacgccggctggagaatctgctgcagagcatcaacgatgaacagacgcagacgctgccggaaaatccgctcgaccgccagcgcctggcctgggcgatgggcatggcggactgggcgatgctgctggcacagctggaacagcacatggccggcgtgcgccatattttcgacgagctgataggcgatgatgcgccggatgtcgacgatcagccgcagctggcggagtttgccagcctgtggcaggacgcgctggaagagagcgatttgctgccggtggtaccgcagctgcaggcggaacagcgccatgcgctgtatcgggcgctgaatgatttccgtcaggatgtcagtcgccgcaccatcggtccgcgcggccggctggcgctcgatcaattaatgccgcgcctgctaagcgaagtgtgcgcgcgtgacgacgccgatgtggtgctggcgcgcctgacgccgctgctgcttggcgtattaacgcgcagcacctatctcgagttgctgaccgaatatcacggcgcgctgcgccatctgattcgcctgtgtggcgcttcgccgatgattgccagccagctggcgcgctatccgctgctgctggatgaactgctcgatccggccacgctgtatcagcccaccgccaccgatgcctatcgtgacgaactgcgccagtatctgctgcgcattcccaccgatgatgaagagcagcagctggaagcgctgcgccagttcaagcaggcacagcatctgcgtatcgccgccgccgacatcgccggaaccctgccggtgatgaaagtgagcgatcacttaacctggctggcggaagcgatcattgaatcggtggtgcagcaggcgtggcagatgatggtgcagcgctatggccgcccttcgcacctcaccagcgacagcgagcgcggctttgccgtggtcggctacggcaaactgggcggctgggaactgggttacagttcggatctcgatctggtgtttctgcatgactgtccggacgatgccgaaaccgacggtgaacgcgttatcgacgggcgccagttttacctgcgtctcgcccagcgcgtcatgcacctgttcagcacccgcacctcgtccggcattttgtatgaggtggacgcgcgcctgcgcccttctggcgcggccggcatgctggtcagcacctttgccgcctttgacgactatcagcgccatgaagcctggacgtgggaacatcaggcgctggtgcgcgcgcgcatcgtgtttggcgaaccggcgctgtgtgagcgcttcgatgcgatccggcgcggtattctctgcctgccgcgtgaaggcgcgaagctgcaaaccgaagtgcgtgagatgcgtgagaaaatgcgtgcgcacctcagtaacaagcacaaaggccgctgggagattaaaaccgatgagggcggttacgccgccagccagccggcgctgacgcgctggtcggataacgtgcgcattttcgaactgatggcgcgccacggcatcatggctgatgaggaagcgcaggcgctgacgcacgcttacgtcacgctgcgcgatgcgctgcaccatctggcgctgctggaactgccgggtcgtgtcgatccggcatcgttcgctgacgaacgcgccgtggtgcacgccagctggcagcgctggctggccgcgagcgacgcggatgacacggagcagtga

SEQ ID NO: 34661 - DNA, 1218 bp, Glycine max
  Peptide Sequence Number=SeqID_126346
caccatggacaatttagaaccaacaggagcgtttgcctgtgcggctgccggcgtcagccggcctgtgctacactgcgcgccgcaagaagagggtgataaagctatgcgagttctgggtattgaaacgtcctgcgatgaaaccggcatcgcgatttatgacgatgcgtccggtctgctggcgaatcaattatatagccaggccggagagattgacgccgtggcgtacaccgccggtcccggcttggtcggtgcgctgctggttggcgccaccattggccgcgcgctggcgttcgcctggaacgtgccggcggtgccggtgcatcacatggaaggccatctgctggcgccgatgctggaagacaacccaccggcattcccgttcgtggcactgctggtctccggcggccacacgcagctgatcagcgtcaccggtattggtgaatatacgctgctgggcgaatcgattgatgatgccgccggggaagcgttcgataaaaccgccaagctgctggggctggattatccgggcggcccgatgctgtcgcgcatggcacagcagggcacgccggatcgctttaaattcccgcgtccgatgaccgatcgtccggggctggacttcagcttctccggcctgaaaaccttcgcagcgaataccattcgcgaacacgacggtgacgaacaggcgcgtgccgatatcgcccgcgcctttgaagatgcggtagtggacacgctgatgatcaaatgcaagcgtgcgctggagcagaccggctttaaacgcctggtgattgccggcggcgtgagcgccaaccgcacgctgcgtgaacgcatggcaaccatgatgagcgcgcgcggcggcgaggtgttttatgcccgtccggagttctgcaccgacaacggcgcgatgattgcctatgccggcatggtgcggctgaaaggcggcacgcgcgccgctgagcagtaccgtcagcagccaggtgccggtcatcaggccggtcaggtcccagccaatcggcgcgatggcgccaaacgcggtggccacacctttgccgccgcgaaagcggaaaaacaccggatagatatggccgaggcaggcggcgatggccgtgaggccaagatacatcggcgtgacgtgcagccaccaggcgatccacaccggcaccattccctttgccacgtcgaaaatcagtaccgcggcggcggcggctttaccgccaatac

SEQ ID NO: 34662 - DNA, 351 bp, Glycine max
  Peptide Sequence Number=SeqID_126347
atgatcatcattatcaatgcggaagcttgtggttacgtgagcatgaactactaccaatatatagatgttgtttacacaaatgagcacatcttaaaagcttactccgcacaatggtggcctcttgggaatgaagcagctattcctccttctgatgacgcatggacacttatccctgacccaactacaattcgtgcgaaaggtaggccaaaatcaacaaggataaggaatgagatggattgggtcgaaccatctgagcaccggcaaaatgtagtagatgtggagccgaaggtcataacaggcgtcgctgtccaatgcaatctgagcatggaagttgttcaaatcattgattaa

SEQ ID NO: 34663 - DNA, 414 bp, Glycine max
  Peptide Sequence Number=SeqID_126348
atggccgcgacatcgcagcgcttgggcctgcccgcgttgaccgcactggtggtcggctcgatggtcggcgccggtatcttttcattgccgcagaacgtagcgcgcagcgccggtccggccgccgcgctgatcggctgggcggtgagcggcgcgggcatgctgatgctggccttcgtgttccaggcgctggccaaccgccggcctgatctcgataccggcatctacgcatacgcgcgcgaaggcttcggcaattacatcggcttctccgctgcgtggggttactgggttgcctcggtgcttggcaacgccagcttcttcgccctgatcttcagtggcctcggccacttcatgcccgtgttcggcgaaggcaataccccggccgccgtgaccgcatcgtcattgctattgtggacg

SEQ ID NO: 34664 - DNA, 394 bp, Glycine max
  Peptide Sequence Number=SeqID_126349
atggacaagctccaaaggcttaaacaagagagtatgaatgttgaagaatatagacaacaaatggaactactccttttaagagttggacttagggaggagaaaagaacaagtatagctaggttctttagtgggcttaatatggaagtgagggacaaggaaagccaagcccaaggaattttgggggctgcaccttcaaaacccaaggaagataagggtaagaccatagagaaaaccatgattttaaggggtcaagacatttatagtagtcaagaggagactacttcttcctcttcctctagtggaagtgaagatgaagtaaggggtgaagagtctagtgaggaagtctacccccatgaagaagatgacctcctaatggttagaaggctccttggag

SEQ ID NO: 34665 - DNA, 309 bp, Glycine max
  Peptide Sequence Number=SeqID_126350
agagggtacatctcttgtggatcagttctagtggagggtacatccactaggttcaaagagaacaagggagggaactatgaagaaattgttggtgatttgactgatggtgtagaagaaacaggtgacacaagaggtaccgacgaaagtgctgatatgacaatggatgatagagggggtgagctaaatgcggggttcgatgaacaaggtgttactcttcaaaatatggacacacaagatacagtgcttccatctatatcactaacagagccattattgggtagagaactgttagtcgtcatttacgactaa

SEQ ID NO: 34666 - DNA, 192 bp, Glycine max
  Peptide Sequence Number=SeqID_126351
atatgttgttcgaaattcaattgcgcacactttcaccgttgggatttgcgagataatattcgtggagggagaaaaaggaatcgcatgaagacagtacaagtggaggcttcaatctcttctccgtctctaacgttagagaattctattggagcagtcagaggaaaaactggaggaatatcaggaaaccgctag

SEQ ID NO: 34667 - DNA, 624 bp, Glycine max
  Peptide Sequence Number=SeqID_126352
atgccatcaccttcagagggctacaagacctcgccttcagaggacaagcacgtcctcgccttcagagggctacacgtcctcgccttcagagggctacacgtcctcgctttcagagaactacatgcctcgccttcagagggctacacgtcctcgccttcagagggctacaccctcgctttcagaggactacatgtcctcgcttctcaggactacacgccttcagaggacttcacgtcctcgccttcagagggctacacgctcctcgccttagagggctactacacttcctcagcctttagagcactacacgtcctcgccttagagggctacacgcgaagcctcgtagaggactacagtaggactacacgtccttcgccttcagagggctacacgccctcgccttctagaggactacacgccctagccttcagagggctacacgtcctcgccttcagaggactacacttcctcgccttcagaggactgcacgtccttgccttcagaggactacacgccctccgctttcagaggactacacgtcctcgcattcagagggctacacgccctcgccatcagatggttgcagtgccctccccttcagaggactacacgccctcgatttag

SEQ ID NO: 34668 - DNA, 479 bp, Glycine max
  Peptide Sequence Number=SeqID_126353
atgtcgatctccccctgcggaagtatcagttggtctgtgtcgtcccgacatagggatcgcggccacaagacacccagtggacccggaggagcccaacagggccctagggtttccagctctggttacgggcctctggatcatgcccgcaagacactcagtggacccggagaagtccaacagggtcctggggtttccagctctgattacgggcctctgtcagttctacggagtgcctgtcacccccaacaaggtcatcaggccccctaccaaccgagctttcatcaagaagtactgtgcccccaggtaggcgcagggcgagacaccacagcagcccggggatggccgacagcgggcaaccgacgcatcgccgccacctccagggcccctcagctcatctacaaaggctggagcgttgcctacgacccgttgccgactagcgggcgaccaagtccaaagccaaagataagcaaaagtactag

SEQ ID NO: 34669 - DNA, 275 bp, Glycine max
  Peptide Sequence Number=SeqID_126354
aacaagctcaagaggttgctcttgtgtgtataaagaggttgctcaagaggttggcattaacagatccacttaaactgttacaagaacacaataagggtaagggaaacttcactaaggagaaaaagcatagagttgtcacgatgctcgagttaaatatgagataccctagccatgagaagaagcacagacttctgacaatgctcgagtgcgacgaacacgatgctcgaccttacacaaaacgatggtcagatggagaacatacaacttcaaggtag

SEQ ID NO: 34670 - DNA, 627 bp, Glycine max
  Peptide Sequence Number=SeqID_126355
atgcccttgccggaggcgtcgcgcatacgttgcagcgctttcggctcgagcacaggcgccaccccctgtaacagcgcggcgaaatccactgccaggcattcggccagatgcgtggcagcggcaccaccgctgttgagtgcacgcagccgttccgcgggaatgggcgtgctcatgcggcggcttcccgcccggtgtccgtgtgctgccagaccttatgcagcagctgtgacagctgctgcccgactcggccaaacgcttgcccggtgtggtcaacacgatctgcagacgacggccatcctcgttatcgctgcgccgctgcagcaggccttcgcgctgcaggccatcgagcaggccgctgatggtggcccgggtcacgccagcgcgctcggccagcgcgtgcggcgccagtgcgccgccggccccgtgcagcaggaacagcacgatgaagcgaccctcgctgagcccgtgcggtgccaaccgtgcagcgcagtcgcgatcgatcgacgaggacaacgagagcagctggaagcacaggcgcagctgcgcgatgttggcgtggccgcgccgctgtgcttcctccagcaacgcctgatgcttggcttcgatcatccttccctcgccgcatga

SEQ ID NO: 34671 - DNA, 456 bp, Glycine max
  Peptide Sequence Number=SeqID_126356
atggggacaaggggttgcatcagttacaatcccgttcttgctataaggcaacttggctaccctatgagaggggcaccactagaggaagagctcgcgcctgtcatttcacgaggtttcaataagaccaacgtggagacacttcagaaggtccgcaaggcatgggaggtggtgcaaaagaaggacaaagaactcaggggcagtaacaatgggcccatcggtggctaccaaaggtggttgaaagcctatgtgcaagctaccaccaaggccttggaacaagagaccaagagggctcgtagggaagagcacggccggaacaagttccgaggggctctatggggcagcaacaacgagcttaagctccgaagagaggaaagagaccaatcacgagtacatggcatggtcttaaagaaggagttagctgcttgctcaagatccaagaaacgtttggcccaatag

SEQ ID NO: 34672 - DNA, 375 bp, Glycine max
  Peptide Sequence Number=SeqID_126357
atggtagaagtctccgtggaagcaactgcatcccttactcagtattatgaccagcccctaaggtgcttcacttttggggacttccaactagtacctactgtggaagagtttgaagaaatcctgggatgtccgctgggaggaagaaagccatatctcttttcggggttctatccctccatggaaagagtagccaaggtagttaagatctcggtacaagagttggaccgtgtaaagcaaaataggaacggggcagtcgaaataccaaggaagcatttggaggaaaaggcaaaggcattggcaaatcaaggcactgctgatatttggagtcgtcctctttccaaatgtggagggtttagtggacctagtagcgattaa

SEQ ID NO: 34673 - DNA, 75 bp, Glycine max
  Peptide Sequence Number=SeqID_126358
atgttaaacacatccagcaaaagacatgtaaggagatacatggagaaaaatgaagaaacaacaatggaagagaag

SEQ ID NO: 34674 - DNA, 447 bp, Glycine max
  Peptide Sequence Number=SeqID_126359
atgtctgttggatcccttatggggagcactgagaggtcctggacttccacgtcagatcatgctattccggtctcttgcgctgggggcctgttgttgtttattaccaaccggagagggtcgtgcgggagtttggctacacgcaaaccattcctgctcctcatgtcgattcatgggtctcgtatgatgatatacacggcaggtggatgcactacgaggatcatatcgttccaacaggccccgcagacggatatccctcgcgtgccggagccagaagcatcgttgacatctgcggtggagcctagacatgtagtggaagtttgtgatgacattgctgagaggttggagcgccatctgagtctaggggtggtcacgcctggctcatcgacacatgaggtgatcgaagaatgcctcaggtctagacgcaggcggcgcacggatcaggagtag

SEQ ID NO: 34675 - DNA, 207 bp, Glycine max
  Peptide Sequence Number=SeqID_126360
atgaagatgatcttgataccacatgatgcaagctccattggagcttcggaatggagaaggaagagagcgaggagacgccacttcaaggagaagatgagtctagaagaagctcaccaccataggaggccatggataagagcttggaggaagaaggagatgaatgaagggagagggagagaagaacacgaaattttgtgctctaaatga

SEQ ID NO: 34676 - DNA, 357 bp, Glycine max
  Peptide Sequence Number=SeqID_126361
atggcttcgaacaaaaggcatttcacggaggaagacgacgatcctcactcgttctccaagaaatcgaaggaatctgaatctgaatctgatgcatccccttcttctcttcgcatttttctcaatcctgcggactatgacttgggtattcattctcacttcactatcattcttgtgtgggattacataagtggaaagctgaagaaagatctacagtaccaggctgatgaagtgttcatgatgcatgatgatgttgtgctttgtgtagactttagcacagattcagaaatgctttcatctgggtctcaagatggaaagattaaagtgtgcactgcacatatagctttgatatttctgtga

SEQ ID NO: 34677 - DNA, 348 bp, Glycine max
  Peptide Sequence Number=SeqID_126362
atgactactcctgtattcactcaagccaatgatgctgacctgtccaaactgtcaatccaaatagttcttccatttgacaaagaaacagaaagtttgccaaatcctaatcaagaaacagctcgcttgagaaaggttgaaggaggcattgttgcaataatgaagtttagcggaaaacccacagaggatattgttcgtgaaaaggagaaaaccctgcgtgccaatattattaaagatggtcttaaacctcagcctggttgtttgcttgcacggtacaatgatccaggtcgaacatggacctttataatggtatgctgcaaaacctgcttgagtgtgtcagttgatttctaa

SEQ ID NO: 34678 - DNA, 618 bp, Glycine max
  Peptide Sequence Number=SeqID_126363
atgagggaccaagacatttatagtagccaagatgaggctactacttcaccttcctctagtgaaagtgaagaagaaaaaggggaagaatctagtgtagaaatctaccaccaagaagatggacaaccattagtggttaaagagaagtgtaaggaggtaagtgtctcctccaagaggttagctaagaaggaaaatcattttacaataaagacaaacattaaagaaactttccctcttagacaacctccacattttctcttttgtaaaaagacacttgctagcaatgccacacctcttgttgggcttgagtttattcctcaagtaaagaagttgttggatgagggtttggttcgtaagagcttaaatccttgtgctttgttggtgcccaaaataggtattattaggcaccaagtccctaacataggtgcaccactcattgagttggtgaggaaccatgttccttcatgggaagatgcccaggaaatgggttttcagaccttaccttacttcaacttcccatacaccactaatataagactccaagaagattgggccaaagatgcaagagaaggccctaaggttcttatgagccttagggtagatttcgggctcgtgggctaa

SEQ ID NO: 34679 - DNA, 239 bp, Glycine max
  Peptide Sequence Number=SeqID_126364
atgatgacaaaggtgatgacaaaaagctcaaagatcaatcaaagaacaactcaagtgaatcaaagatcaatcaaagaacaactcaagtaaatcaagaagaattcaagactcaagaagaaagtttagagtcaagaatcaagattcaaggttcaagatctcaagaatcaagaatcaagattcaaggttcaagatctcaagaatcaagatcaagattcaagaatcaagagaaggctcaatga

SEQ ID NO: 34680 - DNA, 144 bp, Glycine max
  Peptide Sequence Number=SeqID_126365
tgggctaagcacgcatccaccgctaagcgcagcttcaacgcacttagcgtgatagaagaatctggtagagcatcaatatcaaggtggcacgctaagcgcaagatcagtgcgctaagtgcagcaattgtcttcagccaggcttag

SEQ ID NO: 34681 - DNA, 2013 bp, Glycine max
  Peptide Sequence Number=SeqID_126366
atgccgcatatcgatacccgcgtagccgccattttccgtcaggatcgcccgatccgcccgcagggatcgacgatcgtcgaagctggcgatgaagtgttttttattgccgccagtcagcatattcgtgcggtgatgagcgagatgcagcggctcgaaaagccctataaacgcattatgctggtcggcggcggtaatatcggctttggcctggcgcagcggctggagaagcagtacagcgttaagctgattgaacgtaatcagcagcgcgcagctgaactggctgaacatctgcaggataccatcgtgttctatggcgatgcctcggatcaggaactgctggcagaagagcatgtcgatcaggtcgatctgtttatcgccgtcactaacgacgatgaagccaatatcatgtcagcgatgctggccaaaaagatgggcgcgaaaaaagtgatggtactgatccagcgtcgcgcctatgtcgatctggtgcagggcagcgtgatcgatattgcgatctcaccgcagcaggccacgatttctgcgctgcttggccacgtgcgcaaagccgatattgtcggcgtctcttcactgcgccgcggtattgcggaagccatcgaagccattgcccacggtgatgaaaccacttcgcgcgtggtcggacgcctgattgaagatattaaactgccgccgggcacaattatcggcgcggtggtgcgtggtgatgacgtgatcattgccaatgataatgtgcgtattgagcaaggcgaccacgtgatcatgttcctcaccgacaaaaagtttgtgccggacgttgagcccattggccaaggcaaggagataacaatgagtttattcaaagagtttcgtgattttgcgatgcgtggcaacgtggtggacctggcggtcggtgtgatcatcggtgctgcgttcggtaagatcgtatcgtcactggttgcgaacatcattatgccaccgctcggtttactgattggcggcgtcgactttaagcagtttaaatgggtacttaagccagcagaaggcgatatcccagcggtggtgatggaatacggtaactttattcagacggtatttgatttcatcatcgtggcatttgctatcttcattgccatcaaagtaatgaataaactaaggccagaggtaagcactgttgcttaccgctggcctcctgattcgctcccttcgcatgtttatctttacgccggtagctgcctttccccttctgattgcgcacaacacgctggcgatacagcggatcgtgtaacagggcttccagggctccctgcgcgccagaattcaatccttgctacaacaaatttcaggatgcggatcttcgccggtttccagcgcctcgaggatcgaacagcaggcgctactgtgccggtcgccacaacaggtgtgatgctctggatcaatacggatcgacagcaggtcgcggatcgattccaggctgaaaccaagctgccggccgtaacggataaaacgcaggcgctgcagatcgttatcgctgtacaggcggaagccgccctcggtgcgtacctcatgatccatcatctgctgcttttcataaaagcggatggtgtccggcgtcacgtccgccagttttgccagctggccaatgcgatacatactatttctcctgctgtagccgctgaccgatcgccgggcggtattcgccacgcagaaaatcggtgctcatgccagcctgctgtagcttcacttccagcagcgatcgagttcgcgaagcaaatcgctcagtgccagcgcgtcgcggcgcatctccagttccggagggagatagccggcgtttttcagcagtcgccaggcgctgcgcaattccgccggcacaccactgtcatcatccagcgtgagcggcgcaccctcaccaggcagattgctcagctcacccttttcctgcgcggcgcggatgtgttgctcagccagctgatcgataagccacatagaaacctcctgcaggcatgtctgccaacagcatag

SEQ ID NO: 34682 - DNA, 135 bp, Glycine max
  Peptide Sequence Number=SeqID_126367
atggttgggcacatcacattgcccccaaccccttttcttctcatacctaagcttgtagaggttagaataagagacaaaaataaggacttagacctaggaatccaagcctttggttttgagtgcaagaaagcatga

SEQ ID NO: 34683 - DNA, 426 bp, Glycine max
  Peptide Sequence Number=SeqID_126368
atgataggtcaggaaggcaaagaattgagacgtacgggcggcccccattttgtgcaagttcagaacaagcatgctttcctgccatatggcttgcctcccaactatacaccacccaatgttgcacacgctctcgatgagaatgccaataactccactcccatacccattgagagccaacaacctcaatctgatcatgcacatgtctctcaacccatgggggagacacataaaataccctaccatattctatctgacttcgagccttgcctcggatacgccactgaggggcaagcagttggtggtgtacccctgccaaacactttggatggccctcagtttcgcccacaaccacaacccttgcattttgcgatagggagagtccctcctgcaatggtggaaaaaggcagattggatcatatagagtaa

SEQ ID NO: 34684 - DNA, 123 bp, Glycine max
  Peptide Sequence Number=SeqID_126369
atggagaataagatgagaaacaaatcaaggacagtagaatggagaaggaagaaagatgattggagatgccacttcaaggagaagatgagtcaagaacaagctcaccaccataagaaggcatag

SEQ ID NO: 34685 - DNA, 705 bp, Glycine max
  Peptide Sequence Number=SeqID_126370
tctaacacttctagacttgggttccctactcttatcaccgcattatgcggagccagaggggttgtatctgatagccttaccttcgagcgcctgagcccggtcattaacctagcctacataaggaagaactgttggaaccccgaggatctaacaatctttatccgaggggctaggagggcgagggcaaggctaactgagcttccttctacttctatagctcctactccagcatccacttcagtagccccttctgtcccagctaagacaaattctcagtgctttaaagccatgctccaaagcattcatcagggacagatcattttactacagagtttacagatgatggcacctccagactctattcctatagtacctcagcatatggaggatgagtcatctgaggccaccatcccagagccatttgatataggaaaagaggcagaagagatacaggtaaggcaggtagctgctaccactcttgagcgattccttgaggctacttcagagccttctgcaccagtggtaaatctaccctcacctcagcctgtagcagaaccatccactcctcttctacaaatgccagaggacccaactacaccagtcttagatttagacacttctcctcccattactccagtgcttcagctgacagatgaggaggatggtcagacacaggacgcacaggaccagtcacaggaattttga

SEQ ID NO: 34686 - DNA, 1077 bp, Glycine max
  Peptide Sequence Number=SeqID_126371
atgcgctggctgctggacgccactcccgatggctatcagcttgccgcacgcggcgagaggtgcctcggcactatcgacagctggctgctgtggaatttaaccggcggacaatccttcttctgcgattattccaacgccgcccgcacccaattgctgaatctgcaccgcggcgagtgggatgacgaaatgctgacgctgtttggtattccgcgcgctgcgctgccggagattaaaccgtcgagcgggctgttcggctacaccaaagggctggcggcgatccccgacggtattccggtgatggcgatgattggcgactcccacgccgcgctattcggccacgcccttggcgaagctggctgtgtgaaagccacctacggcacaggctcctcggtgatggcgccggtccaatcggcccagtgcgatattgccgccctggcgaccaccgtcgcctggcacgatggcgaccgactggtgtggggactggaaggcaacattccccataccggcgatgcggtagcatggatggctgacagcaccgggctgagcgaactctcagcagccgatttggcccacgagctgaataccctgcccgcctccgtcgattcgaccttaggggtctacttcgtgccggcgctgaccgggctcggcgccccctggtgggatgacagcgcccgcggggtgatctgcggcctcagccgcggcgtcaagcgcgcgcacctgatccgcgcggcgctggaatccattacctatcaaatcgccgacgtggtggcggcgatgcgccagcacgctgaattcaccctgacggcgttaatggtcgacggcggcccaaccaacaacaactggctgatgcaatatcaggccgacctgctcggctgcccggtaatgcgcagcgatatcccggagctgtccgccatcggcgcggcgctactcgcccgcaaagccctcactccgggcgagaccgccgacctgcaagcactttttaaccgaacacagcgcttttcaacccgacatggcccgccaccagcgactacagcagcgctggcgggagtggcgccatgcgtaaacagaacattatga

SEQ ID NO: 34687 - DNA, 198 bp, Glycine max
  Peptide Sequence Number=SeqID_126372
atgaggcaccaaatccctatgataggtggtatgatgaatgtgttgagtggtgcaaccctctttggtaaaatcatccatgcatccaacatcttcatgattaacatatatagggacttattaggtgttgaggaaaaaaagcccagagtttcaagaacctcgggatttgaggccaaatccttttcaagggggagggaatga

SEQ ID NO: 34688 - DNA, 339 bp, Glycine max
  Peptide Sequence Number=SeqID_126373
atgaagaaaagagatacaggccatcaaagtgtgtcattggagaataagacaagagattcaactgtgttgaagataggagattcgactaaagttgtgataaaacaagacatgaagggaagaaggcataaatatgggtttaacaacaataaacgtgagaagctagagaagatcatgggttctccacctgcctcccctcctcctcctcctcctcctctttctcttcctcctcctcctgctccttcggacgcatcggcttcgccgtctgccatgaagcggacacgcaaagcctcacatctacgatcgttgtctactagaccacctggtgctgagagaccagtg

SEQ ID NO: 34689 - DNA, 222 bp, Glycine max
  Peptide Sequence Number=SeqID_126374
atgtcgaaacatatttggacctatgaaatcacgcaagcaatgctaggggcaccatatccactggggattggtgataagtatatcgttcagccttggtataaattccttcaagaaggtgattttagccatggagacgaactgtcattctactataggcgtgacgaaaaaatatgggaagttgttattagacgcgcaatagattgggacgacaacgacatgtag

SEQ ID NO: 34690 - DNA, 570 bp, Glycine max
  Peptide Sequence Number=SeqID_126375
atgaggaagccgaggaaatggaaggcctggaacgggaattgctggcagaactgggtcaccccgacccttatgccgacgatgaaaccgactcaatcacacactgatacacgaaggatcacgagaaccgccatgagcgaagatcgatcgagcaacgggcagaagtcctggctgggtaaactgacccaggcttttgcccatgagccgaaaaaccgccaggagctccttgagctgctgcgcgaagcccaccagaacaaactgctggacagcgaagcactgaccatcgtcgaaggcgccatccaggtcgccgttttttcttgtgcgcgacatcatggtgccgcgctcgcagatgatcagcatcaaggccagccagtcgccacgcgagttcctgccggcggtgatcgacgccgcgcactcgcgctacccggtaatcggcgaaagccacgacgatgtgctggggatcctgctcgccaaggacctgctgccgctgatcctcaaggagaacggcgacagcttcaacatcaaaggacctgctgcgcccggccaccttcgtgcccgagtccaagcgcctga

SEQ ID NO: 34691 - DNA, 288 bp, Glycine max
  misc_feature (9)..(9): n is a, c, g, or t
  Peptide Sequence Number=SeqID_126376
atggcgttnattgctccccctccacgattggcgagcggggccaagcatttttcaacggaatgtcccgggacacccccatggtacttgcaagttgcattagggtcataccactttgggaaagggggttggaggacccttccgggagttacacggccaaatgggaagttccttgttgcgttggaattaccggctgggcgagttgtgttcggagttggaacttggggagcttccctctgggtgggtgccttaggctgcacaggtgctgaactagaggcattcccggtatga

SEQ ID NO: 34692 - DNA, 222 bp, Glycine max
  Peptide Sequence Number=SeqID_126377
cgagaattcgctaagcgcaatcttcaatggctaagcgcgagaaagaatctagaagatgatgagctttcaagttcactaagcacaccactacaggtcatcaagcgcactgcttcagctcatccgctaagcgaaacaagcgctctaagccaatatccacttatgcgtgctaagcgagccagatctgcgctaagcgcacgagaacgaacaaggccatctatttaa

SEQ ID NO: 34693 - DNA, 129 bp, Glycine max
  Peptide Sequence Number=SeqID_126378
atggataagagcttgaaggtaggagaagatgaatggagggagaaggatagaaggggcacaaaattttgtgcctcaaatgagcccactaattcaagatcaagtccaagattctctactaagtgtgcttag

SEQ ID NO: 34694 - DNA, 481 bp, Glycine max
  Peptide Sequence Number=SeqID_126379
gctttcgtctacagacagcaaaaagtttatacggataaccactcgggtatttccgcctgtcagcatgacttaaaaggcgcagaagacgacgttagtctctgcgtgctatcaggcttttcgtcttacagacagcaaaaagtttatacggataaccactcgggtatttccgcccgtcagcgtgactcaaaagtcagtatgacagatcttgtgagcgcggaagatgacgtaaatctccgcgtgtcaacgggcatgtcggctgcgattaacgaagggcgcgaagacgacgttagtctctgcgtgctatcaggcttttcatcttacagacagcaaaaagtttatacggataaccactcgagtatttccgcacgtcagcgtgactcaaaagtcagtatgacatatcttgtgagcgcggaagatggcgtaaatctccgcgtgtcaacggtcttgtcggccgtgattgacgaagggcgcagaagacgac

SEQ ID NO: 34695 - DNA, 354 bp, Glycine max
  Peptide Sequence Number=SeqID_126380
atgacattgctacttagcaacattctgcccagcgaccgcaatgccaatctccccctgcaaaagtatcagttggtctgtgtcgtcccaacatggggattgcacccacaaagacacccagtggacctgaagaagttcaacagggatctagggtttccagctctggttacgggcctctttcggccttacagggcgcccgttccccccagcaagttcatgtcgtcgtggcatagggatcgtgcccgcaagacaccaaaaggtttgagtattgcctacaccacatggccgaccagcaggctaccaagtccaaagccaaagataagcataagtgctaggtccgtgaccaacaagtcataa

SEQ ID NO: 34696 - DNA, 855 bp, Glycine max
  Peptide Sequence Number=SeqID_126381
atgggcccagttttgccagactcgcagagacccttcttgggaggtatgtacattgcaatccagaaacagaacattgccccccatgtcttgtctcatgggggttatgaatatttggagcagaaactcctggctgagaagaccaagaagaagctggagaaagctggacagtcaggaagcattgatggcatcatcgaccctccatcccccgtcaaacgccacgtgaagtggaagatggtccgcgtgaagacaataggggagatgacgactgaggccgcaaaggaaatcgctgagaagatcgtaaggatccttcatccctcatgggcatcaggatgtctcaccgctgctattagacgtccagagcaccctggacatgtccgtgctgctggattcggtgtcaccatcaagcaatacttcggatcggctccatggacgtcccgcagctcttcctccctgcctcttgaagaattacagcagctgacctatcccagttcagtcttagatgcaatctcagggacttgcactgcctccagagcctctggaaacgatcctgagacgggtgactcagataggtgcggcttgtacatcgaagcaaatcctgcccgcctggttaccctggggaaagtttatgagggatccactattgttcataacactcctttgttgcttggccaagtaaaggtaggtgcgaaagaggttaaagatccaaatgctgcagttcctgtacccactgatgaggtttccttagttgggcagacaattcacaccttccttgcttggccgacacatctggtcaagtctttatcacaacagcttgttgtgtcttcggcaaaaccacctgaaaagtcggatcccgag

SEQ ID NO: 34697 - DNA, 438 bp, Glycine max
  Peptide Sequence Number=SeqID_126382
atgtctcaggcttcatccttctcagtttctgttttaccgggggacactcgggatttaggggtaatcggtgttgtacaatgtcagaactcaaaccgggcatatcttagcagggctgttaattcttcacggatgggtgcggccatacccgtgcctatctttacttccctttttccactgccagttcccaagttactagttctgtctcttcttgatgaggccccatttcttgatcctcgtgggcgactatcctttccaagtccaggggaagtcccacatcctcgttctcttcatcttctgtttgattcgtttcttgctcgaagtcgatgggtgggtcccaggtttacattatgcttgtcgcgtaaatgtccaggcgctcctccactcgccaatttcctagtcggaaatcaggagggcatggtcgtaccggggatcctctag

SEQ ID NO: 34698 - DNA, 543 bp, Glycine max
  Peptide Sequence Number=SeqID_126383
gctccaaggccaaatgatgcaaactcatcgtttatcagtgatgctgacggtaacaccagttgggctcctgccaatggctgtggctaccaaagctcttataacactcagcgcatagcgcaaatgtgggttaccactggcggagctggctattgccgatttctgttaaacacgaatcctcaaactgcaaaaacagatgctccgtggactgtatttcagtcagcaggaacatcggacattaactttaagaaagtgaccggggatctggatctaaacgaatcgctgtcaaacatcgaggcaatggattttaagaccttctactaccttgctgatgaagagaaagccattcggcgcggcgttattgctcaggagttggaaaagatagatccgcaatatgttcactcggctgaggagtcgggaaaaatgacactcgacctcaatcctctggtgctcgatgcgctggcggcaatcaaagcgctggcaatccgcgtaagcgcattagagggagacgctaagcctcccgttcctggctcattcgctggttaa

SEQ ID NO: 34699 - DNA, 695 bp, Glycine max
  Peptide Sequence Number=SeqID_126384
atgccagcttccgtacctcatcaggccgccggccgggcgcgcggcgagcaagcgcgccggcagctgctcgccgcggcgaccgacctgttcggcgaatatggcctgcagggcgccaccacccgcgatatcgcccagcgcgccggccagaacatcgccgccatcacctattacttcagctctaaagaggggctgtacctggccgtggcgcagtcgctcgccgatttcatccagcaggcgttcgtcccgctggccgaagaggtcgatcgcttctggcaacagcccgtcgcgcagcgctcacccgacgcggcgctgcgtttgctgcagcgtggcctgctggccttcagcgaactgatgacccagccgcacacgctgaacctgagcaaaatcatgtcgcgcgaacagctcgccccgaccgacgcctacccgctgatccacagccaggtgatcgcgccgatgcacgagcggctgtgccgcctgctggcggccgccaccggcatcgacgaacgcgccccccgcctcgtgctgcatacccatgcgctgatcggcgaggtgctgtcgttccgcgtggcgcgcgaaaccatccgccgtcaggccggctggcaagagattggcgagggcgaagcggcgcaactcgcgccggtgctgagcgagcatatcgagattctggttgttgggctgcgccaacgtcacggcgc

SEQ ID NO: 34700 - DNA, 816 bp, Glycine max
  misc_feature (506)..(506): n is a, c, g, or t
  Peptide Sequence Number=SeqID_126385
atggtagaagtctccacagaggccattgcctccctcgcccaatattatgataagccgttgaggtgcttcacctttggggacttccagctatcacccatggtggaagaatttgaagagatcctaggatgtcctctagggggaaggagatcatacctcttcttagggttttatccctcattagctagaatttctaagatagtccaaatcacggcgcagaaattagaccatagaaagcaagtagaaaatggggtggttggaataccgagaaaatgtttggaggcaaaagcaagaatcttggcagcgatcgacgcttttctcgcctatcatgaccacaaggaaagcccggttgtcgctatgctagccgacctatatggcacctttgaccaaagatgtgagaagagtagtatgaggatttgtttgctgtacttcggctctttatgtatggttggtttcacacctttttcgccaagaggatttccaaatgttcccttgatggggacaaaggnttgcatcagttacaatcccgttcttgctataaggcaacttggctaccctatgagaggggcaccactagaggaagagctcgcgcctgtcatttcacgaggtttctttaaaaccaacgtggagacacttcagaaagtccacaaggcatgggaggtggcgcaaaagaaggacaccgcactctggggcagtaacaatgggcccatcggtggctaccgtaagtggttgagagcccacgtgcaaggtttggattggctcccgagtttgagaattactaatagggaggaagttgaggcatcggaggaagacgaagag

SEQ ID NO: 34701 - DNA, 958 bp, Glycine max
  misc_feature (21)..(21): n is a, c, g, or t
  Peptide Sequence Number=SeqID_126386
attccccagtccgcgccgtcnacggttgccccgaaaacgctggcccagtggcaggcggtattaccgaatacctggcttaccgttcaccgtctgacgctttcaccctggcagcagtggcagggggaacttaacgcatcgctgaccccggcaaggcaggagatcgcctataaaggcgagcaggtcagcattcaggggacacttcgcgggcagacgctctccgttacccagttcgatgtgcagcttcctgaccagccgcagcccgttaagctggtgggcgagttcacgctgccgctggtgccggatggcgtgccggtgaagggccacgcggtggcgacctttaacgtgccacagctaacgtccctggtcgatgccgatctggactgggaagacaatcaggggcaactggtggtgatggcacgggacaatcccgaaccgctccttgacctgccgtggcagataaccgcagagcagctggacatcagcgacggacgctggaactgggtgctctccggcatgccgctgagcggacgcatttcgcttcgtgccgacaactggcagcaggggctggagaaggccaccctgaccggtcgactgaatgtgctgacccacggcgacgccgggaaaggcaacgcggtactgaatattgggcccggcaggctcagcatggaaaacagcgacatgccgctgcacctgagcggtgaggcgaaacagaacgatcttattctttacgcccggctgccggcaaaactgaccggcagcctgtatgaaccgcagctcgcctttgagcctggcgcgctgctccgctcgcgcgggcgcatcattgactcgctcgatatcgatgaaatccgctggccgctggcgggcgtgaagctcacgcaaaagggtgtggacggccgtttacaggctattctgcgcgcccatgaaaacgaaatgggggattttgagctccacctcgacg

SEQ ID NO: 34702 - DNA, 399 bp, Glycine max
  Peptide Sequence Number=SeqID_126387
atggtgcatggtgttggggctatagagtttattatatgccattcagaggtctcaattgcacttgcagaagagaagaagatacctgagctattcaagacatttccaaatgcaacaaagtatctcaagagatcaaactcagagcttgaacttcctattaagaaaatgatgtatacatatcttaccttcccactcgcacatactttttttaggaccattgaggagatattcatatggcatggtgcttcaattggtttctggcgtggggatgtcaaattgttaattgatgatgttggggaactaaaaccaactattttctgtgttgttccccgtgtgcttgatagagtgtactcaggtttgacacagaagatttcttctgggggcttcttgaggaagacataa

SEQ ID NO: 34703 - DNA, 510 bp, Glycine max
  Peptide Sequence Number=SeqID_126388
gactcagagtcctctgtcatgtatgcttttagagactattacagtctccctttgccttccagagacaagcaatctccccttgccatccagagacaagcgagtctgttggcacgtggagacaaaacatggtcatctgcaccctttttgatatccgaagacaatcaagtccgatggcacgcagagacaaacatggtcatccgcaccctttttgctatccagagacaatcaagtctgatggcacacggagacaaacatggtcatccgtaccctttttacaatccagagacaatcaagtccgatggcacgcggagacaaaacatgaccatcaaggtcatccgcacccttttggctatccagagacaatcaagtccgatggcatgcggagaccatcatggtcatccgtgccctctttgctatccagagacaatcaagtccgatggcatgcggagaccatcatggtcattcgctttcattgttttcgagactattttagtctcctttgccatctag

SEQ ID NO: 34704 - DNA, 297 bp, Glycine max
  Peptide Sequence Number=SeqID_126389
atgatgataacaaaaggtgatgacaaaaagctcaaagatcaatcaaagaacaactcaagtgaatcaaagatcaatcaaagaacaactcaagtaaatcaaagatcaatcaagaacaattcaagagttcaagctaagaatcaagaagaattcaagactcaagaagaaagtctagagacaagaatcaagattcaaggttcaagatctcaagaatcaagatcaagattcaagactcaagattcaagaatcaagagaaggcttaatcaagataagtataaaaagtttttctcaaaaaattga

SEQ ID NO: 34705 - DNA, 282 bp, Glycine max
  Peptide Sequence Number=SeqID_126390
atggaaaagtgtcctgtgaagttgcagaccaaatttcgagaatatccaacgaccaaatttcgaaaagatccaacggttagcgaaggctgggcagcgtttttacccaggcagcttcatgtagctttctctagaagcttcattaagaggcttctagcacactccaaatatctactcaaagatcccaatggtcagatcatggacaagtgtctagtgaagttgcagagcaaatgtcgagaagatccaacggttaacgaatgctggacagcgtttttacccaggcag

SEQ ID NO: 34706 - DNA, 624 bp, Glycine max
  Peptide Sequence Number=SeqID_126391
gagtttctgttttcaatttcaagcatctcgatatattacgggactcaatcggacatccgagtcaaaaagttattgtcgtttgaatttgctcagcttctgttttcaattacgagcgtctcgatacactacgggacacaatcggacactcgagttaaaagtttattgtcgtttgaatttgctcagagcttctgttttcaattcgagcgtctcgatatattacgggactcaatcggacatccgagtaaaaagttattgtcgtttgaatttgctagaccttctgttttcaatttcgagcatctcgatatattacgggactcaatcggacatccgattaaaaatttattgtcgtttgatttgctaagagccgctgttctaatttcgagcgtctcgatatacttcaagactcaatcggatatccgagtaataagttattatggtttgaatttccaacgagccttcgttttcaattatgagcgtctcgatatattattggactcaataggacatccgtgtaaaaatttattgtcttttgaatttccaacgagcttccgttttcaattacgagcgccttcaatttcaaacgtctcgatttactacgagacacaatcggacaacccgagttaa

SEQ ID NO: 34707 - DNA, 928 bp, Glycine max
  Peptide Sequence Number=SeqID_126392
cccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccggctcgcacgtgattggtctcgagcgtggctcatccaccatttatcacggcgaagtcggccatgaacccagatttcaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatcgccggggtttgtgtttgtacgcgaggacgaggaggccgggcgcacggggcgccgtggtcatcccctccctcccgacg

SEQ ID NO: 34708 - DNA, 240 bp, Glycine max
  Peptide Sequence Number=SeqID_126393
atgcaaaggggtgcggataatcgtaagaatgaccaaacttggtctctgcttgtcatcgacacctgtgctctgaatgacaaaggggtgcggataaccgtaagaatgaccaaactttgtctctgcttgtcatctgctctggatgacaaaagggtgcggataaccgtaaggtatctccgcgtatcatgggtgcagaatgaccaaacttggtctctgcgtgccatcggacacgactgtgtctga

SEQ ID NO: 34709 - DNA, 216 bp, Glycine max
  Peptide Sequence Number=SeqID_126394
atggagaattcgtccctaacagtcaaccacttaatccaaccctatttcaatttactaagcgaaaatcaacttaggggagaactgccaggaaaccacattacaagcggaaacctcaaagagagttgggctttgtcctcaaaaggaaacaacaccagaaaatctagccttccatggattcaaacagaaaacgcaatgaaacatgaagcagaaacgtaa

SEQ ID NO: 34710 - DNA, 147 bp, Glycine max
  Peptide Sequence Number=SeqID_126395
atgaaaatacctgaaacaaaatgtggaccaccacgggaaaataggggagaagcttgccgccccagctcgcccaggcgagccaggttgcttcctccagaagcaacagccttctggaggaatcttctggaaggccccaagtgggcctga

SEQ ID NO: 34711 - DNA, 330 bp, Glycine max
  Peptide Sequence Number=SeqID_126396
gcggctggcgcggtggtctacaacgctgccagcgtgctgcgcgatggcctggtcgaacagacctaccgcaagcgtgaactgcccaactacgcggtgttcgacgagcgcgttcgctacttcgatgtcgatccggatggcggcagctgcgtgttcgaggtcaacggtgtgccggtcggcctgctgatctgcgaggaatcctgtggttcgccgagccgttggcctgacaccgtgcgcgccggcgcgcagctggtggtggtgccgaatgcgtcgaccgtacgagcgcggcaagcatgcccagagcgatgcggtgctggttacgcgcacccgtga

SEQ ID NO: 34712 - DNA, 762 bp, Glycine max
  Peptide Sequence Number=SeqID_126397
atgcatgagggcagcacaatgcaacaacgtaaactgggttctcacggccccctcgtctccgccttggggctgggatgcatgggcatgagcgacttctactccaccggcgccgatcggcaggaagccatcgccacgctgcaccgggcgctggagctgggtgtcacgctgctcgacaccgccgacatgtatggcccgcacaccaacgaggagttggtgggggaagcgatcaagggcaaacggcaacaggtgttcctggccaccaagttcggcatcctgcgcgatccggcggatccttcggcgcgcggcgtcagcagccggcccgagtatatccggcgctcggtggaaggcagcctgcggcgcttgggcgtagaagagatcgatctttattatcagcatcgggtcgatccgcaggtgccgatcgaagacgtcgtgggcacgatggcggatctgatccgcgaaggcaagatccgccatatcggcctgagcgaggcgtcggtcgccacgctggagcgggcgcacaaggtgcatccgatcaccgcgctgcagaccgagtattcgctgtggacgcgcgatgccgaacagggcgtgctggcggcctgtgagcgcctcggcatcggctttgtgccttacagcccgttagggcgcggtttcctcatcggcgctatccggcggccggaggatctggccgaggacgatttccgccgcggcaacccgcgcttccagggggaaaacttcgcccgcaacctggcgctggtggagaag

SEQ ID NO: 34713 - DNA, 274 bp, Glycine max
  Peptide Sequence Number=SeqID_126398
atggcgctggtctgcgaaggcggcggccagcgcggcatgttcaccgccggcgtgctggacgagtttcagcgcgcgggctttaaccctttcgacctgctgatcggcacgtcggccggcgcccagaatctgtccgcctacatttgcgggcagatgccgctggcgatggacgtagccggaacggcactttaccgacggggcgcgagtttctgctggtgcgccttccgcaacgacgatttccaaaccgacctatctgccggcgcagcgcggagcgctg

SEQ ID NO: 34714 - DNA, 351 bp, Glycine max
  Peptide Sequence Number=SeqID_126399
atgtggaaaatagacaacatttattatttttacacagttcaagaaaaaacgtacacacaaagtttcataattccacactttcctaaactaggcctaactcacaaaaatagttcccggtggagtcgccaactgtcgcaacctaccttttggcgggagggcaacgcggggctcgcgagtgtgtcttccatgaaaggaaaatgcgcggagtcgccaccaacgtttattcgaggaaaacgtcgaaaaaaccaaaggaaaccggtcatgaagcatattccagattcgggagttatctttacgtttgaggaaggtattagcacctctcacgtttgtcccaaaggacaacagccttag

SEQ ID NO: 34715 - DNA, 240 bp, Glycine max
  Peptide Sequence Number=SeqID_126400
atggaagtaagaggcaaggttgaactctttccatataggggcctagatgagctagttcaactttgtataagggtagagcaacaattaaagagaaagccatctcctaaaaactctacctcttactcttatacaaagaaggaccaagctccaagtgtgttaggagtaccaccttctaagccaaaggatgataaggcacaaggttggtacccaagtggagtctcaatatcatttcccacctaa

SEQ ID NO: 34716 - DNA, 312 bp, Glycine max
  Peptide Sequence Number=SeqID_126401
atgtctcctccacccctagagactcataatcactcacagactcatctcatgctctcaagatggccttcacttctcgctcagttctctgccagtggccttgtttgtgcttgtgcgcttagtgcaactttggcttgcttagctcgcattagtgaatttcggcttagcgcgcgtcttctcactcagcagatggactcaagcggtgcgcttagtgggatgagccctcactcagcgaacatgcacagctcatccttcttccagattcttccttgcactcagccaaaggagtgttgcgctcagcagatggctcactaa

SEQ ID NO: 34717 - DNA, 606 bp, Glycine max
  Peptide Sequence Number=SeqID_126402
atggccccgaggaaacttgcctcaaagagatccaggaaggataaggcggccgaaggaactagttctactcccgagtatgatagccaccgttttaggagcgctgaacaccagcagcgcttcgaggccatcaagggatggttatttctctggaagcgatgcatccagctcagggacgacgagtataccgatttccaggaggagatagttcgccggcggtgggcatcactggttacccccatggccaagtttgatccagacatagtccttgaattttatgccaatgcttggccaacagaggagggcgtgcgtgatatgaggtcctgggtgaggggtcagtggatcccgtttgatgcggatgctatcggccaactcctgggatatccgttagtgttggaggagggccaccagtgcgaatatggccagaggaggaaccggtctgatgggttcgatgaggaggccatcccccagttgctatgtataccggggcaagattttgcccggactgctgtcgagagacgggtgcggatcatgcgcaccaacatgaccaccctgactcagatatggatgactttgctgctcagcaacatcctgcccagcgacccataa

SEQ ID NO: 34718 - DNA, 324 bp, Glycine max
  Peptide Sequence Number=SeqID_126403
atgggtgccaagcacctcacaaggaccaaagaaaggtcgcatgtcatcaagcaaaggtccccggacgaaattagggccgaaaggcatcctcctataggcaaaagtgccgaaggggcaggtgaatgtggtcttttcctgatcctcaagagcaatagtgatttgcatataaccagaaaaaccatcaaggaaacagtagtgagatttacctgcctggcgttcaagcatctggtcaatgaatggcagtggaaaatggtcctttttggttacatggttcagcctcctatagtcgatgcaatactctccaactattctacacccgagtag

SEQ ID NO: 34719 - DNA, 750 bp, Glycine max
  Peptide Sequence Number=SeqID_126404
atgtcacaaaggggatcgttgatcccaacacatattcaaccagatatacatgggttagtagcacgagtgagcacaaaagggagcaatgcggagagtgttgtcaacccatgtctgcctaatgatgttgctcctgtcgaaccccctatagggttgtatgtgccacgccaagattcaattgagttggtggccttgggaaaaacatatgatggaggctcgaccatacacaatgtggcttatgcagacgatgtcgtaagggttagtgttgagcaagttattgacggtgacgctgaggtcccattcccgacatcagagattaagtgtgtcaggcaggcccttcacacattcattgcatggccaacaccacttcatgagggcagtagtccaactaaagacactgaagctgttgaagcggtcaatgatgttgttgtagatgaccccttgcacgagttgattaagagcctagttgacatttatgagaagcctgtagagttagtgtgggatgctactaaatttggaattccaaatgcaactgcatcattgttcgtaacctgtgctgatgtgaatgaaataatatcaggcgtacaatgtttgaacatagctatactacaattgtatatggacccattgagtcaaagcgacgatcaaggatcggtgtatggattccttgagtcgcaggctatactgaatgcaaacgataaacgtggacaatgtcaagaatacattgaaaaatggctaaaggaatcgaactga

SEQ ID NO: 34720 - DNA, 561 bp, Glycine max
  Peptide Sequence Number=SeqID_126405
atgtacccaaatatgcaattgaggtatgtagatattgtcgatgaggcatttgaggatttaaaaaacaagcgcatagatgcgtatatcggaaatgaattggtggttgattatcacgctgaatttcatcgattgtcgtatgcaaaaaaatcctctttaacgacattcaggtctgcggtgagtatggctgttaggaatgaccaagtcttactgctatcaatcattaataagtcattggctaaaatagggcccaataatcccaaaattctagattactggaaaacgcctcattcaccgatcagtagcttggaaaaaattttactggcactccttatcttagcttttgtaggttcactagtaaaacttctctctattcgaaaaaagtctaagtctgaagcaattgaacatcaaaaaaagatttggcatgaggcaaactatgatcgcaatactaaacttccaaaccgaaatttttttgagcgaaaaatcaaagaggttgttgcagacgctaagcaagacaaaaccgcttttgcagtgatgtttattgatttggatgattttaaatat

SEQ ID NO: 34721 - DNA, 651 bp, Glycine max
  Peptide Sequence Number=SeqID_126406
atggccacaatgatggaggccatgacgagcatgaaaaagatactggaagccaatgcggttatagttgccgctaccagcactgtcgctaaggcgaacccaatgcccccatctggcctcaagcaaatgtatcatccaacctcagatatggtaggcaaagatttgggaagtacggatgaccccatgatgtgcaaattcaaaacaagcatgccttcccgccatatggcttgcctcccaatgtggcgtacactcccaatgaggatgtcaataactctgctcccatactcattgagagccaacaaccccaaaacagatcatgcacatgtctctcaacccatgggggaggcacatgaaattccccaccacaatctagccgacttcgagccttgcctcggatatgccactgaagggcaagcagttggtggtatacccatgccaaacactttgaagggccctcagtttcgcccacaaccacaacccttgcattttgcggtggtaagagcccctcctgctatgcctgaaaagggaaaggtgccggactttgacaagtacaaggggactacttgctccaagaaccatctaaagatgtacttcggacccccccccatgggggcatacgcaaaagatgagaaactgctgatacatttttcctaa

SEQ ID NO: 34722 - DNA, 312 bp, Glycine max
  Peptide Sequence Number=SeqID_126407
atgaatctggggatcccacagtcatgtggctccgcatgccaccggactcttgggtcacgcatttcgtttctaaatgaccatttagaggaagcactgggttcaacaaaaaataggagaaaatcactcaaagtgtatcaatctcacacatggcaaggattgacattctcaccctgggtcaaggtttatgataagttgggattttggctcaaggcttgtagaacggctggtcatgatatatgtcagggtttggccagcggttcggggataaaggggatgtcctacattatttccatgatacacatgcaacaatga

SEQ ID NO: 34723 - DNA, 380 bp, Glycine max
  Peptide Sequence Number=SeqID_126408
actcttacgagtctacaagttgagtctacgagtcgagtctatagaactctcacgagtctgcgtaaactctcgagtttgataaccttggctgagacagcactgacacgtggggcatatgtacgactaggatgggttcgaggcatttatgagacgagatgtcaggctcggcggtggattgtagcagctcgcgcttatctgctgcaccttgtcggttgcactctttttgctaataagagtgcaacatatgtgcatgtggttcaccttgacgtttttcgagacctcgctcagagtggtggttatgctttgggagttgttgcgctggttcatatgtatgaccagttagatgaggcttgtaggaacaccaaacgacagcttgcggg

SEQ ID NO: 34724 - DNA, 107 bp, Glycine max
  Peptide Sequence Number=SeqID_126409
atgggaccaactcttttatttcaaaaaggaagtcgtatccagtcaaggtgtctgccatcgccttggcattggctaacaagcggggaagttcttgactcccgttcaag

SEQ ID NO: 34725 - DNA, 448 bp, Glycine max
  Peptide Sequence Number=SeqID_126410
atggcacgcagagacaaaatttggtcattctgcacccttgtgtcatccagaggcggcgggcccgatgatacgcggagataccttacggttatccgcacccttttgtcatccagaggcgagacaaaatttggtcattctgcacccttgtgtcatccagaggcggcgggctcgatgatacgcggagataccttacggttatccgcacccttttgtcatccagaggcggcgggcccgatgacaagcagagacaaaatttggtcattctgcacccttgtgtcatccagaggcggcggacccgatgatatgcggagataccttacggttatccgcacccttttgtcatccagaggcggcgggcccgatgatacgcggagataccttacggttatccgcacccttgtgtcacccagaggcggcgggcccgatgatatgcggaaatacccgagtg

SEQ ID NO: 34726 - DNA, 124 bp, Glycine max
  Peptide Sequence Number=SeqID_126411
atgtggcatttacctctcaatgagctggtgaagaagaatgtggcatttacctggggtgaaaaacaagaggaagcctttgctttgctcaaagaaaagcatactaaggcacctgtattgttacaag

SEQ ID NO: 34727 - DNA, 303 bp, Glycine max
  Peptide Sequence Number=SeqID_126412
atgacagcggaatggagaaggaagagagagaggagatgccacttcaacgagaagatgagtctagaagaagctcaccaccataggaggccttggataagagcttggaggaagaactctagcccaatcctcttggagcctcttgctcatgggtctagtgactggtcccttccttgggaggattgcatcaacaatgaaacctcatctagagtttttatctttgatgatacgttgtcattggtagtccctaccaccacaatgtttgatatcaaaagggatgatatctctagaaaccttggaagctag

SEQ ID NO: 34728 - DNA, 222 bp, Glycine max
  Peptide Sequence Number=SeqID_126413
atggtgactgtgggtgatggagaaatagcttggaacgttgaaaacggtttgggaagaaagaaaggagaagaaatgacatttttccaaagctacttggactacaaggctcaaaacgcgcaagtgagcaatgctctcggaaacggaaacttctcgcacactctacgcatcttctccaagatcccaacggtagcttcatgtagcttccttgagaagcttcattaa

SEQ ID NO: 34729 - DNA, 513 bp, Glycine max
  Peptide Sequence Number=SeqID_126414
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgacggcgcggtcggcgacgatggcgttggctttgacagtgctggtggtgcagtggtggtggctttctttggagaaaaggaagaaggatataatatgacactccgtctgttatatcatcacttaacagaatga

SEQ ID NO: 34730 - DNA, 207 bp, Glycine max
  Peptide Sequence Number=SeqID_126415
atgcagctcccggagacggttcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34731 - DNA, 441 bp, Glycine max
  Peptide Sequence Number=SeqID_126416
atgcgaggtaaaattccagcaggggatttagctccattagacttggagattgaagccacttgcaggaggaacaatgcagaaaagaggagaaaagctttacaagagaggacagtccggccaagcaccgagagaactctttcatccgaatcatcttcattatttccaacaaacttgagggaattcgaagttgttgcatctgaagctcacatcatggcggacaaccaaccacaaagggctactcttgaggactactccagctctactgtgccgcaatttttcacaagcattgcgcggccaaaagtccaagcacacaacatcacctatccacattccttgattcagcttattcaaggaaacctattccatggtctgcccaatgaagacccttatgcacaccttgcaacctacatagagatttgcaatacagtgaagatcgcagag

SEQ ID NO: 34732 - DNA, 735 bp, Glycine max
  Peptide Sequence Number=SeqID_126417
atgcctttcaacagcctttacggggcagggcgctgccagattatcaacaacggtatcgacgtggcgacggaagccattctggcggagctgacgccggtggcggacaccgcgggtaaaccgaaaatcgccatcgttgcgcatgacctgcgttacgacggcaaaaccaaccagcagctggtgcgcgacatgatggcgctcggtgacaagattgaactgcataccttcggcaagttttccccgttcgaaggggcgaacgtcgtgaaccacgggtttgaaaccgacaagcgcaaactgatgagcgcgctgaacggcatggatgcgctggtgttcagctcccgcgtggataactacccgctgatcctctgcgaagcgctttccatcggcgtgccggtgattgccacccacagcgatgccgcgcgtgaagtgctggaaaagtcgggcggtaaaacgttctcggaaggggaagtgctgtcgctggtgcagatgccgaaagcgcagatcgctgagactgtttttggcactgacctggaatcgttccgcaaccgcagccgcaaggcctacagtggacaacagatgctggaggacttcccgataaccatcgtcactttcttgcccgttctgcttctgctgtatgtcgataaaatcaacctgaagaagctgatgattgccctggggttgggcacgggcctgacgctgtttaactacatctttggccaagtcgctggatgccagtaa

SEQ ID NO: 34733 - DNA, 267 bp, Glycine max
  Peptide Sequence Number=SeqID_126418
atggcatacaccaactggcacttaggtagagggaggtcgaagttgtggtcgctaagcagcagtgtcatccacatctgggtcaaggtagtcatgcgggtgcacatgatccgcacccgcctccccgcagcggtccgggcgaaatcctgccccggtatgcacagcagctgggtgatagcctcttcatcgaagtcgtctacctggttcctcctctggctgaattcacactgctggttctcctccaaaatcagcgagttgcccaagaactag

SEQ ID NO: 34734 - DNA, 318 bp, Glycine max
  Peptide Sequence Number=SeqID_126419
atgtctcttgttacactatttggaaagttacaggaacacgaaatggaactgttgagattaaatcaacacgaagaaaatgataagaaaaagaagggaattgctcttaaagcttcatcttcaatccaagaagaaagtgatgaggaagacttaattgatttgaatgaagatgatgatcttagcctttttgttaaaaggttcaataagttcctgagaatcagaggaaatcaaaggaggccaaactttaaacctaaaagaaggacagaagattcatcctctactccaaaatgctttgaatgcaatcaacttggacatctgagg

SEQ ID NO: 34735 - DNA, 369 bp, Glycine max
  Peptide Sequence Number=SeqID_126420
atgaccgccagcaaaggaaaacccatttttgaagtagttctttctttgggatttccgttcaaagtcgctctcgactggcgatatcccgccccacataaacaaagaggaaaagaccaaaacacccagcttcctctccaaaaagtcactaccttcgagaagatcctattggtccgtgatcctgcgtgtgatcttttggtgaaagaacctggtgcaccattcggtcccgccaataaatcttatccgaagccccatgaattgattgtcattcatgcatcctccaccatcgagtctggagccccacgaattgattgtctagcactgttcatctatcctccagcctcaaatcttattcggagacccatgaattga

SEQ ID NO: 34736 - DNA, 285 bp, Glycine max
  Peptide Sequence Number=SeqID_126421
atgcagcgatcaaaacacgatgtccatcttggagcctacttgaatgggtcagacaactaccttaaagggataattaacagtgctttaaaaggtcttgatgatgctccacagcctaaatcaaaggctcctgctaggtggattgtcgtcaagtgtaatagacaaaaaggaaatactgagtgcagctactatgtcatgcactggatgtccaccatcattttaggaagttttaggaataattgggaagcgtattttaacgatcctagaccattggagccagagagataa

SEQ ID NO: 34737 - DNA, 174 bp, Glycine max
  Peptide Sequence Number=SeqID_126422
atgtggaccaccacgggggagaagcttgccgctcagctcgcccaggcaagcaaggttgcttcctctagaagcaacagccttctggaggaatcttctggagggcccaagtgggcctggttgctatttgcaccccccctttttactaaatgcaacccccttctatttttttggtaa

SEQ ID NO: 34738 - DNA, 141 bp, Glycine max
  Peptide Sequence Number=SeqID_126423
atgacagtcggcgttggccaggaaagacgaccgatcgagggattgaatagaataaacatggccggtgtcggtcgttatatggccccgactgatatctttcagcctacattgcgcaatttcttttacaacgctggccgataa

SEQ ID NO: 34739 - DNA, 279 bp, Glycine max
  Peptide Sequence Number=SeqID_126424
atgtttgtcggcagttcccctcttgaaaactacactgtaatttacaaaacaaaagttgaaaggaaagatattgacctgatagatgaggaagaagcacagattggtgctgaagcactagaacatacaaagaaaagagatacaggccatcaaagtgtgtcattggacaatgagacaggagattcaactatgctgaagatgggagattcagctaaagttgtgataaaacaagacatgaatggaagagagcataaatatgggtttaacaacaatgaacgttag

SEQ ID NO: 34740 - DNA, 672 bp, Glycine max
  Peptide Sequence Number=SeqID_126425
ctcctgagtttgagaaccgctaaaagggaggaagttgaggcaccggaggaagacgaagaggtgcaggcccttagggcagaactcgagcaagcccaaacagtcaaagaaaagttcaaatcaacaactcttaaaatccgaaaggagaatgccaaactaaaagatataaatatagctaccaccaaggccttggaacaagagactaagagggctcgtagggaagagcacggccgaaacaagtttcgaggggctctgtggggcagcaacaacgagcttaagctccggagagaggaaagaaaccaatcacgagtacatagcatggtcttaaaggaggagttagctgcttgctcaagaaccaagaagagtttggcccaacacttagaagccacggagcaaggcatgctagctataatagggcagtacaaagaagagttaaaccagtctttgacccatgagcaaaagctagtagaggacttcgcacaagcatacaccgagaaggaagcaagagggagggtgattgatgcattgcatcaagaagcgaccatgtggatggataggttcgccttgaccttaaatggaagtcaagacctcccgcgactactagccaaagcaagggccatgaccgaagtgtgttcagcctcagaggaaattcacgggctaatcaattactgttaa

SEQ ID NO: 34741 - DNA, 291 bp, Glycine max
  Peptide Sequence Number=SeqID_126426
atgaaggctcgggatggcatgcaccaactggcacttaggcagagggaggtcggagttgttgctgagcagcagtctcatccatgtctgatgcgcatgatctgcacccgcctccctgcagcggtccgggcgaaatcctgccccggtgtgcacagcagctgggtgatggcttcctcatcgaaaccgtcggccttgttcctcctctggctgaactcacactgctggccttcctccaaaactagcggctcgcccaggaactggctgagggcatctgcgtcaaagggaatccactga

SEQ ID NO: 34742 - DNA, 432 bp, Glycine max
  Peptide Sequence Number=SeqID_126427
atgaagaaactgataagaagaagaagggaatcgctcttaaagcctcatctgcaatccaagaagacagtgataaagaagattcaattgacttggataatgatgaaagatattagtctgtttgtaaaaagattcaacaagttcctgagagtcagaggaaatcaaaagctacccaattttaaacctaaaagaaggacagaaacttcatcctctacactaaaatgctttgagtgcaataaacctggacatctgagggttgattgtcccatcttcaagaaaaagatggagaagtctgaaaagaaaaatattaatgaaaagaaattgaagaaagcatacattacatgggatgaaaacgatatggaatcttctgaagattcagaaaatgaagaaataaacctctgccttatggcaaaaagttatgaaagtgatgaagag

SEQ ID NO: 34743 - DNA, 189 bp, Glycine max
  Peptide Sequence Number=SeqID_126428
atgggtcaatcatttgcttcattggtttcaacggtggcagctgcggaatccgctattgggttagccattttcgttatcactttccgagtccgagggactattgctgtagaatttattaatagcattcaagggtcagggccttttctcgctgggcgagcgcatccgattgattcgaaagtcctttcctaa

SEQ ID NO: 34744 - DNA, 306 bp, Glycine max
  Peptide Sequence Number=SeqID_126429
atgaagaaggggtttcagtttgcagggtatgataaagccaccataggaactataactcttgactgtcaaagtccctatggagagaagcgtaaccgatgtgcccttctaccacctaatgttcctattcttgctcattccttagaacgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34745 - DNA, 373 bp, Glycine max
  Peptide Sequence Number=SeqID_126430
atggaggccatgaaagagcaaatggccgcaatgatggaggccatgataagcgtgaagaagataatggaagccaatgcggttgcaattgccgctaccagcgttgttgctaaggtgaacccgacgtccccatctggcctcaaccaaatgaatcatccgaccttagatatggtaggcaaagatttgggaagtagggacggcctccatgatgtgcaaaatccaaacaagcacgccttcccgccacaaggcctgcctcccaactatacaccacccaatgtggcgtacactctcaatgagcatgtcaataactccactcctatacccattgagagccgacaacccctaactgttcatgcacatgtctctcaacccatgg

SEQ ID NO: 34746 - DNA, 517 bp, Glycine max
  Peptide Sequence Number=SeqID_126431
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaggagaaaagtgttgtgtctcaagcagtttagccggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34747 - DNA, 431 bp, Glycine max
  Peptide Sequence Number=SeqID_126432
atgaccaaacttggtctctgcttgccaacggacacggctgtgtctgaatggcaaaggggttcggataaccgtaaggtatctccgcgtatcataatgaccaaacttggtctctgcttgccaacggacacgactgtgtctgaatggcaaaggggtgcggataaccgtaaggtatctccgcgtatcataatgaccaaacttggtctctgcttgccaacggacacgactgtgtctgaatggcaaaggggtgcggataaccgtaaggtatctccgcgtatcataatgaccaaacttggtctctgcttgccaacggacacgactgtgtctgaatggcaaaggggtgcggataaccgtaagggtgcggataaccgtaagggtgcgaataaccataaggtatctccgcgtatcatgggtgcatgtcacatgacctcagg

SEQ ID NO: 34748 - DNA, 727 bp, Glycine max
  Peptide Sequence Number=SeqID_126433
gtaatagtcttaagacatgggatgaagttgtggagaaatttgtgaagaaatatttccctcagtctaagattgcagaaggcaaagctgccatctcttcttttcaccaatttcccgatgaatctttgagtgaggccttggaaagattctgtggtgggaaaatcaaattgaagacccctgaagaagccatggatctcattgaaaatatggctgcaagtgacattgctattttgagagatagagctcacattcctaccaaaaagagtttattggagttaacctcccaagatgcattgttggcacaaaaaaaattgttgtctaagcaactggaagccttgactgaaacactaagatgtaccatctgtgggggagctcatgaatctggatgttgtatagctattgaagaacaccccactcgtgggccatccacaaggccacaacaacaagggcctagtctctatgatcgaacaacgaagctggaagagactctagctcagtttatgcaagtttctatgtccaaccagaagagcacacagtctgccataaagaattttgaggtccaagtaggacagcttgcaaaacaattggcagatagatcatcaagcagttttacacctaatacagagaaaaatcccaaggaggaatttaaagctgtgatgactagaagtagaatggcaatccaaggagatgatagtgaagctggaaagaagatggaggaacataaacaaca

SEQ ID NO: 34749 - DNA, 391 bp, Glycine max
  Peptide Sequence Number=SeqID_126434
gatttacatgcgattctcctcaaatttcagccagcccgcatcaattagatcttacgctttagagccctacaatgctcaatggaacgccccggggcttctccgtgacaagcacacgttgcgttcgaattgtattctcggagaaatggaggttgatgaaccttggccggggctttctcgctgcaaaattcatttcttggttggtgttttggtttatgctaaagggatggcctttgtggatgactgggtggtgggtaatgagaagggttgttataggctgagtaatgacattgttggacccacttcgatcatttcgccgatgaagaccaaatccacaaagcttgaaggtgccactggagttgccaggttctccacctttgggcgtattctttga

SEQ ID NO: 34750 - DNA, 357 bp, Glycine max
  Peptide Sequence Number=SeqID_126435
atgagccttagcatgcaggagccagggcttcgctcatttttcatgccctactccagaccagttcagggcagagtttgcatggcccggagatttggcccgaggcccaagcaggagaggcacccccagaagctcccggcgatggagaagaagcccacgaggatgaggagatgcctgatttgcttgacttcttgggagggagtggagacacgtgactgggagatccccagattcatggtgaatgctgtgaaatttcccggacgcccgaaatggactcggatgaatgcacaaattgataaaagaacatattttggaaacattgggttgattaaaaatagaggaaatgaacctgagccctag

SEQ ID NO: 34751 - DNA, 306 bp, Glycine max
  Peptide Sequence Number=SeqID_126436
atggtcatccgcaccttcgccatccagagacaagcgagtctgatggcatgcggagaccatcacgactattacagtctcatttaccttccaaagacaagcgagtccattggcatgcggagaagaattatggtcatccgtttccttcgccatccagagacaagcgagtatgatggcatgcggaaaccatcaaggtcatccgtttttgttgtttttttaagactattacagtctccttctccatccagagacaagcgagtctgttggcatgcggagaccttcatggttatccgctttcattgtttttaa

SEQ ID NO: 34752 - DNA, 768 bp, Glycine max
  Peptide Sequence Number=SeqID_126437
atggagaggagtatgattgatgctgccagtggtggagctcttggtgatatgacccctactgaagctaggaatttgattgagaagatggctttcaactcccaacaattcagtgcaagaaatgatgctattgtccttagaggagtccatgaggtggccacggattcatcttcatctactaaaaataaaaagcttgaaggaaaacttgatgccttggtcaacctagtaacccagcttgccatgaataagaaatctacacctgttgcaagagtctgtggtctatgttcttctgtcgatcaccatacaaatctctgtccttctttgcagcaatctgaagtcaatgagcaacttgaagcttatgctgtaaacatttataatagacctcctcagcagcaaaaccaacaacaacagaataattatgacctttcaagcaatagatacaatccaggttggaggaatcatccaaatctgagatggacaagtcctccacaacaacaacagcttgtccctccttttcagaatgttgctggtccaagcaagccatatgttcctcctccaatacaacaacaacagtcacaacaaagacaacaaacaattgaggctcctcctcaaccttccttagaagagttagtgagacaaatgaccatccagaatatgcaatttcagcaagagacaagagccttcattcagagtctaacaaatcagatggggcagatggctactcagatgaatcaagctcagtcccaaaattctgacaaattgccttcataa

SEQ ID NO: 34753 - DNA, 267 bp, Glycine max
  Peptide Sequence Number=SeqID_126438
atgacggtgaaacctctgacacatgcagctcccggagacggtcacagcttgtctgtaagcggatgccgggagcagacaagcccgtcagggcgcatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 34754 - DNA, 51 bp, Glycine max
  Peptide Sequence Number=SeqID_126439
gaggtttccggactatggaaagctaaatcctctgttggatcttccctgtag

SEQ ID NO: 34755 - DNA, 267 bp, Glycine max
  Peptide Sequence Number=SeqID_126440
atgttgctaagtagcaacgtcatccatatctgtgtaagagttgccatgttggtgcgcatgatccgcactcgtctctttgtagcggcacgggtgaaatctcgccccagtatgcatagtggttccccactagcctccctctggttgtgctcgcacagttggcactcctctgagattaggggggtgaccaagggactgataaagggaaactactggcccctcacctgggagtgcaagtctcggttaagcattaagggcagaggaccttaa

SEQ ID NO: 34756 - DNA, 904 bp, Glycine max
  Peptide Sequence Number=SeqID_126441
aggactacacgttctcgccttcagaggactagatgtcctcatctttagaggactacacgtcctcgtgtttatagggctacaagccctcgccttcagagggctacacgtccttaccttcagagggctacacgccctcactttccatggacaacacttcctcaccttcagagggctacacgtcctcaccttcgtaggactacacgtcctcgcgtttatagggcttcacgtcctcgcctttggagggctacacaccctcgccatcagagggctacacgtcctcaccttgagaaggctacacgccctcgccttcagagggctgcacacccttaactttcgagggctgcacgccttcgccttcaaaggacaacacgtcctaaccttcagagaactacacgtcctcgccttcagagggctacacgccctatcctttagaggactacacgtcctcgccatcggagggctgagtactacattagttgcctttagagggctacacgccgtagccttcagagggctacacgtcctcaccttcagagggctacacgccctcactttcaaaggactacatgtcctcggcttcagaggacttcacgtcctcgcgtttactgggttacatgtccacgcctttagagggctacacgccctcactttcagaggactacacgtcctcaccttgagagggctacacgctctcgtattcagagggctgcacgccgtcaccttcagagtgctgcacgccgtcaccttcagaggactacacgtcttcgccttcagaggcctgcacgtccttgccttcaaagggctgcacgccctgcccatcagagggttgcatgccctcaccttccgaagattacacgtcctcgccttcagaggactacacgtcctcgcctttagaggactacac

SEQ ID NO: 34757 - DNA, 291 bp, Glycine max
  Peptide Sequence Number=SeqID_126442
atgacgaaagacaacgattggactacacgtcctcgccttgagaggactacatgtcctcgccatcagaggactacaagtcctcgccatcagaggacttcatgtcctcgccatcagagggctgcacgccctcacctccagaggactacacttaccctcaccgttgagaggactacacgtcctcgccttgagaggactacacgtcctcaccatcagagggctgcacgcccttacctccagaggactacatgtcctcgccttgagagggctacacgtcctcaccttgggtactag

SEQ ID NO: 34758 - DNA, 123 bp, Glycine max
  Peptide Sequence Number=SeqID_126443
atggcagatatgacggttcaggtgaacaacttccgaggcctttcgccagagtcactctggggagaggcactgaagattgcagcttacattctaaatagagtgctaaccaaggcaactgcctaa

SEQ ID NO: 34759 - DNA, 384 bp, Glycine max
  Peptide Sequence Number=SeqID_126444
atggcaagaactggtgacaatggtggtgtatatcatcaactggacgaatctcagcgcttatttctggacgcgtggactatacaaatgcaacgtttgttgaaccgtaacaaagaagagccctacagacgaatagtcaaatcttcctcgtttactcttaaacctctatcccctagagaagcatgtgatgaccaaatcagaatgagagaaaagagagaacaagagaaagaaaatagtgaggctccacaaaggaatatgaaaaagaagagtgatacacccgaggaaaagagtgatacacaaaagagagagagtgataattctaatcagaatttaaagatgtcttttccaaggagattcctcatggactgccaccttcaagaagcatag

SEQ ID NO: 34760 - DNA, 552 bp, Glycine max
  Peptide Sequence Number=SeqID_126445
atggaaaaatcgtcgaagaagcgaaaggggtcatcctccaccaccactgctgctggccatcgccgccacggaccatctgaagcacccataacacctattcatccttccttatcatctccaagatcatccactctgtttttttcagatgatcaacgtctacggtacctttctcaattttcttctaggatcattctagaccctaagtacctagacatagatttcttcaatgatgagacatttgactgttatcaagtgtttcaaaactctggattgattgatttcatgtctttaaaattgccttactatcctgaacttgttaaagtcttttacaacaattttaaaattcaggatggtattatttcttctgaggtgcatgatatttctatgatcattgatcaatctttgttcttttcgttgacaaaattactcagtcaatgtgcaccttttgagggcatcattgttgatgactggaaattcgattattctagtcatgatgctcaccgtatgatcgactgggctcacttagttcggtaccgtatggggatcctctag

SEQ ID NO: 34761 - DNA, 618 bp, Glycine max
  Peptide Sequence Number=SeqID_126446
atgttcgattatctcagcgaggagctgccggcactggtggcggataacttcaagctgagcgatcgccagtcggtaatggggcattcgatgggcggccacggcgcgctggtgctggcgctgcgcctcggcgggcgctttgcgtcggcgtccgcgtttgcgccaatcgtcaacccgaccgaagtgccgtggggacagaaagcttttaccgcctatctgggcgacgaccgccagacgtggcgcgagtgggatagctgcctgctgatgcagaacgctgaacatcgcctgccagtgctgatcgatcagggcgatagcgatcagttcctcgccgatcagctacgcccggagcggctggaagcagtggcgcgcgagcagaacttcccgctggagctgcgtatccagccgggttatgaccacagctacttctttatcgccagcttcgtggaagaccatctgcgcgattccgccaccagcccatcaatcattacctgcggcatgccctgtgagcagtgctcaatgcggccgcgcacgccatacacctgcgccagcgtctccggcgtaatcacctgcgacggcacaccgtcggccagcagttgcccctgcttcagcatcagcgcgtga

SEQ ID NO: 34762 - DNA, 450 bp, Glycine max
  Peptide Sequence Number=SeqID_126447
atgttctataaagacatatactgcctgaaaggaagctccgaaggaccttcaccaaagcaagtcagggtcagaggccacgtggtgaagattgatgtagacaacctcaacacctttttggagacatctgtggtactagctgagggtgaaaccttacccgcatattccaaatactgcgggttgcccgctgatattagagaaattaaggttgccttatgtatcccaagtcgggggtttgttttgaatgctgaaggccaacctgggaagattctcaggaaagatttaacaactcttgctcaggtatggagtgttctctcatactccaacctggctcctacttcccacacctcggatctgatagtagatcgagctaggctgatctttggcctagtctctcagatggacatgaatgtgggagctctcatctctggtcagattgcatctatggcctag

SEQ ID NO: 34763 - DNA, 156 bp, Glycine max
  Peptide Sequence Number=SeqID_126448
atgggacaccttagtgatcaaggggttcccatgaatcctaagagaataaaggtcattcctgagtggcccactccaccaagtgttgaggaaaaaagcctagagtttcaagaacctcgggatttgaggtcaaatccttttcaaggggggagggaatga

SEQ ID NO: 34764 - DNA, 453 bp, Glycine max
  Peptide Sequence Number=SeqID_126449
atgcctaatatttacaacgctctgatagttaagggtcgagatactgttggtcaacaaattaatgtgacttgtgaagtacagcaattattaggaaataatcgaattagagctgtagctatgagtgcgacagaaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtagaatcaaaagtagctctagtatatggtcaaatgaatgaaccggccggagctcgtatgagagttggtttaactgccctgactatggcggaatattttcgagatgtcaatgaaccagatgtacttctatttatcgaccatatcctttcgcttcgtccaagcaggatctga

SEQ ID NO: 34765 - DNA, 763 bp, Glycine max
  Peptide Sequence Number=SeqID_126450
atgacttcgatcttcagggtttgcatctcagccatttgcctgctccttattctttttctcctgcgcttcggcttctgcgccgtagacgcgtttggccggcggcagcttggtgattttcacgtcgctgtattcgagacgcggcgcgccctgcgggttatggaacgccagcgtatgcttgaggaagttgacgtcgtcgcgctcggtgcagccttcgtccaggcgctggtgagcgccgcgcgactctttgcggttaaacgcggagtgcgccatacattcggcgacgtccaggccgtagcccagctcgatggtgtacagcagatcggtgttgaacacgctggagttgtcggtgatgttgacgcgcttgaagcgctctttcagctccgccagcttatcgatggttttttgcatcagctccggcgtgcggtagatgccgcagccctcttccatcgacagccccatttcgtcgcggatcttcgcccagttttcgttgccttcctgcttcatcaggttgctcaggcgggtttcgacatcgcgggtttgcgcatccagcgcgctgccgttggccggcgcggtttccagcgcgcgacgcgccgcgtgctcaccggcgacgcggccgaacaccaacagttctgccagcgagttggagccgagacggttggcgccgtgcaggccgacggaggagcattcgccgaccgcgaacagccccttgatgcgggtttcgcaattctgatcggtttcaatgccgaccatggtgtagtgcgcg

SEQ ID NO: 34766 - DNA, 297 bp, Glycine max
  Peptide Sequence Number=SeqID_126451
atgtgtgcgagtcaacgggcgagtaaacccgtaaggcgcaaggaagctgattggtgggatccccctaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtacactcacctgccgaatcaactagccccgaaaatggatggcgctaaagcgcgcgacctatacccggccgtcggggcaaggaccaagccccgatga

SEQ ID NO: 34767 - DNA, 379 bp, Glycine max
  Peptide Sequence Number=SeqID_126452
atggcgtgtctcctccatcttcctatcacaggggcattacacaggtttgagcctctgggcgtggacgaggcagtcttgctgtcgacggagattctagaggtatctgacgaggaggctcgagctgagacctctaggagctatgcctggagagttgccacgctggttcacatgtatgaccagctaaatgtagcttcacagacccccacacgacagatgggtgggtacttgacgctattacagtgttggatatatgagtattttcccagtgttcatcagggcgtcactgatgatggctacgctgagacgaccccatgtgcctccaggtggcttccgacgaaggcgtacatgaaggggatcaagggagcgccgtacagggcac

SEQ ID NO: 34768 - DNA, 674 bp, Glycine max
  Peptide Sequence Number=SeqID_126453
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccgaacttgcacttccaactgcatttgccatcataatctattggatgggagggctcaagcctcatccagtgacctttctcctttccctccttgtggtcctctacagtgtccttgtctctcaaagtcttggcttagcatttggtgccattttgatggaggtcaaacaggccaggggatcctctagagtcgacctgcaggcatgcaagcttggcactggccgtcgcccgcaccgatcgcccttcccaagagttgcgcagcctgaatggcgaatggcgcctgatgcggtattttctccttacgcatctgtgcggtatttcacaccgcatatggtgcactctcagtacaatctgctctga

SEQ ID NO: 34769 - DNA, 261 bp, Glycine max
  Peptide Sequence Number=SeqID_126454
atggcacaagaatgcttcccaaatgaatatatgatgtggaattgcctctcaagtgtagatagatggcatgaaaattcattttcaaataaatgcaagtgtgtgcatgacgaaatggctccgaaaaagctttccgcaaagagatctaggagggacgccgcagctgaagggacaagcgccgctcccgagtttgatagccaccgtttcaggagcgccgaacatcagcagcgtttcgaggccatcaaaggatggtcgttccactga

SEQ ID NO: 34770 - DNA, 279 bp, Glycine max
  Peptide Sequence Number=SeqID_126455
atgacgtcctctagagtatccacatcaggaagtgggtcctcatcaccctttggaaagttcaagagcatccacagcaggctcaggaggttaactcctctgggtcctcctcagggtcttcttcagatgatgacacctctatcacttggacgggctccactagtcgatatggacgtgcgtgcgggttcctctggatgtaccaatgacagtagccgtgagtcaaatcgtgccacggaatcggcacctcgcattgccttcgagggtctcccaaactccctctag

SEQ ID NO: 34771 - DNA, 423 bp, Glycine max
  Peptide Sequence Number=SeqID_126456
atgaagaacgacggaaaaccatcatggatttgctcacgaaaacgtctcggaagcattacagaagcacctcggcttggattttcttcacggaaacaattttttttcaccagaacagctgaaatgcatagccagggggatccgggatccttggaacaacccccttttgctttttttataggaaaaggggagaggaggttgctgcccagctcgcccaggcgagctgggttgcttcctttagaagcaaccatgcttcgaaaatactctggaagaactttacggagtgcgcaacaatgcttcctttcgactcccgacatgtcgcgaaacttcacggattgcctaacgatgagtgttaagtacctcgaagcggtcaagcgaaggttgcatgccaccaaacaatggtccccagacaaaattagggtatga

SEQ ID NO: 34772 - DNA, 153 bp, Glycine max
  Peptide Sequence Number=SeqID_126457
atgatgcaatcctaccccgcaagggcattggatagaagactccaagaagattgggctagagatgcaagagaaggccttagggttctcatgagccttagggctacggagtttgggatgacgacacttccagtgaaggaagataagtcaggatag

SEQ ID NO: 34773 - DNA, 264 bp, Glycine max
  Peptide Sequence Number=SeqID_126458
gcatgagtttgaagaaaggcataaatacccgaggtgtggggtatcatggtgcaaagtcaaggaccatgacgagtgtagcgatgatgaaagcacaaagaaagcccccctagcaaagaaaggagaaattgcaatggaatgctccgtcatccggctgattcctcctagtggaagaagattcatcatttgtatcctaatttcgagaaagagtccgttgattgaagtcttgacaaagttgtgggacgaggaggttgttgtgtttgatgg

SEQ ID NO: 34774 - DNA, 470 bp, Glycine max
  Peptide Sequence Number=SeqID_126459
atgaggtctaacggtgttaggggattgaaccccatagacaacctcaaaaggggactgcttggtggttctatgaacccccctgttgtaggaaaattctacatgaggaagatactcatcccaggacttatggttgcctttcaaagagctcttaaaaggaagtggctaaggaacttagcatctctatctgacacaatggtcttaggcacaccatggagtctcactacttccctaaaaaagagttttgagatatgggaagcatcatccaccttgtggcatggtataaagtgtgccatcttgctaaacctatccaccactacaaagatagagtctacacctctttgggttctagggagcccaaggacaaagtccatactaatgtctacccaaggtgcagatggaatgggtaaggacaagggtcttgtctatcccaaagtggcccatgagcccaccctcatggctctccttcacaa

SEQ ID NO: 34775 - DNA, 795 bp, Glycine max
  Peptide Sequence Number=SeqID_126460
atggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgtatggcgcctactaggcaccctttggacccagataagtccaacaggcccctgggatttcccgcactgatcacaggactctgccagtcgttcggagtccccgttgcacctaccaaggtgattcggccgcccatcacccgggcttttattgagaagtactgtacccagagacaggctcagggtgatgcttcacaggccgcaggcgcgccaccaccacctcatcaggctggccaggctggggcatttgacatggagctgtatttacggcatttggttcgccagcaggcggccaaccaccgagcacatgtacagacccatgattgtctataccagatgagccttagcatgcagagccagggcttcgcttctttttcatgccctactctagaccagttcaggcagagttgcatgtcccggagattggcccgaggcccaagcaggagaggcaccccagaagctcccggcggtggagaagaggcccacgaggacgaggagatggtcgatttgcttgacttcttaggagggagtggagatacgtcactgggagatccccagattcatgttttctttcatatttcttttatcatttttatgctatgttattgttttgacttgagagactaa

SEQ ID NO: 34776 - DNA, 759 bp, Glycine max
  Peptide Sequence Number=SeqID_126461
atggctacctcaccaaaaagaaactgcagctcctgggttcacccgctgtacccatcatctccgcaccaggaacaaccagaattcaacatccaacccatacagataattcctggtcaagcttctgtccctgagaaactggttcccagaagacaacagggagtgaagattgctgtaaaccctagccttgcaacaagttctagggaagtagacacggagatggacaagaaaatccgcagtatggtgagtagcattttgaaagaagcctctgtgcctgaagctgatgaagatgttccaacatcttccaccctaaatgtttctatgcctgatgttgagaaagatgttccaacatcttccggcccaaatgatgaagtactctcttcccccagcaaagagagatcaacagaggaagatgatcaagccgcaaaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaagagcactccagtcactcctgccacatccagaagaagcaaggttgctatcccctccaagaaaaggaaagaaatttcctcatccgattcggatgatgatgtcgaactagatgtctcgacatctaagagggccaagaaatctggaagaaag

SEQ ID NO: 34777 - DNA, 1767 bp, Glycine max
  Peptide Sequence Number=SeqID_126462
atggctttcgttcaccctatctttgcttcagtgaatcacccaatattttctccaaacaaatgctcagtttttctgggtgtgaagctcatccccgagcatgcctatagtagatgccatagtaaaaaacattttactattgccttgaaccaaaatatccacatttctaaaaatggaaaaggaagggatgctcttcaaatcagacatgctaaagcattagaggaagttaagcgcgaacttgttagcaagacaaggcaaaatgcagatcatggtttatccatggtggactccatccaaagattaggcatcgagtaccattttgaagaggaaattgaaactattcttaaaaagaagcttctgatgcttagagttcacaaccatcaaggaagggcttatcaagaactatcagaagttgcacttcaatttcgtctgttaagacaagaagggtattacatccatgcagacatatttgataagttctggggcaatgaaggcaagctcaaactaacattctgtgatgacataaatggattaattggcttgtttgaagcctctcaattaagcatagaaggagaagattatcttcatgaagcagaggaatgctgccgccagtatcttaatacatggttgagtagatttcatgagcatcctcaagtgaaagttgtggcagattcattacggtatcctattcatagaagtttgtcaaggttcacaccgacaaactctttacaaatagaaagtacagaatggataagatctttacaagaattgtccaaaatagacaccgaaatggttagctctttgcatctgaaggaaatgtttgcagtttccaaatggtggaaagaactaggtctggcaaaggacttgaagttagctagagatgaaccaataaaatggtacatgtgggcaatggcatgcctcccagatccacgattctcggaagaaaggattgaactcacaaaaccgctgtccctagtctacattattgatgatatatttgatttttgtggaaatattgatgaactcactctctttacagaagctgtcaagaggtgggacatggcagccacggagcaattaccagactacatgaaagggtgctttaaggccctttatgacattactaacgaatttgctttcaagatccaaatcaaacatggatggaatcctataagcaccttaataaaatcgtgggtaaggctcttgaatgcattcctggaagaagcaaaatggtttgcttctgggcttgtgccaaaggcagatgattacttgaagaatgggatagtgagcactggggcgcatatgatccttgttcactcattctttttcatgggtgacgctataacccaggaaaccatcactctaatggatgaattcccaagcattatatctgccacagccacaattcttaggctgtgtgatgaccttgaaggggaccaggatgttaatgttaaaggtgatgataatgatgggtcgtatataaagtgttacatgaaggagcacccagcaacttctgttgaacaggcacgggagcatgtcgctgaattgatttcggatgcatggaaacgtctcaaccaagaatgtctcatgacagatgcaaatctgttcccatcatctttcactaaactttgcctaaatgctgctcgaatggtacctctgatgtacggttatgacacaaatagcccatcgaagcttgaagagtatgtgaaatcattgctttgtggtggtgctatgcagagtattccagaagaccagaccattgtttcatga

SEQ ID NO: 34778 - DNA, 2010 bp, Glycine max
  Peptide Sequence Number=SeqID_126463
atggcttctcgctaccacagcagcaccaacaaaaaagtgggtcccgaagaagcttctctcgacaagcgtcgccggatcctcggagctgacaagatggaccgacagcagggtggtagggtcagaacgccgttttccgttgtcaccaacaacgcagcaacgagtgacgccgccgaaggcgccgccgtcgtcgtcgatttcacgaaggatgaggtggagacgttgctcaatgagaagaaggggaatacttatgataataagaaaaagattgagcagatgacggatcttattaagcgccttaagctctgcgttcggtggtttaagaggattgaagaagggtatgtgcaagaaaaggaaaaacttcggtttgagctggaggctgctgagaagaagtgcactgatactgagactgagatgaagagtaagattgaggagttggaagagactgtatctgatttgaggaagacaatttcttctctagaagagagaattgtgaaggaagaatcagataagttggaagcaattaattcttatggtaaagaaaaggaagccagaactgaagctgagaaagttctggatgagaaatcagctgagcttgagaaagttcgggatgagaaatcagttgctgtgaagaaggccatttcaaatgaggacttgtacaagcgatcacaagagtataatgtgagcctgcagcagtacaatagtcgtcttcagtcagatcttgaaactgctaatgaggcccataaacgacttgaatcagagaaagcaaccattgttgagagccttagcaatgtaagaggccacaataaggcattgcaggatcaattggtatctcttaaagtttcacaagacgaggctataaagcagaaagaaattttaggaaatgagctcaaatgccttcgtgaagagttaaaacaaattagagatgatcgtgatcaccaattgggtcaagtaaatgctttaactggagaaatagcaaagtacaaagaatatacagggaaaacatgtacacaattggatacgttgatgattaaaacaaatgctcttgaggagacttgttcatcacagaaggagcaaatacatatcatgcagcagcagttgtttgctgaaaaggaaaagttaaagaatgctgatttatctgcttcagaaacaagaacaatgtttgaagagcaaaagataattatacgtgaactacaggatcgattggcagataaagaatttcaagttattgaaggagagaggctaaggaaaaaactgcacaacactatcctggagctaaaaggaaatattcgtgtgttctgccgtgtgcgtcctctcctagcagaggacagtctgggaacagacatgactgtttctttccctacgtcaacagaagtgcttgatcggggcattgatttggtacaaagcgggcagaagtacaatttcacatttgacaaggtgtttaatcatgaggcttctcagcaggacattttcatagagatatcacagctggttcaaagtgcacttgatggctacaaggtgtgcatctttgcatatggacagacgggttcaggcaaaacctatactatgatgggtaggcctgatgcgccagatctgaaaggattgataccacgctctttagaacagatattccagactagccagtctctaaaagaccaagggtggaagtacacaatgcatgtatcaatatatgaaatatataatgagaccatcagagatttgttatcatcaaatcggtcaagtgggaatgatcatacacgaacagaaaatagtgctcccactcctagcaagcagcacactattaaacatgaatcggacctcgcaacactggaagtttgtagtgcggaggagatttcctctcttctacaacaggctgcacaaagcagacaatgtgcccttgttattggtctaccgtccttatgtaatataattgttgataagtggtgcaagaaggggttcaagaacttgacaggaacccgactgatgcacagaaggtggctcaccgtgatttga

SEQ ID NO: 34779 - DNA, 381 bp, Glycine max
  Peptide Sequence Number=SeqID_126464
atgggccattctggccatgcccacgactcccaagcaaacttcttcaacgtccacaacgcagctaggtcacaggtgggtgttccacctctcacatgggataacactctagctgccttcgctcaaagttatgctaatctacgcaacgtgattgccaacttatccactcacgcggaccatacggtgagggcatgggtgaatgagaaagccaactatgattataattccaatacctgttctagtgtttgtggccactatacgcaagtcgtttggagaaactcactccgtgtagggtgtgccaaagtaaggtgtgataatggaagcacgttcattatttgctgttatgatccccgtggtaacattcgtgggcaaagaccttattag

SEQ ID NO: 34780 - DNA, 1128 bp, Glycine max
  Peptide Sequence Number=SeqID_126465
atggaagcgcgtgcaggagccaatcagcgtattgcaagaatctctgctcatcttcagcctccaaatttccaggaagggagtgatgttcttcttaagagtgctgagtgcagagcaaagggtggggcacctggattcaaagttgcaattttgggggctgctgggggaattggtcaacccctttctttgctgatgaagatgaacccattggtttcagttcttcatctttatgatgttgtcaacacccctggtgtcactgctgatgttagccacatggacactggtgctgtggttcgtggctttctggggcagcaacaacttgagagtgcactcactggcatggacttggtaatcatacctgctggggtaccaaggaaacctgggatgacaagagatgatttatttaaaataaatgctggaattgtgaggaccctttgtgaaggaattgccaagagctgccccaatgcaattgtcaacttgattagtaatccagtgaattccacagttgctattgctgcagaggttttcaagaaagccggtacatatgatccaaagcgactactgggtgttacgacccttgatgttgtgagggcaaatacttttgtggcagaggtacttggagttgatccaagagaggttgatgttccagtggttggaggtcatgctggtgtcacaattttgcctcttttgtcacaggttaagcctcgcagtagcttcactgcagaagaaactgaatacctgacaaatcgcatccaaaatggtggaactgaagttgttgagaatgatgcaattgcgtgtgtttggatagctttcaaaatcactatagacgatggtgaggcaaaagctgggacaggttctgcaacactatcaatggcatatgcagctgccaagtttgctggtgcatgcctccgtggcttaaaaggagaagctggggtagtggagtgtgcttttgttgattctcaggttacggaacttcccttctttgcaaccaaggtacgtctaggtcgtgctggagcagaagaggtttatcaactgggtcccctgaatgagtatgaaaggattggattggaaaaggcaaagagagagttagcaggaagcatccagaagggtgtagagttcatcagaaaataa

SEQ ID NO: 34781 - DNA, 1545 bp, Glycine max
  Peptide Sequence Number=SeqID_126466
atggattatcagtacattctaggagggattatggcttgtagttttgctttttttaatgaatgtgcaaagatatcatcagagaatggaatatgctcacatgaggatgcaggaagtgctgacatcattattgtgggtgctggggttgctggttcagctcttgcttgcactcttggaaaggatggacggcgagtgcatgtaattgaaagggatttaagtgaacctgacaggatcgtgggtgaattgctacaacctgggggctatcttaagttaattgagttgggtcttgaggattgtgtggatgaaattgatgctcagcaagtctttggctatgctctgtataaggatggcaaaaataccaaactctcttatcccttggaaaattttggctctgatatttctgggagaagctttcataatggccgtttcatacagagaatgcgagaaaaggcttcatctcttccaaatgtaaaattagaacaaggaactgtcgcatctctacttgaggaaaaaggaaccatcactggggtgcactacaaaaccaaaagtggtgaagagttcacagcaaaggctcccctcaccatagtatgtgatggttgtttttccaacttgagacgttctctttgcaatcctaaggttgaagtaccctctcattttgttggtctggtcttggagaattgtaatcttccatatgcaaatcatggacacgtcatcttaggtgatccttcccccattttgttttatcccatcagtagcactgagattcgctgtttggttgatgtgcctggccaaaaattaccttcccttggtagtggtgaaatggcccgttatttgaaaactgtggtagctcctcaggttcctccagagctgtatgattcatttattgcagctgttgacaaaggaaacataagaaccatgccaaatagaagcatgcctgcctcaccttatcccacaccaggtgcccttctaatgggagatgccttcaatatgcgtcaccctttaaccggaggaggaatgactgtggctttatctgacattgttgtgctaagggacttacttaaaccccttcatgatctccatgatgcttctgctctttgcagataccttgaatcattctacaccctacgcaagcctgtagcatctacaataaacacactagccggggcattgtacaaagttttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgccgtcgctatatatggtgttggccgcttgctcataccatttccttctccaaaacggatgtggattggagctagattgatttcaggtgcatcaggcatcattttccccattattaaggctgaaggggtgagacaaatgttcttcccagcaactgtgccagcatattacagaacccctcctgtccatccattgaacacacatgaaggaaatacatggaattaa

SEQ ID NO: 34782 - DNA, 2139 bp, Glycine max
  Peptide Sequence Number=SeqID_126467
atggcggaagtgaagagtgaagagccagaaaaggcaaatacaaatgtgaaagaagaagaagaagaagaagaagaagaagaagaagagtctccaatagaggaagtgaggctaacagtgaagaacaccgatgacccgacccagccgcctctcgtcatcacgcagatcaccgtgcaggtggccaccctccccctcggccatctcatggcggtggtcctccccaccgccatgttcaggatccccgggttcgggaccaagcggttctccttcaacccgggtcccttcaacatgaaggaacacgtccttattactatattcgccaatgctggtagcgccttcgggtctggctcgccctacgctctggggattgttaacattgtcaaggccttgtatagaaggaagatatccttcatttcttcatggcttctcgtgttaggatacgggtgggcggggttgctgaggaagtacgtggtggagcctgctcatatgtggtggcccagtaccctcgtccaggtctctcttttccgagctttgcatgagaaagatgagcgtcgattttcgcgggcaaagttcttctttatcgcactagtctgcagtttttcatggtatgtgatccccggatacttcttctcaacactcacaaacatatcatgggtgtgctggatattctccaagtcagtcactgctcagcaactaggctcaggcatgaacggcttaggatttggtgcactcacacttgactggactgctgtagcatcattcctgttcagccctcttatctcacccttctttgccattgtcaatatctttgtggggtacacactggtagtgtatgttgtgattcctattgcatattggggcctcaatgtgtacagtgcacatatgtttcccattttctcatcaaacttgttcacttcccaaggccaagagtacaacatatctgctattgtcaatgaaaagtttgagctagatatcgccaagtatcatcaacaaggtcgaattcatctgagtgtgtttttctctttgacttacggatttggatttgccaccgtagcatccacccttacacatgttgtatgcttttatggaagggaggttatggagcggtatcgtgcttcggcaaagggcaaagaagatatccacacaaaactgatgaaaaaatacaaagacatacctacttggtggttttatgtgatgatgggcgtgacgcttgtggtttctctcgtgctatgcatctttctaaataaccaggttcagatgccgtggtggggacttatctttgcttcagccttggcctttatatttactctcccaattagcatcataactgccaccacaaaccagacaccaggactaaatattattactgagtatctctttggtataatttaccccggaagaccaatagcaaatgtatgcttcaaaacctatggttacataagcatggctcaggctgtctccttccttggtgatttcaagcttggtcactacatgaagatccctccaagatcaatgtttttagttcagttcattggtacaatgcttgctggaaccatcaacatttgtgtagcatggtggttgctgaactctatcaacaacatttgtcataaagatctccttcctgaaggcagtccctggacatgtccaagtgaccgtgttttcttcgatgcgtcagtcatctggggtctggtaggacctttgaggatctttggttctcatggagactaccaagcattgaattggtttttctttggaggtgcaatagggccaatactagtttggatattgcacaagtcattccccaagcagtcatggattcccttgatcaatcttccagtccttctgggggcaactggaatgatgccaccagcaacaccactgaactacaatgcctggattatagttggaacgattttcaacttctttatctttcgctacaggaagaagtggtggcagagatacaactatgttctatcagcagcacttgatgcaggggttgcttttatggctgttctgctctacttcacacttggcctggaaaacaccagtcttaattggtggggaactgctggggagcattgccctcttgcaacttgcccaacggctaagggcattgtggttgatggttgccctgtatattga

SEQ ID NO: 34783 - DNA, 450 bp, Glycine max
  Peptide Sequence Number=SeqID_126468
atggaactccaacaactaaatcaaaatgaagaaaccgacaagagaaaacgaagcatagcactaaaagtctcctcatcaatgcaagaggaaaatgaagatgaagaatcaggagataaagaagacttctcactctttgtgaagaagtttcataaattcatcaaaaatataataatcgagaggcgtcaaaatttcaaccatggaaaaagattccaagaagactctccaactcttagatgctacaagtgcaaccaacttggtcacatcaaagcaaatttcccctcaaatgagcaatggcctgagaagaatgagaagaaaagtcataaagaaagaagatccaagaaggcgtatattgcatgggatgacaattactcatccgatggttcggagaaggagatcaaccttctatccaaggattatgagagcgatgagaacatctctcaagaagattaa

SEQ ID NO: 34784 - DNA, 1833 bp, Glycine max
  Peptide Sequence Number=SeqID_126469
atgggtttagagctttcacttgcacgtctgaaagctcttgcaaaatatgcttttgggatgggattggctcaggttgtattgtctactttagcatttactgcttttgaacttcctccaaatggagctgttggaacaaaaattttggaattccttttccactctaggcctgatctggtgaacatcagaagtgttgatgaagctgtagtgattggtgctgcactctctctgtcttcttctgcatttgttctacaggacttagccgttgtccctcttttagtcatacttccaatactagagagccagaatataactgagggaagtatttggcccatgcttgctcaagaaagtttaaaggcattaggtggattgggtctgctttctcttggggcaaagtacattctcagaagagtttttgaggttgttgcagatacaaggagctcagaggcttttgttgctctttgcttgctgactgttgcagggacttcactagtcacacagaatttgggatttagtgacacgcttggggcttttttagctggagcaattttagcagagacaaacttcaggacccagattgaagcagacataagaccatttagaggcttgcttcttgggttgttttttctaactacgggaacttcaattgacatgcagctccttttgcgagagtggcccaatgtactttccctcttgggaggtttaattgttataaagacattgatcataactgcaattggtcctcgtgttggacttactttaaaggaaagtgtaagaataggattgcttctatcccaaggaggcgagtttggatttgttgttttctctttagcaaataggcttggggtgcttcctcttgagctcaacaagctgctcataattgtggttgtattgtcaatggcattaaccccatttctgaatgaagctggaagaagggctgctagctttattgaagacaaatttgatgctgagaataaacagaatgcttctgagacggttaacttcaatgttagtgaacctgttgttatccttggatttggacaaatgggccaggtccttgccaatttcctgtccaatccattagcttcaggaggagatagtgatgaagtaggatggccttatgtggcatttgatcttgacccctcagtagtaaaggcagctagaaaaattggctttcctgtactctatggggatggatcacgcccagatgttcttcactctgccggtgtctctattccaaaagctttcatgattatgtacactgggaagaagaagacaattgaagctgttcagaggctaagattgaattttcctgcaatcccaatctatgccagagctcgtgatctcaagcatcttttagatctgaagaaagcaggtgcaacggatgccattttggaaaatgcagagactagcttgcacctgggttctaagctgctgaaaggccttggtgtgatgtctgatgatgtagcatttttgagtcagcttattagagattccatggagctccaagctcaagaaggaatcggccaatctgaagatcgcggattagatattatgaaaccactgcaggtgaaagttgctgacgtgagggaagcacatgtactgacggcaacaacttcaccagaaactgaattatcagaaatgaatcagaaacatcaagcttcttcgattagaaatcaaagggaagtagattcagaagaacaagattatgaactgaatgaagctgtgaatttagaaggaaatggtgttttagttagcaaacaaagtagtgaagaaagctcaatggtagtagatccatcaaacccttcttcccatactgccactgaggaaccctaa

SEQ ID NO: 34785 - DNA, 459 bp, Glycine max
  Peptide Sequence Number=SeqID_126470
atggcagcatctcgttactgtaagaaaagttatgtgcatgcttcttttcatgcaataacattaacactcttgcttcttgcaatacctcatgcagcttcattatctttcaactatcagcaacttggtgacacgggaatcgccctcaatttttcaggaaaagcccgtcgtgacaatgatgtcatcaacctcaccaggtctgagccagatagttatggcagagttacatattacgaactattgcatctttgggacaagaactcagaaaaagttacagacttcactacccatttctcctttaccatcaacaccccaaataaaactcatcatggagatggcatcaccttctttctggcacacccagacttcccacaatctgacatagatggaagtggtatcggtctagcgagccgagaacaactgaagaatctaaatttcgcaaaggattatccatttgtagcg

SEQ ID NO: 34786 - DNA, 631 bp, Glycine max
  Peptide Sequence Number=SeqID_126471
atggggaagaacaagggtcgccaatcgcactcagctgcaaagcaaattatggtgaagggtactacctcaggttcaagtaaatctcaaacatctgctacttctggtctggataatcttttaggcaaggtgctcgtaaaaaaggcagggacaagttttgcaaaaactgatgatgtcgcacaccaagtgtttgataatttgtcggaatgcagtgctgaatctgaatcttgcccagaggtttcttgcaccttaggggacaatgattcaactactgatgatgattcatctcactcctgtggctctaagtcatcaccgcagctacacgacaataaggctcttactccttgggtcaatctgttcaaagataacagaaatctttccaaaggttttggaatgaagttctcccctccaccctctgatgatgaagtgttgttggaagaaactgatttgcaacccctggaagaggcttggggacatagccttattggttatgtggctggccgcttcccaggaaagaaagctctgctggattgttgccaaaaatggggagtcaagttttcatactcaactcatgaaagtggttgggtgatgtttaaatttgagtctgaggacgaactgaaccaagttcctctct

SEQ ID NO: 34787 - DNA, 1326 bp, Glycine max
  Peptide Sequence Number=SeqID_126472
atgtcgaactcaacagaaaacaaacatgtagcagtctttgcattccccttcggcacccatactgtgcctctcttaaacctcgtcctcaaactatctcaagccgctccaaactgttcattctcgttcatcggcacagaaaaatccaacgcaatccatttcccgaaaccccacatccccatcaacattaagccctattgcatcagcgatggaatcccagagggtcacccactagccaaccacccaatcgaaaagctcaactttttcctcagaaccggtcacgagaacttgcacaagggtattcaaatggcggaagaggagaccaagcagaaagtcacatgcgttatttccgatgcttttgtatcctcttctctcgtcgtggcacagaaactcaacgttccttggatcgcgttttggcctcccatgtcatgcacactctctctatatttctacattgatttgatacgtgaacagtttttaaacagtgctggaaacgcagcctttgatttccttcccgggttgcccaacatgcgtgtcgaagacatgccgcaggatctgctattttttggagaaaaagagacaattttttcaaagacactagtttcactgggcaaggtgctgcctcaggctaaggttgtagtcatgaatttctttgaggagctagacccacctttgtttgttcaggacatgagatccaagttgcagtctttgctctacatcgtcccggttcgcttccccatactatcggtggcggattccacagggtgcttgtcgtggttggacatgcagggttctagatcagtggcgtatgtctcctttgggaccgtcgtgacgccaccgccacacgagattgtggcggtggccgaggcgttggaagaaagcgaacttccgtttctttggtctcttaaggaaaacgtgttgggttttttgccaactgggttccttgagaggaccagcatgagtgggagaatagtgtattgggctccacagacacaagttttggcgcatgattctgtgggagtttttgtgactcactgtggatctaactctgtgactgagagtctctccagtggggttcctatgatttgtaggcctttctttggagatcaaggggtggctgccagagtgatacaggatctttgggagattggggtgataatagaaggtagggttttcaccaaagatggattgcttaaaagcttgaagatgattatggtgcaggaagaggggaagaagattagagacaatgctcttaagttgaagaagactgtggaagatgcagcaaggcctgcagggaaatcagcacacgatttgaagactctgctggaa

SEQ ID NO: 34788 - DNA, 1212 bp, Glycine max
  Peptide Sequence Number=SeqID_126473
atggactacataaacacttcccacccaaattttattggcggaagtaaggcaatagaagctgcagtgcaacaaaccaggtcttctagaattgctttaccagtttctagggtgaaggatgcactggaatctgataagggatcagcctctgagagaagtgggaagtctcgatctattctcgcaagacatgcaaatggagtagtggctgatcaggaaatgacagctagtaaaccacatactgaaccagtccatactgtgcagtcattctctactattcatttgagagagccccctcctgtcttgaggccattggagagcaattcagagactgaagctgttgaaatcacagtaacaaagttgcttttgaaatcatactatgacattgtcaggaaaaatgttgaggatcttgtccccaaagcaattatgcacttcttggacttgaacgaactgcctcttgaagctgaaacagttgaaaggggatacagtttgcctgaaactactactggcttacctaaaattcgtggattgcctacttcgtctatgtattctaccggcagtttgggagactattatgaagcttctcccaagaacacaaagtctagaaagtcttcacattctggggaactccaatctccatttcacgattcaaatggaaatggagggccatacacgtcaggaagatctgcccgtcctgctcctcgtgcagcacctcgtcctgctccagttcaccatgctcctcctccagcccctgctcagagcggtggcggatctatgcttggtggcattggttcaaccatagctcaaggtatggcttttggcactggaagtgcagtggcacacagggctgtggatgctgtcatgggtcctcgtaccattcaacatgaagcagtagtcacggaggctgctgctgctgcccctgcacccactgcaaatacttttggtggcgatgcatgcaatgttcatacaaaggcattccaggatccaaccgggaaggtctttggattagttgggtttgggctcgttggatgggctgttgatggagggggcccagccggtgttggaaaagatgatgctgatgacgaactgattggtggtgtttggtgtaccattcgtaaaaaaggagaaaggaagaagggtctcaagggtaaaaaggaaatcttggataacgtgaaaggagaaatgccttctcatttgtcaagtcttgcagagtgctag

SEQ ID NO: 34789 - DNA, 396 bp, Glycine max
  Peptide Sequence Number=SeqID_126474
atgtctcgaaacggcgacgtagtggaacagaacgcggccccctcgacgacgtcgtcgtcgagcacaataagaaacagaacagacccgttcctggtagcgtgcaggtgcttcagctttttcacctctctcgccgccattctctgcatcgccgtcaacttcctctccgccgtccgttccttcaaacacgcatctgacattttcgacggcatattccggtgttacgcggtcctcgtggcggctttcgtggtcctcgccgagaccgaatggagcttcatcttaaagttctccaaggttttggagtattgggctgccaggggtatgctgcagatcttgtacgcgttcctttcgatttactctaaattatatgatgcttacttccactacgctctaatttaa

SEQ ID NO: 34790 - DNA, 249 bp, Glycine max
  Peptide Sequence Number=SeqID_126475
atgggagagcttgctttggactttcggttagtccttaaactccagactgtatgtagacgatcctcctctactctgcatctattgcctttagaagtattctgcactgcaaaacttctactggtggttctggatcttgataaagcatcttgccaggtggtgaaaaaagatggaaatgggagatttggaatattaattggtggggtattaggaagaatggctgtggcggagttgttgggaatgcagatatag

SEQ ID NO: 34791 - DNA, 312 bp, Glycine max
  Peptide Sequence Number=SeqID_126476
atgccggcgccagcgatcccaatcccaatcctcatcgccgccgccgccgcggccgcgatcgtcgtcggcgttcccgagggacttccagaaggaatcgacgcgtttcgcgacctcggagaagtggtgcagcacggactcccagccgcgtttggcgccgccgccactgcggtcgtcggaggaggcggaggcgaggcagcggcagggggattgcaacgggaacgggaggagcgagggcgtccgcggcgccgggaacggaacggcgagcttctgcgtcgggaaggagattgggaatatgctatttgtgttgattaa

SEQ ID NO: 34792 - DNA, 1630 bp, Glycine max
  Peptide Sequence Number=SeqID_126477
atggtgtgccaagcagcgagccaaacaagattccgggcattaaagcatgagtatggcattgatggtgcagcaacaattattgttagagtgatagcatgctttcaacccttgcatttttgtcaggctgagtacttccgtcatttgcttaagcctgtcaccaagtttccaaagatctcatacaagagcaccataacatctactggtcatttgttttgttggatggttaaggctgacgagtctttgcctcgcccacaccatgtggcttggcaatcaccttcttctaatcacttcagtatactgcctaagcccagcttactcagtcttccagcatatctgaattcaagcacttccatcttgcctgctgtcagtacatttcatgggcttgcagctccttctatcccaagtctgaagagcatgctaaaaaatgaagtgcaaggattccttcagtattgcaatgctgacacaagtttgaaagaaacacattttggaggagctttacaaaatgcaaatccttctttgcagaagaggttactgatctttgaccgctctgataataagacaaggttgttttatggtcctgtcctccctcttgtccagagtccaactgttactgctacaaagtttgctcaaagttatggcataaatggggagggacaggccagtaatgtgggtcaaaagcatctaaccagatacagtttactgaaagagtctgttaaggatcatgcaattactgaagaaagtgaaaaccatgaagatacagaagaaataaatgcactgctttattctgatgatgaaagccctgaaggcgatgatgatgatagttgtgatgaggtaacaagtacagatcattctccattggcaactaataagacttatgtgatacaagagcaatttgaagacacgaaggaggaggttgctagctctgattggcctaacaaaaggctaaagctatttgatggtgactataatagatcatccacacctgcggacaggtatagtttgctaagaccaaatgaaacctgtgattgtgtaagcgatgctgaatcaaagaattcttgtggctgggcatattctgttgataaaactaaagtagataattcagtggcttgcgatatcaaatttaaaaaggataagatcagtgaatcattgaaagttcttgaaaatttaattcctggtgcaaaaggaaaggggccactgttagtcattgatggaactattgagtacttgaaaattttgatgtcccaaactggtgctcttggggatatgctaggtgcacccagcattattgctggtgcacccagcaatttattgaaaggtcaacattctcttccaccgcaagccaccgcgagcccagctgctacttctttcgcctggacgccattgccgttcgagggaaagggggctgacgacgaggcttccggaagacccgttatgggttcttccggaacttccggaagaacattttccggaaactttccggaagaagtgttcttccggaagaaaccaaacgttttccggaagaactcttcttccagaaactttccggaagaaggtttcttccggaaacgtttgggatttccggaagaagtgttcttccggaataattccggaagaacacttcttccggaaa

SEQ ID NO: 34793 - DNA, 618 bp, Glycine max
  Peptide Sequence Number=SeqID_126478
atggagacaacaaacaaaggtcacttgatcaacaaccccaacaaggatacatcagcagagtactgtagaagaacctggaaagtgggaaaggaactactaaaaggaatatcagaaagcttgggattggaagccaattacatagaggatacaatgaacctagattctggttggcaaatgatagcagcaaatatgtatccaccttgtccacaacctgaacttgcaatgggaatacccccacattctgatcatggcctcttgaacctcctcatgcagaacggggttagtggccttcaagtgctccacaatggcaagtggatcaatgtcagttcaactgtaaactgcttgttagtctttgtgtctgatcaccttgaggttgtgagcaatggcaagtacaagagtgtattacatagagcagttgtgagcaacaaagctacaagaatgtccttagctgtagtaattgcaccatccttagacactgtggtggaaccagctaatgagttactagacaatcaaaggaatccagcagcgtatgttgggatgaaacatacagactatatgcaacttcagagaagcaaccggcttaatgggaaggctgtgctagacaaagttaaaatctga

SEQ ID NO: 34794 - DNA, 366 bp, Glycine max
  Peptide Sequence Number=SeqID_126479
atgggtgactcagatatgtgcggcttgtacatcaaagcaaatcctacctgcctgggtgccctggggagagtttatgagggatccactgttgttcataacactcttttgttgcctggccaagtaaaggtgggtgtggaggaggttaaagatccagatgctccagttcctatacccactgatgaggtttccttagtggggcaggcaattcataccttcctttcttggccgacacatctggtcaagtctttatcacagcagacagttgtgtctccggcaaaaccacctcaaaagtcagatccagaggtcgatgatccgctttatctgatgacattgaccatccccaagcttttcttgaggccttaccag

SEQ ID NO: 34795 - DNA, 465 bp, Glycine max
  Peptide Sequence Number=SeqID_126480
atgggtcaaaagcttgacccaagagaattggacaacacagctgcccaagtccatgtccatcttcatcaccaagccatatatcaaccttgccctatcaacattaagattaaaagtgtgagaggtaggcgtaaggttaaagtagtaaagtacactccatgtctgagcgagtgcagtgaggtatgtgttcacgtactgaaagcatgtcagatattcctctccttcagcaaggatgattggggtgttgaggaagtcatagatgttggagcagaattccttgaccagagcatcgtcaatctgcttctcctggagtttggtgagtacccggcagcactgcctccattagagctctccgtaaaattcaccgaacatccctgtggagaactctatgttcctctccgaagtgaagcaagaggaatcccaggtggattcccatccttgtgtaggaattgctcggcattttcgtga

SEQ ID NO: 34796 - DNA, 351 bp, Glycine max
  Peptide Sequence Number=SeqID_126481
atgcttgatgatgagccatttgttcaagtcaaacgttcctttgctattggtgctggtgctgtgacttcctttggttaccgtaaggatcggaatggtcaatggctgaagaaagacgcactccctcctcaagatgagtgtactccttcacctcctcctcggcgtgaagattcagcactcctgaatgaagtccttaccaaattacgaggtcttcgttgttatgttggtgaacgtttcgactcattggatacacgctttgccggcatggatattcgcctcacacaagttgaagaagatgtctccttcatccgtacttgctttgatccaccaccaccgcctccatcatcctcttag

SEQ ID NO: 34797 - DNA, 444 bp, Glycine max
  Peptide Sequence Number=SeqID_126482
atgaagaatattccagattcgggaattatctttacgtttaaggaagaaaacgacttaaacgatcggttaaagctcgttaaaaacggaagaaaagaaaccgaaattgaacgaaataaagatgaaagccaaaaaacaagaaatgaattaaaaagtctcggatttggaaacttacccgttgaagaacgaagaacggaggaaaaccttcacggatttgcttacggaaacatctcggaagcgttacggaagcacctcggcttggattttcttcacgaaaacaattttttttcacccaaaacagctgaaatgcatagccagggggatcaaggaaaaaaggggggggggggggggagattgccacccagctcgcccagacaagctggattgattcctccggaagcaatccagcttcgaaaaacagtctggaaagcctatatcaaaatttga

SEQ ID NO: 34798 - DNA, 171 bp, Glycine max
  Peptide Sequence Number=SeqID_126483
atggcaaagaacaacgctgatgaaggaggttgttggcaacaacaaagggttcctccatcagtggtgcataaggaaagaagtgggatgagggttgaaggtgagatatttcagagtgtggatctgatgggggcagccattcaacaattttaccgcatcaagatgtgtccataa

SEQ ID NO: 34799 - DNA, 126 bp, Glycine max
  Peptide Sequence Number=SeqID_126484
atgttgagaacgacaggctttcaggacgagtttggggtcgagattgggacggatattagtaatcctatacctgtccccactttaggttatcagggaaaacccaaccctgaccccaaatgcggttaa

SEQ ID NO: 34800 - DNA, 595 bp, Glycine max
  Peptide Sequence Number=SeqID_126485
tgttgcaaaagaaaagccaattggcgatgtcgatagtggcatgaaggatgcggcggctggggaactctgtgtgtatctggaggatggcggcttagcggcggctggaggagaacgtgtggggcttgctggtgttgggttttgctgcaagagtgcgagacgtggaggtggaatcggcatggaggcgtctagtgtcggtgactgcacaggggaggaagatggaaaatgtggactgtttggtggccatggtgtctacgacagcggcaagtttgagttgactagaggtgagttctgcgatggatggtttgatgcgatctatagcagaccatttggcggtgtcgatagtggcatgaaggtgagggaggaagtggctggggaactccaggcggatccggaggatgacgacccaacagtggttggaggagaatgtgtggggcttgctgttagcggagaggtggaatcgacatggggtcatctagtgtcggtgactatgcagggaaggaagatggaaagtgtggaatggtatcgcgaagggtcattcactgaagaaggtcatccagtttggtggccatggcgtctatggaaacatcgagtttga

SEQ ID NO: 34801 - DNA, 360 bp, Glycine max
  Peptide Sequence Number=SeqID_126486
atgaccctaccatttgccgccatcgagacttttgtccttgcttgtttgctcaaagatcaatcaaagaatgagttcaagatattcaagatagaatcaagaacactacaagattcaagaggaaagttgatttcaagaatcaagaatcaagattcaagagatcaagatttcaagaatcaagattcaagagatcaagattcaagactcaagattcaagaatcaagagaaggcttaatcaagataagtatgaaaaggttttctcaaaaattgagtagcatatggatttttctcaaaacatgtttaccaaagagtttttactctctagtaatcgattaccagattgctgtaatcgattatcagtag

SEQ ID NO: 34802 - DNA, 156 bp, Glycine max
  Peptide Sequence Number=SeqID_126487
atagaggaagcaaaagaacatcacctagatgaagatgctatgataccacataatgtagctccatgtagagcttgtaggccttggatcttcttcatcaatggagttctttgcttcttgaagatcaatggcagtggaatggagaaggtggaaaggtga

SEQ ID NO: 34803 - DNA, 450 bp, Glycine max
  Peptide Sequence Number=SeqID_126488
atgtactacattattgtttgcattttgcttcctcggtctacaaatcttgcccaagcctctaaggaggatttgattctgttgtgggcccttcaaactggtcgtcagatcgactgggcccgtcttgtttggtatcggatgcataaggcattacgggccaatgcacctctgccatatcctcaccttgttatcctctttcttcatcatttcaaagttctcttggatgatgaaccctttgtcaaggttaaaaggtttttttccattggtgccggtgttgttacctcctttggttaccagaaggacatgggtggtcagtgggtccgcaagcaagatttgccaccgcctattcccgatgagcgtacaccatctcctccaccacaaagggacgcttcgtcttctctgctgattgaagtcctcatagagctccacgaccttcaagcatttgtgggttaa

SEQ ID NO: 34804 - DNA, 243 bp, Glycine max
  Peptide Sequence Number=SeqID_126489
atgggaaaaaggtggttacggtggcaccttccgaaagatccgtttcaggttcttccggaacttccggaagaacgtgttccggaagatttccagaagaagggttcttccggaagtaatgaaacgtctttcggaaagcttccggaacacctcttccagaagaaggttcttccggatgacctttcagtgcttccgaaagcactttccagaagaccccttcttccggaaagtttccggaagaactaa

SEQ ID NO: 34805 - DNA, 216 bp, Glycine max
  Peptide Sequence Number=SeqID_126490
atggccgacaacaactccttcattcccaacccccatgagtcatccaaaccccttgcttgcatcactttcaccaatgtcaccaaacttcttcccaacaattatcctaattggaaacaacaagttgaagctctccttgatggctatgatctcctccaaaatccagatggatcttttcctgcgccgtcggaaacgacccccaccactgcatcacttccg

SEQ ID NO: 34806 - DNA, 759 bp, Glycine max
  Peptide Sequence Number=SeqID_126491
atggcggaaaggacagtggtgcttacctcgacggtcgacgctgacgatgctccctcgacggtggacggtggtttgtggttcgtggctcctcttcacggtggttcgtggtttgtggctgctcgtgcttcgtcgttcgtggctgaggaagaagaagaagaatcaaacggagaagaagaaaaaggtagcgcgaggaagaagaagaatggctctggggaagaatcaaatgctttgtgggagaagaagaatcaaaagctggagttgctaggtgcacccagcaatattgctgattcttcttctctcccggaacacagattcttcttctctcccggaacacagattcttcttctctcccggaacacagcttcttcttctctcccggaacaacttcttcttctcccggaacctgcttcttcttctcttctccgtgaagcttcttctccgcgaggcgcgccaaggctttcttcttcttctccgcgaacagacccgttaggggttcttccggaagttccggaagaacattttccggaaagtttctggaagaactgttcttccggaagtaaccaaacgtcttccggaagaacccttcttccggaagactcccggaaaacctcttccgggaactttccggaagaagtggttcatccggaagaattccggaagacgcactcttccggaagaactttcaaatttccggaagacctttccggaagaaccccttcttccggaatgtttccggaagaaccacttcttccggaagtg

SEQ ID NO: 34807 - DNA, 495 bp, Glycine max
  Peptide Sequence Number=SeqID_126492
atggcaatgcgagagagtgtttggtttctagggttttctccagtttcaaaacgcaaaaaagatgtgccaaggggtaaaggggaagagaaagaggagaataaggatagaggaggtatgaaagggtgggcgcctcctcctccggaagaagcacttgatgttgcttcttttcttgcttcttttggttcttccaggttcttgcttcctcttctccgtcagcgacaccgtgagccaagcgccaagcttcttcttcttctccgcgaacgaggcttcgagacaaggatagaagacgccggaaaaaatgggaaaaaggggcttacagcggcagcttctggaagattcgttagaggttcttccggaacttccaaaagaagttgttccggaaacattccgacacttcttccggaattctcccggaacacctcttccggaaagtttccagaagaagtagttcttccggaagaattccggaagaagtgttctaccgatgacctttga

SEQ ID NO: 34808 - DNA, 168 bp, Glycine max
  Peptide Sequence Number=SeqID_126493
atgtcatcgcgtgaccttttcctaggactcaggcaaagcgccatacccgaaccaaacgtgttcttcgtgtgccctaacctctaccgccgcgcagatggcgcaaccgtcggtgttctccaccaccatgatgaagcctccgagacgtatctgcttcttgatggtgactga

SEQ ID NO: 34809 - DNA, 1008 bp, Glycine max
  Peptide Sequence Number=SeqID_126494
atggcacgtgctccagataacatcaagtctattaatcgatcaaaagagacacttaaacttgctgtaagaattattgatctttggtttgttgggactcccaataggtctgaacaagcggaaatggtcataattgattctcatggagatgcaatccatgttgtttgcaaacaagatcagctaaagtcttggaaggctgatttgatggaaaattgtacttatgtaatgcataattttaaagtcatgaagaatgatggtcaatttaaaatctgtgatcaccaatataaattagtttttactggagttactgttgtgaggcaatccgatttggaggatcttccttttaagaaatataaatttgcttatttcaccaatgtcattgctgggctcttccagcctaagctgttggttggatcttatgcaccctcagtcagtaattcgttgagggcctccaaattattgatcaatgaagctgtgtttgaaattcaagaattcagggagaggctttctgatttaggcattcaggtttcaggttcaagccaattgtcgtcaaaggatgcatttctttcaaaagctgaagcaaagacaatctctaagattaacaacatttctgaggagggtgatgttgatttaaatgtttctcctcaagcccttgataagttgctgggttatgtccttacatttaaagtcaaagttcaacccaagtttaacaatgttgttgttcttagatactcaaatgacttagatttgatcaatgttgtggtggccatgctgcctgatattgaggcatgttccaaggttcatgctcctatccctgactccgatgatccttcccaacttgaatttcaatctgtgtctgtcacagcaaatcatgatccacttttgggtcttccattgacacccacaaaacagattacatctgatgactgtgatgatgaaccgaaaagctctcagatttcacccatccagctttcatctaacaaattagcaagacatgatcaaattgaatga

SEQ ID NO: 34810 - DNA, 432 bp, Glycine max
  Peptide Sequence Number=SeqID_126495
atgaaagggaaaaaatcatggatcatccatgatgcaatcctccctaggaagggaccaatcactagaaccataagcaagaggctccaagaagattgggctagagctgctgaagaaggccctaaggttctcatgaaccttaggactcatcttctccttgaagtggcgtctcctctctctcttcctttctccattccgctgccattcatcttccaagaagcaaaggaatccattgatgaagaagatcctaggcctacaagctccaatggagcttgcatcaatccagaccaaagaaataattttactatatacaataaagatacaccagagtcttcaacaagtatactgaaacgtgctacaaaagttaaatcaaaacagacccctaattggtacaatagatacaagaagatgaaaccccaaatatatagagcatag

SEQ ID NO: 34811 - DNA, 135 bp, Glycine max
  Peptide Sequence Number=SeqID_126496
atgaagaggaagaacactctccctgtgaccctccgtgatgatttgaccatagagattcttttgaggttgccactgcggcacccacccaccaacttcttcagagatgccatgacttttataaagctaagtccatag

SEQ ID NO: 34812 - DNA, 1041 bp, Glycine max
  Peptide Sequence Number=SeqID_126497
atggtgtgctcttctcattcaaaccaaaaagaaacaagttcttcatcccagccagcagcacctaattctcctgttaacccaacacatgatattgggaagcaattggtggttcctacttcagaaggctctccagagtgcatagtgtctaaaggaatagaattacctccaacacagttgcaacaagtttcttcagatgatatgggcccagcattacaatcaagacctaaaggggacctagatgagaaccttttgtccaggggttctgagcagaagcctccaaaacatcccagaggaaggcctcctaagttagagactgaagcaaactacccaggaaagtcattattaccttcatatgatgacattcatgatgaacaaagaccaaatataaacaaaatggagaagcagcatcagtcgggcagaggtagaggtagaggtagaggtcgaggtggggtgaagcttggtcgagttagaggtcgggtgaagggtagaggtagaggtagaggtcgggggaggcctcctaaactaaaagaagatccaatccaatatgaggagcagttacaagaagaagatcaacctcagcaaggtcgtcaaggtagaggccaggggaggccccgtaaactgattcaagatacaaacatatgtgaggcacaattaccagaagaagttcaagctaagcagcagggtgttcgagttccaggtagaggccgtgggaggcctcctaagccaaaggaaaatacaaaccaatggacgaatgatagcaagggtttggagtggaaaaagctgaaggtacaaagaggggaagcatcaaagatcagagtcaagagaagcaaagtcaccagcggggtcaaggttggaatcagaatcaaaatatgggtcaagagaggtttcccaatcctaatgttgaagcaaaacagagccttggcggctagtgccagtagcaagttcaaggtagagatggacttcattagaatgaagtcattagcaacttcaattacaagcatgtcaatgttaggagagggtctcctaatcaaaccagattga

SEQ ID NO: 34813 - DNA, 387 bp, Glycine max
  Peptide Sequence Number=SeqID_126498
atggataataagatgaggaacaaggaattaaaggtcatgccatcccgacatagggattgcgcccgcaggacacccagtggacccaaagaagtccaacagggtcctggggtttccagctctgattacgggcctctgtcagttctacggagtgcccgtcacccccagcaaggtcatcaggcctcctactatccgagctttcatcaagaagtattgcgcccccatgcaggcagagggcgagacaccacaacagcttggggatggccagcaacaggcaacaaatgcaccaccgccacctccagagcccctcagctcatccacaaaaaggttagagtattgcctatgacacatggccgaccaattggcagccaagtccaaggccaaaggtaa

SEQ ID NO: 34814 - DNA, 300 bp, Glycine max
  Peptide Sequence Number=SeqID_126499
atgaactggagaagtaggctcctgagctgctgcttcctcctgagcaaatggatcagtttcaaagataaatggctcaggaggaacagcctcatcctttatatctggcataggctcatctgctggcacaggttattgggctacggaggcctcaccccttccagaaggagaaggctggactcctggccaagccactcgtgcaaggaactcctccacactcatggtcggctgctggccaaagctctgcaacctctaaatgatgatgatctaacctctgtgcaggctctagagcatggcaaataa

SEQ ID NO: 34815 - DNA, 288 bp, Glycine max
  Peptide Sequence Number=SeqID_126500
atgtcgctgcatgttctctatctttatgcgttttctagatttccccccagggatttccgttccgttgtatctcttgggcaggatcaccttgggctaccttctggagtgaagacaaaacatgaacggcagaaaccaatcaaggtacttaaggatgaatgcaagcggggatggggtcacgaccgaccgatcgttgcccttctctgtgcgaaacaagcagggaatgtcgctgcaaggcagccccgtatcctttgtattttgcagctttcttttactacttgtttgttttaa

SEQ ID NO: 34816 - DNA, 336 bp, Glycine max
  Peptide Sequence Number=SeqID_126501
atgtggtctccagccagtatcgaccaattgcaggaatatcggattgcgttgtgccaagcgcctgacggcgctcgtacacatgcgctgcaactcgcgacagaagcgcagacaccggagcacactgtttttatgactaaagtcgttcctacggaactacttttgagaggtaatttgcgagcaatctcaaaggctgtcaccttaaccaacggtcaacgatattgggtagacccgcatggggtttggctcaccttggaagaacttgatgcactcgaaagcgatgacgactccgaagttccctggatcaatggattgcctgctctttttgcgccgaaatag

SEQ ID NO: 34817 - DNA, 396 bp, Glycine max
  Peptide Sequence Number=SeqID_126502
atggataagagcttgaaggtaggagaatatgagtggagggagagggagagaaggagcatgaaattttgtgcctcaaatgaggtccaaattgaatctgtggagccaaattgtagagccaaaatttcactaattaatattagtgaatttttgctatggttcagcccactaatccaagatcaagttctagattctccactaagtgtgcttaggtgtcatgaggcatcccatgggcccgaaatctacctgtcataccctaatttcgtccggggactattgtttgatggcatgcaacctttggttgaacgcttcgaggtacttggtgccctttgttgcacaatacgtgaagttccgagacatgccagaaatcaaaaggaagcattgttacgcaatccgtga

SEQ ID NO: 34818 - DNA, 297 bp, Glycine max
  Peptide Sequence Number=SeqID_126503
atgctgcactccatgctccagagcttacacagggggcagtccattatcatgcagagccttcagggcttgggcttgccatccgttatgagcatggatgagtttgatgcacaggtggcctggccaggagcccaaccttctccttttggagggggtggggcctctgcagctcaggagcctgaaccagaggaaccagcagtagcagcaacagagggagaggatgagctcacccctcctgagcccttttattttgatgcaggtgtacacatggctcaggaggaggagacttccatagactag

SEQ ID NO: 34819 - DNA, 569 bp, Glycine max
  Peptide Sequence Number=SeqID_126504
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatcccctttgtcataacaatgaaatgggatgcacagatggatggtggtggcgggtccccggcacaagatgagtcaatggatgcatttactagtgctcaacaaagaattgataattacttaacccaaatgaaggcgacagcagagagagaaggtactcctctaatggcagatggcaagcccgtggttgtgaatgagaagcaggttgagaagtttctttatacgacgcttaagctcaattcgacaattttgagatactcgagaatggctgctgttgtgttggtgagtcttcctccacctccagtgagccacccagcatatttctatatggtaccgagctcgaattcgtaa

SEQ ID NO: 34820 - DNA, 132 bp, Glycine max
  Peptide Sequence Number=SeqID_126505
atgagcaagaggctccaagaggattgggctagagttgctgaagaaggctctagggttctaatgaacctcagggtagggtaccctagaaatataggattttttagcccttgtattttagggcacctagactag

SEQ ID NO: 34821 - DNA, 932 bp, Glycine max
  Peptide Sequence Number=SeqID_126506
acggagaccaacatgctagctatcatcgccaagtaccaagaagagttaggtctagccacggcccacgagcatagaatcgcggatgagtatgctcaagtatatgcggaaaaagaggctagaggaagggtgatcgactctttacaccaagaggcaaccatgtggatggaccggtttgctcttaccttgaacgggagtcaagaacttccccgcttgttagccaaggccaaggcgatggcagacacctactccacccccgaagagattcatgggcttctcggctattacgcaggaacagatgaaagccgacatgtcggctctgaaagaacaaatggcctccatgatggaggccatgttaggtatgaacagctcatggagaagaacgcgggcactgccgccgctgtcagttcggctgccgaagcagacccgactctcttggcaactacgcaccattctccctcaaacatagtaggacggggaagggacacactggggcacgatggcagccctcacctgggatacaaccgagcggcttacccttatggattgccgcccaactattcaccacccatgttgcaagaggaggcgggccacattgcttctcccgtccatgaaaaagagcctcctcagcagcccgacgaagcccataaagaccctcaagattatgctcggagggatgtcgagttttatcccccgatccccgaagggccggcaccaggcacgttgtcccaacccaacatcgcagcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaa

SEQ ID NO: 34822 - DNA, 366 bp, Glycine max
  Peptide Sequence Number=SeqID_126507
atgtcagtctctgcatgctatcaagcgttctgtcttacagatagcaaaagaaagtgttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggtgcagaagacgacgaataaagaatgtttatacggataaccactcgggtttttccgcccgtcaacgtgactcaaatgtcagtatgacagatcttgtgagcgcggaagatgacgtaaatctccgcatgtcaacgggcttgttggccgcaactgacgaagggtgcagaagacgacgttag

SEQ ID NO: 34823 - DNA, 480 bp, Glycine max
  Peptide Sequence Number=SeqID_126508
atggcttcaaactcccatcaatttagtgctagaagtgatgatgctattgtcattagaggagtgcatgaagtagccacgaattcatcttcatcagccaagactaagaagcttgaaggtaaactagatgccttggttaacctggtaacccaactggccatgaataaaaaatctgcacctgtcaccagactctgtggtttatgctcctcttctgaccaccatacagacctttgcccttctatgcagcaacttggagcaattgagcagcctgaagcttatgctgcaaacatttacaatagacctcctcaacctcagcagcaaaatcaaccacaacagaacgattatgacctctccagcaacagatacaatcctggatggaggaatcaccctaatctcagatggtctagccctcaacaacaacaacaacagcctgctccttccttccaaatgtggaagcaaagtttcatgatgaatcaacaatga

SEQ ID NO: 34824 - DNA, 406 bp, Glycine max
  Peptide Sequence Number=SeqID_126509
gaatggagtagtgggaataccgaggaagtgcttggaggagaaggcggaaactctggcaagccaaggagaatggtgatcgatgcttttcttgcttatcaccacagtaaggaaagcctggtcattactgttttagcatatgcgtatgatacgttcgacttaagatgtcatcgcatgtgcttgagaaagaacaaggcaaattgggaagaactcttggcaggcatgacggaagtgtctattagttggttcccacggcggaaagaagaaggcgcaagagtgttatgcttgtcgcaacctatccttcggcgggagggcgacgcggggctcacgggtgcgtcttctatgggaggaaaatgcgcggagtcgccaccaacgtttattcgaggaaaacgtcggaaaaatcggaaag

SEQ ID NO: 34825 - DNA, 399 bp, Glycine max
  Peptide Sequence Number=SeqID_126510
atgtacaattatcatgagaaaggaagagcttctgatcttgaaagtgtattggtagacttcatgacatatcaagctagctctaaaggtaattgttattcatcgcaacaacaacgaactcagtttggaaaggactattcttttgaagagtatcaatgggaatctgaatggcaaccttgttatcagaatgaagcagaaggattgtctaatctggatgacctgttaatgcaattcaagggaagaaaagaagagtatggagagattgaaacacatcaagaaagtattcttcaagttaacacaatccatcatcaattgatcaacaaagaagaaaaggatgaggtcttcattattcctgaatattcctgtatggcgactactgtctatgttgtaggcaaagattaa

SEQ ID NO: 34826 - DNA, 723 bp, Glycine max
  Peptide Sequence Number=SeqID_126511
agggctgtacatcctcgccttcataggggtgcgtgccctcgccctcagaggactacacgtcctcaccttaagaggactacacctcctcaccttaagaggactacacatcctcacctttccgggctacacgaccctcgccttcagaggactaaacgtcctcaccttcagaggactacatgcccttgccttcagaggactatgacatcctcacctttagagggctccacgccctcaccttcaaagggctacatgccctcgcctttagaggactacacatcctcagcctttagagggctacatgccctcgccttcagaggactacacgtcctcagcatcagagggctgcatgtcctcacctttggaggactacacaccctcgcctttagaggactacacgtcctcacctttagagggctacacgccctcgcgttcagaagactacacgtcgtcaccttcatagggctgcacgccctcgcctttagtgactacatgtcctcacctatagaagactacatgccctcgccttcagaggactacacatcctcaccttcagagggctacacgccctcaccttcagaggactacacgtcctcgtcttcagaggactacacgtgctcaccttcagaggactacacgtcctcaccttcagagggttgcacaccctcgccttcaaaggttgccctcgtcctcaacttcagagggatacacgtcctcaccttttga

SEQ ID NO: 34827 - DNA, 420 bp, Glycine max
  Peptide Sequence Number=SeqID_126512
atgaccactcttgcacagatatggatgacgttgttgcttagcaacattccacccggcgaccgcaatgccgatctccccctgcggaaatatcagttgcgatcgcgcccgcaagacaccccagtggacctgaagaagttcaacagggtcctagggtttccagctctgattacgggcctctgtcagttctacggagtgcccgtcacccccagcaagggatcgcgcctgcaagacacccagtggacccgaagaagtccaacaggttctacggtgtgcccatcgcccccagcaagttcatcaggccccctattaaccaggctttcatcaagaagtaccgcgcccccaggcaggcgcatggcgagacaccacggcagcctaaggatggccggcagcgggcaacaaacgcactgtcaccacctctag

SEQ ID NO: 34828 - DNA, 624 bp, Glycine max
  Peptide Sequence Number=SeqID_126513
atgggatcaagtcaaatgccttcacttaaaaggaggttctatcaagtcaaggtcaagagcctaggaaccaccagtctaaaggagttagggcagttaatgggtcagctccagcggtgcttcacctttggggacttccagctatcacctatggtagaagaatttgaagagatcctaggatgccctctagggggaaggaaaccatacctcttctcagggttctatccctcattagctagaatttccaagatagtccaaatctcggcacaggaagcaagtcgaaaatggggtggttggaataccgagaaaatatttggaggcaaaagcaagaatcttggcagtttcgcacctttttcgcaaagagatgaggcatgcttgctcgctagaaagccaccgttcatgcacaaagaaaggaggggcaaattgggaccgactcttagcaagcaaagaaggagcatctgtcaactggttccctcgatggaaggaaggaagaaccggagttcttatttcatgcggaggatttccaaatgttcccttgatggggacgaggggttgcatcagctacaatcccgttcttgctataagacaacttggctaccctatcacacgggcgctgctagaggatga

SEQ ID NO: 34829 - DNA, 210 bp, Glycine max
  Peptide Sequence Number=SeqID_126514
atgaaagattgcaaaaatacaagtggtgaggatgtctccttcacctctaggagctcacaatcactcacaaactcatttcaagctctcaaactggctcctgtttcaagctctggtggccttgttcgtgctcgtgcgcttagcgcacttatgtgccgcttagtgcacgtttgtgatttttggcttagcacgcctttctcgcttaatggatga

SEQ ID NO: 34830 - DNA, 285 bp, Glycine max
  Peptide Sequence Number=SeqID_126515
atgaactggacaagcagccttccgatcaaatcctcttggttggtgcaagccaaccggcagaagagggattggtcaatgaccattgttatccgaaacacctcagaaatcaagaatgagaggagaagaggtttgtgtaccgtgtacattgttcttccgatgagaacaacaaggaggaggaaatggtggaaggaatcggagtatcctgagccttggagtgccgttggcttctactcgaagaacccttgtgcttcttcgatggttccgccatttgagagagttatttga

SEQ ID NO: 34831 - DNA, 308 bp, Glycine max
  Peptide Sequence Number=SeqID_126516
ggatcgcgcccgcaagacacccagtggacccaaagaagtccaacagggtcctggggtttccagctctgattatgggtctttgtcagttctacggagtgcctgtcgcccccagcaaggtcatcaggccccctactaatcgagctttcatcaagaagtattgcgcccctaggcaggcgcaaggcgagacaccacaacagcctggggatggccagcaacaggcaacaaatgtaccaccgccacctccagagcccctcagctcatccacaaaaaggttagagtattgcctacgacacatggccgaccaatag

SEQ ID NO: 34832 - DNA, 498 bp, Glycine max
  Peptide Sequence Number=SeqID_126517
atgactcaaaagctggtaacttgcggagacaccttacggttatccgcacctcgtcattcagtgaccccaagtgtgattgatgagcagaggccaatatggtcatctgcgccctttccggagatgtcagcatcttccggtggagactttttcaagtctcacaagttatctagaactacgagcaagagcattgcttttatcggccaccccacaagatctgtcatactgaccctgaggtcatgtgacatgcggagacaaaatttggtcattccgcacccctttgccattcagacacagtcgtgtccgatggcgcgcagagacaaaaattggtcattctgcaccctttgtcatccagaggcggcgggcccgatgacatgcggagacaaaatttggtcattccgcaccccttttccattcagacacagtcgtgtccgatggtacgcagagacaaaatttggtcattctgcaccctttgtcatccagaggcggcgggcccgatga

SEQ ID NO: 34833 - DNA, 351 bp, Glycine max
  Peptide Sequence Number=SeqID_126518
atggtggggtacataccttcaagctttgcggatttggtcttcatcggggaaaggatcgaagcgggtctgaaagaggccaaatttgatcatcctgctttgatgaatgagaaaactggggcaaatgaagaggatgagaatgaggaaggaacccatgttgtggctgccattcctacatggtcaaacttcccaccagcccaacaatgtcattactcagccaatatcagcccttctcattacccatcacctagtcatccacaaaggccatccctaaatcaaccacaaagcctacccgccgcacatccggtgccaaaacaccaaccaaaaaggaattttgtagcaaaaagcctatag

SEQ ID NO: 34834 - DNA, 636 bp, Glycine max
  Peptide Sequence Number=SeqID_126519
aaggtccgcaaggcatgggaggtgttgcaaaagaaggacaaggaacttaggggcagtaacaatgggcccatcggtggctatcgtaagtggttaaaagcccacgtgcaaggtttggattggctcccaagtttgagaaccgctaaaagagaggaagttgaggcaccggaggaagacgaagagctgcaagcccttagggcagaactcgagcaagctcaaacagtcaaagaaaggttcaaatcagaagctctaaagatcctaaaagagaatgccgaactaggaaatgtaaatatagctaccaccaaggctttggaacaagagaccaagagggctcgtagggaagagcacggccagaacaagtttcgaggggctttgtggggtagcaacagtgagctcaagcttcgaagggaagagagagaccagtcacgagcacatagcatggtcttgaaagaggagttagctgcttgctcaaggtccaagagaaacttgtctcagcatttatgcgagacaaagaccaacatgttagccatcgtcagcaagtaccaagaagaattaaatctagccacggcccatgagcacaaagtggcgggcgagtatgcccgagtgtacgcggaaaaggaggctagaggaagagggtga

SEQ ID NO: 34835 - DNA, 49 bp, Glycine max
  Peptide Sequence Number=SeqID_126520
ggtgaacgctgtgaaaattttcccggacgcccaaaatggactcggatga

SEQ ID NO: 34836 - DNA, 285 bp, Glycine max
  Peptide Sequence Number=SeqID_126521
atgaaggctctaaatctcgtagaagctcgtgatacacttcctcctccttgggcgtcatgtcagagtgatctccccggtcctcagtcacctacacgggacatactaactcaaatctccaacttaagacattacctctcgcatcaaacctcattagggagtgtggcagtaccaatgatgattgatggtgatgagcatgtgtcataccctaatttcgtccgggggcctttgctcgatgacgtgcgaccattctttggtcctcgtgaggtgcttggcacccatcattag

SEQ ID NO: 34837 - DNA, 282 bp, Glycine max
  Peptide Sequence Number=SeqID_126522
atgcgcgaacaacgcttgacaatcaattcatggcgctccggactcgatggtggaggatacatgaacgacgatcaattcatggggttccgaataagatttgatgatggaggatgtacgaacagtggtaggcaatcaattcgtgggactccaaactcgatggtggaggatgtgaacgacgatcaattcatgggactccgaataagattagatggtggaggatgtacgaacagtgctaggcaatcaattcgtggggctccggattcgatagtggaggatgcatga

SEQ ID NO: 34838 - DNA, 252 bp, Glycine max
  Peptide Sequence Number=SeqID_126523
atgcggggttaccttgtggttacccacacctttcttcaaccaagggcaaacgagcccgttgacgcgcagagactaacatcgtcttctgcaccttctgttgtcctgacccgtgaagtcaggcccgttgacacgcaaagactaacatcgtcttatgcaccttttgtcgtcctgacccgtgaagtcaggtgtcatgcggggttaccttatggttacccgtacctttcgtcaaccagcggcaaacgggcccgttga

SEQ ID NO: 34839 - DNA, 456 bp, Glycine max
  Peptide Sequence Number=SeqID_126524
atggatacctcagagccctacattggggcaatgaaaggcaccatgtgtgagcctcaggcgaacctaggggcaggtcaaaagttctcacccatcaatgtttttaaacaaaaaaagagaagtgacaaaccctgggatttcaatcaattgattaaacggctccattgccgtcactccaaaattgtcaaatttcctacatctaatgtccaatcttttgcatttgggatgatcgaccctctcgatgagtcaatctcttgctttctcataagggtggacccttgggtactagtacctattgcctttagagggctacacgccctggccttcagagggttggacgccctctccttcagaggtctgcacgccctcgactttagaggactacacgtcctcgactttagagggctatatgccctcgccttcagagggctacaggtcctcgccttcagaaggctacag

SEQ ID NO: 34840 - DNA, 108 bp, Glycine max
  Peptide Sequence Number=SeqID_126525
atgggtttgtcaggtcactctcactatcataggcttaaaggagcactcaaacccggtgacccccaaggcctacactccgaagagtccgtcagggcctctccctcctga

SEQ ID NO: 34841 - DNA, 843 bp, Glycine max
  Peptide Sequence Number=SeqID_126526
atgagaccagatgtcaggcccggcggtggattgtcgcagctcgcgcttatttgctgcaccttgtcggttgcactctttttgctaataagagtgcaacatacgtgcatgtggtccatcttgacgctttccgggacctcgctcatagtggtggttacgcttggggggttgccgcgcctggttcatatgtacgaccagttagatgaggcttgtaggaccaccaccagacagcttgcggggtacttgacgctatttcagtgctggatctatgagcacttccctagtgtgcatcagtgcgtgactgacgatacataccaggagacgtccccacgtgcttcccggtggttgacgtcgaaggcgcacatgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcgcagttcgaccggagagggtggtacgccagttcggttacatccagagcatccctccgccgcctgttagtgcacgattgtcacaggatcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtg

SEQ ID NO: 34842 - DNA, 216 bp, Glycine max
  Peptide Sequence Number=SeqID_126527
atggcatttttcctaagctacacaaaagcaaagactgaaacgcttaaattagagatgctctcgggaacggaagcttctagcacactccagacatcttctcaaagatcccaatggtcagatcatggacaaacagcctctgagtgtggactacagagaatgaagaagcagagcaaggagccaatttctcaacttttagagatattaggaagcttttga

SEQ ID NO: 34843 - DNA, 627 bp, Glycine max
  Peptide Sequence Number=SeqID_126528
atgggtgaagtagagaaggtgcaagagcagatgaaggtcgacatggaggccatgaaagagcaaatggccacaatgatggaggccataataagcatgaaaaagataagggaagtcgatatggttgcagttgccgctaccaacgctgttgctaaggtgaacccgatgcccccatttggcctcaagcaaatgaatcatccaacctcaaatatggtaggcaaagatttgggaagtacggatgacaccatgatgtgcaaattcaaaacaagcacgccttcccgccatatggcttgcctcccaaactatacaccacccaatgtggcgtacattcccaatgaggatgccaatacctccacacccatactcattaagatccaacaacctcaatctgatcatgcacatgtctctcgacccatggaggagacacatggaatgccccaccacaatctagccgacttcgagccttgcctcggatatgccactgaagagaaagcagttggtggtatacccctgcaaaacactttggagggccctcagtgtcacccacaaccacaaccctcacattccacagcggttaaaaccctcatgctatggcagaaatgggaaaggggaaaggctcagggccattga

SEQ ID NO: 34844 - DNA, 913 bp, Glycine max
  Peptide Sequence Number=SeqID_126529
atgggtcagctccagcggcaagctttttgcaaagcttatggtaagatctgggacctagccatggtagaagtctctacagaggccattgcctccctcgcccagtattatgatcagccgttgaggtgcttcacctttggggacttccaggtatcacccttggtggaagaatttgaagagatcctaggatgtcctctagggggaagaagaccatacctcttctcagggttctatccctcattagctagaatttctaagatagtccaaatctcggcacaggaattagaccatagaaagcaagtcgaaaatggggtggttggaataccgagaaaatgtttggaggcaaaagcaagaatcttggcaggtaaaggcaaatgggcctcgttcatagacattctcgcactgttgatcttcggaggagtcctctttccgaatgtggatgggttggtggacctagcagtgatcgacgcttttctcgcctatcataaccacaaggaaagctcggttgtcgctatgctagccgacctatataacaccttcgacggaagatgtgagaagagcagtacgaggattgtttgttgtactccagctctttatgtatggttggtttcacacctttttcaccaagaggtaaggcatgcttgcccgctagaaggtcatcgctcatgcacagagagaggaggggcaaattgggatcgactcttagcaaacaaagaaggagcatctgtcaactggttccctcggtggaaggaaggaagaaccagaattcttatttcgtgtggaggatttctgaatgttcccaagatggggacgaggggttgcatcagttacaatcccgttcttactataaggcaacttggctaccctatgagacggacgccactagaagaagggctcgcgcctgtcctttcacgag

SEQ ID NO: 34845 - DNA, 1119 bp, Glycine max
  Peptide Sequence Number=SeqID_126530
atgttcggagacttccaattggtaccaaccattgaagaatttgaggagattcttggatgtcctctcgggggaagaaaaccatacctttcctccgggtgtctcccctctttgagcagaattgcaattgtggtcaaggattcagcaagaggtttggaccgcatgaaacagactcgaaaaggcatagcgggcctaccacggaagtacctagaagacaaggcgaggggtatggccagtcaaggagattgggtctcgtttatggatgtgttagctttgctaatttttggggtcgttctctttccaaacgtagatggtttggtggacctagcagcaatcgacggtttccttgcataccaccatagcaaggaaagtccggtggtagctgtcttggcagatttatttgacacatttgaccgaaggtgcgaaaagagtagcgcacggatcatctgttgcttgcccgctctctgtgtttggttggtttcacacctattccagcaagacacgaagcatccatgtccgctccaaagccatcgctcgtgtactgaaaagagaagaatagattgggaccagcttttggctgggataggagttcatacacgaggtttagattggctcgccaagttaaaggttgtcagcgaagagagtttcgaagcgccggaagaggacgaagaagtccaagctctcaaaaacgagttaggaaaggcgagacttgccaaggagaagttcaagttagccgctacagacatccggaaagagtgtgtcggattacgagaagagaatgcaactaccgcaagagcccttgaacaagagaccaagagggctcgcaaggaagagtatggtcgtaacaaatttcgcggagctttgtggggtagcaacagtgaactcaagctgcgaagggaagaaagagaccagtcgcgagcacatggcatggtcttgaaagaggagttagttgcttgttcaaggtccagaagaaacttgtctcagcgtttgtgcaagacggagaccaacatgctagctatcatcgccaagtaccaagaagagctaagtctagccacggcccacgagcatagggtcgcggacgagtatgcccaagtatacgcggaaaaagaggctagaggaagg

SEQ ID NO: 34846 - DNA, 545 bp, Glycine max
  Peptide Sequence Number=SeqID_126531
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatcccctaccggcatatggccaataccctgtcattgtataggacagttaagcggctaggaataccggatgagaggattatactcatgcttgcagatgacatggcatgtaatgctagaaacaagtaccctgcccaagtttttaataatgaaaaccatagacttaatctgtatggggataatgtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 34847 - DNA, 585 bp, Glycine max
  Peptide Sequence Number=SeqID_126532
atggcatctgtaaaagtgaaatctccaatggtgcaacggacagtaaaagtgtcaggatctttgcacttctatggcaaggtggatggtgcaatggtagcaacagttttgttctgtataagtgtagaaacatttctgcccatcttcactggcttattttcctttagcttcttctcacgggtgaacaaatccttcaagaatttagcatattttggaatctgtttaatggcatccaagagaggaatgttgacttccaccctcttaaaagtctcaagaagatcaaaatcaagctctactttctttgcaagaatggatctagatggaacaggtgatccgcaggagaaggaaatagaccaccacggaggactcttggtgactatgcttgtcaacaaggacaagcattatgacaacatagtcattcctcctttcagcaacaaggttgtggaattcaagccaacactactcagtctgattggctcacacccttttgccggaatggatcatgaggatccatacacacatttgtctaccttcatggagttgtgcagtaccatgggagcttccgaaaaaaatgttgaagctgtctag

SEQ ID NO: 34848 - DNA, 222 bp, Glycine max
  Peptide Sequence Number=SeqID_126533
atgtcaaatcataaaagtagtgagtcagcactgaagaaccttgagaatgaagataagagtagaagtgataaagctgtgaacgaaggtaaggaagtaccatatcctgtggtaccttccaagaaggagaaggaaattggaaataaccatgcccttcggagaagctttacaacagatgccactctactccaagttcttgaaggatatgttaacaaggaaacataa

SEQ ID NO: 34849 - DNA, 399 bp, Glycine max
  Peptide Sequence Number=SeqID_126534
atggcaagagctggtgacaatggtggtgtatatcatcaactggatgaatctcaacgcttatttctggacgcgtggactacacaaatgcaacgtttgttgaccaaatcttccttgtttactcttaaacctctatcccctagagaagtgtgtgatgaccaaatcagaatgagagaaaagagagaacaagagaaggaaaatagtgaggcaccacaaaggaatatgaaaaagagtgatacacccgaggaaaagagtgatacacatgagagaaaatttaattattttgcagaggcgagtgaagtgaggaaagtgttacctgctcatgaaccactcaatctacagaatttaaaaatgtctttcctaaggagattcctcatggactaccaccttcaagaggcatag

SEQ ID NO: 34850 - DNA, 396 bp, Glycine max
  Peptide Sequence Number=SeqID_126535
atggcttcattcagctccggttcccaacgatcaaggcgagttacaggatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 34851 - DNA, 179 bp, Glycine max
  Peptide Sequence Number=SeqID_126536
atggctccgaaaaagctttccacaaagagatctaggagagacgccgcggcgaaagggtccagtgccgcccccgagtttgatagccaccgtttccagagcgtcgagcaccagcagcgcttcgaggccatcaaaggatggtcgttccacagagagaggcacgtccagctcagggaggatga

SEQ ID NO: 34852 - DNA, 579 bp, Glycine max
  Peptide Sequence Number=SeqID_126537
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcccctcaacttcatccatggtcgattccatcatggaagccctagaacccactgtcccaggcctcctcgccgtccccatcgcttccaacctccgctcacaccttctctctctctctcggaaactcgctcttctcgacctcgacacccgaaaactcgttctcaagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 34853 - DNA, 192 bp, Glycine max
  Peptide Sequence Number=SeqID_126538
atggaacacatctccaaactcgaaaatggaggacacatgaacagccctaagcaatcattcatgtggttccggaaaatgatgataatggaggattgccttgatgctcctaactcagaagatggaggacacatgaatgacaacgcaatcattcttgtggctccgaaacaagatgataatggaggattgccttga

SEQ ID NO: 34854 - DNA, 649 bp, Glycine max
  Peptide Sequence Number=SeqID_126539
atgtttttcttatatgcatatggaggaacaggaaaaacatttatttggaagacacttgtagcctcattgagagctgacaataaaataattattatggttgtttctagcagcatagcttctttgttattgcctggaggaaaaatagcacattcaaaattaaaaattcatgttccgatatttgaagactcgacatgcaatattcatcaaggaacacatttgactgaattattgaatgaagcaagtcttatcatctgggatgaagcccctatggctcacaaattctattttgaagcacttgatcgaagtctaagagatgttattaaggtgaaatcaagttctgataaaatctttgatgaagccaatacagatgcaacagacagagaagaaactgcagcttttgcagagtggatccttaatattggtgatggaattgttggccagcaaaatgatggttattgttcaattgaaattccaacagatctgttaatcacagaatatgatgacccactctatgcaatagttaattctacatttccaaatttatctcaccatcatacaaatcctgaatactttcaaaccagagccatattagcttccacaaatgaaaccatacaacaaattaatgattatatactatcattgataccag

SEQ ID NO: 34855 - DNA, 555 bp, Glycine max
  Peptide Sequence Number=SeqID_126540
atggagagaagtatgatagatgctgccagtggtggagcccttggagacatgacccctgctgaagccagaaatttaattgaggagatggcttcaaactcccagcaatttagtgccagaaatgatgctattgtcattagaggagtgcatgaagtagtcacgaattcatcttcatcagctgaaactaagaagcttgaaggtaaactagatgccttggttaacctggtaacccaactggccatgaatcaaaaatctacacctgtcgccagaccctgtggtttatgctcctctgccgaccaccacacagacctttgcccttctgtgcaacaatctgaagtaattaaacagcctgaagcttatgctgcaaacatctacaatagacctcctcaacctcagcacaacaggtacaatcccgggtggaggaatcatcccaaccttagatggttgagtccttcacaacagcagcaacaacaacagccttatttccagaatgctgctggcccaagcagaccatacgttcctccaccaatccagcagcaacaacaacaacaaccctag

SEQ ID NO: 34856 - DNA, 501 bp, Glycine max
  Peptide Sequence Number=SeqID_126541
acagcaaaaaagtttatacggataaccactcgggtatttccgccagtcagcgtgactcaaaagtcagtatgacagatcttgtgagcgcggaagatgacgtaaatctccgcatacaacaaaaagtttatacggataaccactcggatatttccgcccgtcagcgtgactcaaaagtcagtataacagatcttgtgagcgcggaagatgacgcttttcggcttacagaaccagcaaaagtttatacggataaccactcgggtatttccgcccgtcagcgtgactcaaaagtcagtatgacagatcttgtgggcgcggaagatgaccaaaaagtttatacggataaccactcgggtatttccgcccgtcagcgtgactcaaaagtcagtatgacagatcttgtgagcgcggaagatgacggcgcagaagacgacattagtctctacgtgctatcaggcttttcgtcttacagacagcaaaaattttatacggataaccactcgg

SEQ ID NO: 34857 - DNA, 675 bp, Glycine max
  Peptide Sequence Number=SeqID_126542
atggaagtagatctgtctgtcccctacaaggtcattgcatggacgaggggttgcattatttataaccctgtgttggccataagacagtttggatatcctatgagaggtgcgtcatcggaggaaaccatcatgcctttcatcacacgagggtttaacaaagcgaatatgaagatacttcagaagatccgtaaggcatggaataaagtgggaaaaaaagataaagagcttagaagaagaagcaatagtgtcataggcgactatcataaatggcttaaatctagaacgcaagggatagcttggcacaaaaagctaaagggtttgaatggagaagaggcaggagtgcccgaggagagtgaagaggtgcaagacttgaaggctgagctcggaaagacaaaagtagagaaggagaagctgaaggtggtagtcactagagttaggaaagaatgtgataagctgaaggatgtcaacatgtccacgactgaagcgctagagcagaaaatgaagaaagccagaaaggaagagtggagtagaaacaagtttcgaggggctttgttaggcagcagtaatgagctcaaagttagtaaggccgagaaagacaaatcaaggatggagaacatgatgttaaaggataagttaaggaattttcaaaggtcaaagggaagtttgaaagaatag

SEQ ID NO: 34858 - DNA, 379 bp, Glycine max
  Peptide Sequence Number=SeqID_126543
acaagcccgtcagggcgcgtcagcggttgttgccgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatgggtacgagtcttttgggaaacggttatttag

SEQ ID NO: 34859 - DNA, 492 bp, Glycine max
  Peptide Sequence Number=SeqID_126544
atggatttcttttccaatgagagttttgaatgcattcaggcatttgaaaactccaatctcattcctttcatatctttaaaattgcctgtttacactgaattagttgaagccttctattctaacatagaaatccaagaaggcactttaatttctgaagtctatgggataaaaatggtcattgacaaatccctattctatgacttgacccaattatccagtgaaggtgtaccatttgaaggtacactgaatgatgattggaaatttgatttctctgtgcatgatgcccaccggttggtttgcaccaaccaagcggatatgaccggaaggcttcttcctagttcattggcttttgaaagctgcatccttcattatctcattgtgcgtatcttgcttccaagatcttcaaaccttgcacaagtttctaaagatgatcttattgtcatgtgggcttttcacacaggtcgacaaattgattgggcacacttagtctga

SEQ ID NO: 34860 - DNA, 1336 bp, Glycine max
  Peptide Sequence Number=SeqID_126545
aagccattgcatcactcacccaatactacgaccagcctttgagatgcttcacgttcggagacttccaattggaaccgaccattgaagtatttgaggagattctaggatgtcctctcggggaaagaaaaccatatcttttctccggttgtctcccctctttgagcagaattgcaactgtggtcgaggattcagcaagaggtttggaccgcgtaaaacaaactcgaaacggcatagcgggcctaccacggaagtacctagaagacaaggcgagggatatggcaaatcaagaagattgggtcccatttatggatgtgttagcattgctaatctttggggtcgtcctttttccaaacgtagatggtttggtggacctagccgcaatcaatgcgttccttgcataccgccatagcaaggaaagtccggtggtagctgtcttggcagatttatttgacacatttgaccgaaggtgcaaaaagaagaagaatagattgggacagcttttggctgggataggaggtagaacaatcaattggttcccccgatggaaggaaggaaatgagggagtccttttctcatgtggagggtacccaaacattccgctgataggaacgaggggttgtattaactacaatcccgtgctcgctataagacaactagggtaccccatgaggggagcaccgatggaagaaagcatgtctccttttcttgtgagggatttcagcgcgcaaaatttcaaggctatacaaagaatccataaggcatgggaaaccgcgttaaggaaagatcaagaacttaggggcattcgtaatggcatcattggtggttatcatgaatggctaaaagttcatatacgaggtttagattggctcgccaagttaaaagtcgtcagtgaagagagtttcaaagcaccggaagaggacgaagaagtccaagctctcaaaaacgagttaggaaaggcgaaacttgccaaggagaagttcaagttagccactacacacatccggaaggagtgtgccgaattacgggaagagaatgcaactaccgcaagagcccctgaacaagagaccaagagggcttgcaaggaagagtatggccgtaacaaatttcgcggagctctgtggggtagcaacagtgaactcaagctgcgaagggaagagagggaccagtcgcgagcacatagcatggtcttgaaagaggagttagttgcctattcaaggtccaaaaggagcttgtctcagcgtttatgcgagacggagaccaacatgctagctatcatcgccaagtaccaagaagagttaagtctagccacggcccacgagcatagggtcgcggacga

SEQ ID NO: 34861 - DNA, 897 bp, Glycine max
  Peptide Sequence Number=SeqID_126546
cgcggctggcgtacccgctggcgcgcgccctgtccggtcattgtcgttggcaacctgaccgcgggcggcaacggtaaaacaccgctggtgatttggctggtgcaggcgctgcaacagcaggggctgcgtccgggtgtagtgtcgcgcggttacggcggtaaggcggaacgctatccgctgctggtcaatcaggatagcgcgacggaacaggctggtgatgaaccggtgctgatcgcccagcgcactcaggtgccggtggcagtggcaccgcagcgccggcaggcaattgaggccctgctggcggcgcatctgctggatgtgattgtgacggatgatggcctgcagcactatgcgctagagcgcgatcgcgaaatcgtggtggtggatggcgtgcgtcgctttggcaacggctggtggttaccggccggaccgatgcgtgaacgcgcatcgcggctggagcaggttgatgccgtggtggtcaacgggggcagcgcgcaggctggcgagatcgccatgacgctgcagccgggtctggcggtcaatttgctgaccggtgaacaggctgcgctgacgcagctgccgccagttgtcgcgatggccggcatcggtcatccgccgcgtttcttcactacgctgcagcagcagggcgtgcagccggtggcagagatcgcctttgccgatcaccacgcttacagcgaagaagagttacgcagcctgactcaggatgcacagtgcctgctgatgacggaaaaagacgcggtcaagtgccgccattttgcccgcgctaactggtggtatctgccggtggatgcgcatctggcgggcgcgccgctggccgcattactggccgatctgacgcaactctgtacagctgcgcgcgacgcccggtcgcgctaa

SEQ ID NO: 34862 - DNA, 522 bp, Glycine max
  Peptide Sequence Number=SeqID_126547
atgttggatgaaaataatgctcatgcaaaaagtttcaggatggcaagggatagattgacagacactcaagtgcataatgtcagactcaaattgattgatggtcgtacatataatataccaagtgttccagaagttgctgcacttattgcaggtgatattgatgcaaattcaaacatagatattattgttgatactcaaaatgggcaattacagaggatacatgaattacattgtagttatctagctctacaatatcctctattgtttccttatggagaggatgaatataggactgacattctacatcgtgatacattaagtgggaaaaaaagaaaaaggaatcgtcttacaatgagaaagtggtttgcttatagactacaatgcagacccaatgaaggtcaaactctgttgcattctagaaaactagtccagcaatttgttgctgaaggatacacaatgattgaatccgaaagactctcctatcctttcaagagggtagcaggctcacattcacctttctaa

SEQ ID NO: 34863 - DNA, 339 bp, Glycine max
  Peptide Sequence Number=SeqID_126548
atggttaaggaggagtgtaaggaggtaagtgtctcctccaagaggttagctaagaaggaaagtcattttgaaataaagacaaatattaaagaaacttcccctcttggacaacctccatatattctcctttgtaaaaagacacttgttagcactgtcacacctcttgggcttgacgttattcctcaagtaaaggagttgttggatgagggtttggttcgtgttgacggaaggagcccaaagtatgaagaacctcaggatttgaggtcaaatcctttccaaggtggagggaatgatgcaatcgtaccccacaaagggcattggatagaagactccaagtag

SEQ ID NO: 34864 - DNA, 672 bp, Glycine max
  Peptide Sequence Number=SeqID_126549
atggtagaagtctccacagaggccattgcctccctcgcccagtattatgatcagccgttgaggtgctttacctttggggacttccagctgtcacccatggtggaagaatttgaagagatcctaggatgtcctcttgggggaaagagaccatacctcttcacagggttctatccctcattagctagaatttcaaaaatagtcaaaatcttggcgcaagaattagaccacagaaaacaagtggggtggttggaataccgagaaagtaaaggtgaatgggccccgttcatagacattctcgcactgttgatcttcggaggagtcctctttccaaatgtggatgggttggtggacctagcagcgatcaacgctttcctcgcctatcatgaccacaaggaaagcccggttgttgctatgctagccgacctatatgacaccttcgaccaaagatgtgagaagagcagtacgaggattgtttgctgtactctagctctttatgtatggttggtttcacacctttttcgccaagaggtgaggcatgcttgcccgctagaaagtcaccattcatgcacagagaaaggaagggcaaattgggaccaactcttatcaaacaaagaaggagcatctttcaactggtcccctcgatggaaagaaggagaaccagggatcctctag

SEQ ID NO: 34865 - DNA, 295 bp, Glycine max
  Peptide Sequence Number=SeqID_126550
atggctccaagaaagcttcctgcaaagagatccaggaaggacaaagcggctgaagggaccagtgccgagcaccagcagcgtttcgaggccatcaaaggatggtcattccaccgagagagacgtgtccagctacgggacgatgagtacaccgactttcaggaagagatagctcgccggcggtggacattgctggttacccccatggccaagttcgacccagacatagtcctggaattttatgtcaatgcttggcctacacaggagggcgtgcgggatatgcgatcttgggtgaggg

SEQ ID NO: 34866 - DNA, 531 bp, Glycine max
  Peptide Sequence Number=SeqID_126551
atgccgcccagcggaccttccagccaggcagggcgcaaggccagcagcatgatcagcgacatcaggccgatggaccagacgcctgtcaggtacagcgcctgctggcgcagcacccagggccaggcggccgtggccgccggttgcagcaccagggcgtcgatggcccaggcgccggtcagcgccagcaggaacagtcccagggcggtacgggttttcatggcgtcggcctcaatccttgatacggctgcgcagcaccgcgccggtctgcgcgtccacccgcagcttcacgcgctggccttgcgggttgtcggccttgacgtcgtagccgcggtgatgctccagttcgatctcggtgatgttgcgatagcccgcggcggtcagcgtgtcatagacctggcgcacggtcaggatctgcgcggcgggggcggcctggaccggcgcggttgcggcgggcgccggagcgggctggggcgcggtctgcgccagcgcggcggtgccggcgagggcggcggcgccgatggccagggctga

SEQ ID NO: 34867 - DNA, 708 bp, Glycine max
  Peptide Sequence Number=SeqID_126552
atgaccacactcgctcagacttggagtgttctttcttactccaacttggttcctacctcacacacttctgacatcacacttgatagggccaagttgatttatgagatgataatgaagatggataggaatctgggctacctcatctcccaccagatctctattattgcccagaatgactcctctaggcttggattcctagccttaatcacaactttatgtaaagctagaggagtcacatctgattccaggactcttaagagccttagccccaccatttacttggcgtacattaagaagaactgttggaatctggatgatccaatagtaacattcagagggcctaagaagaccaggggcaagagattagaggcccctactacttcagcagcaccagagacagccgcaccttcttcatccactcctccagcaccttcttcttctactccatctactcagataccacttccagctcattcatcttttggaccctcaaattttttgtttacttcagagatgcttcattctatgctccagagcttacacagagggcatgtcattatcatgcagagtctccagagctcaggcctgccatttatcatgagcacagatgagttcctgactcaggtggcttcgttaggagtccagccttctccttctggagggggtgggacctctgcagctcaagagcttgaggttgtagaggagtag

SEQ ID NO: 34868 - DNA, 337 bp, Glycine max
  Peptide Sequence Number=SeqID_126553
ggccctggggttttcggctctgatcacaggcctctgcccgtcctacggagttcctgtcatccccagcaaggtaatccgaccgtcgatcacccgaactttcattgagaagtactacacgcctaggcaggcacagggtgatgcacatcaggccgcgggcgcactgccaccacctcgacaggccgatccgtttggggctgaggtcgcatggcctagagactggcccgatgcccaggcaggggaggagcctgcaggatcccccggtggggcggatgagtcccatagggatgaagatatgactgacctgctcggtttcttgggagggagcggagccacatga

SEQ ID NO: 34869 - DNA, 76 bp, Glycine max
  Peptide Sequence Number=SeqID_126554
atgcatgagaacgaatggcacggagcgtgtttgctccgtgcccctattttagggacctataggacaatatctaggg

SEQ ID NO: 34870 - DNA, 625 bp, Glycine max
  Peptide Sequence Number=SeqID_126555
atgcctcctatagtagtcataactcttgcaagagccttagtgaagaacttcgtgactattacgaaggaaggcataggtcacatcttagacctcactcccatagaagagaaaaggaaagaaagccttaagaggctaacattaacctctcatacttccatgggaaggacaaaagaccaaggtcaaggcatcttaggggtgacaccttctaagcccaaagatgataagggggagacaatagaaaagcaagcccctaaggctagtatgcaagagaaaactagctctataaagtgctttaaatgtcgtggaaaaggacacattacttctcaatgccccaccactaaaaccatgattacgaggggccaagacatttatagtagccaagatgaggctactacttcaccttcctctagtgaaagtgaagaagcaaaagggaaagaatctagtgaagaaatttacccccaagaagaaggacaaccattagtggttaaagagaagtgtaaggagacacttgctagcattgccacacctcttgggcttgagtttattcctcaagtaaagaagttgttggatgagggtttggttcgcaagagcttaaatccttgtgctttgttggtgcccaaaatag

SEQ ID NO: 34871 - DNA, 492 bp, Glycine max
  Peptide Sequence Number=SeqID_126556
atgctattccagtttcttgcgctgggggcctgttgctgtttattatcgaccggagagggtcgtgcagcagttggctacacacagaccattcctgctcctcctgtcgattcatgggtctcgtatgatgatatacacgacaggtggatgcactacgaggatcatatcgtaccagcaagtgaggtgtgcgttgtgccaagggtgtgttctagtgactacatcgactggttcttccgcatctcccatcctttcatgacaccaggccacccccgagtcgtccctgaggccccgcagacggatatccctcacgtgtcggagccaggagcatcgtcaacatctgcggaggagcccagacatgcagtggaagtttgtgatgatattgttgagaggttggagcgccatctgagtctaggggtggtcacgcctggctcttcgacacatgaagtgatcgaagaatgcctcagattggccaggagtgtgacacatgaccatcta

SEQ ID NO: 34872 - DNA, 120 bp, Glycine max
  Peptide Sequence Number=SeqID_126557
atgatgcatgcacctgacctcaactctcagatgcaatgcgtatttgtcgaggccacccagtcgtgcaccataactcccccctcggtgatcaacctggggccacaaggagttccctactag

SEQ ID NO: 34873 - DNA, 319 bp, Glycine max
  Peptide Sequence Number=SeqID_126558
atgggggagttacttcaagtttgggagaagatggatctgccactggagaatgtggatcagttggcattggttcaacctgcacagctggctcgtcagatccctcctattgaggtgcctgagctacaaaccttccaccaattctcacaaccgagggttgagctccaggccaggccacctactcaaggaactactcaactgacagaatggatcctggaggagctaccatctctctgggcatctggtcctgctgatgcagacggaggcgctggagaagatggtgaagggatggtgcgcttttgccgaatcaaggccgcaaaag

SEQ ID NO: 34874 - DNA, 90 bp, Glycine max
  Peptide Sequence Number=SeqID_126559
atgccaagcacctcacaaggaccaaagaaaggtcgcatgtcatcaagcaaaggtccccggacgaaattagggtatgacaacgagtaccaa

SEQ ID NO: 34875 - DNA, 549 bp, Glycine max
  Peptide Sequence Number=SeqID_126560
atggagacacttcagaaggtccgcaaggcatgggaggttgtgcaaaagaaggacaaagaactcaggggcagtaactatgggcccattggtggctaccgtaagtggttaaaagcccacgtgcaaggtttggattggcttccgagtttgagaaccgctaaaagggaggaagtcgaggcaccggaggaagacaaagaggttcaggcccttaggacagaactcgagcaagctcaaacagtcaaagaaagagctcgtagggaagagcacggtcgaaacaagttccgaggggctctgtggggcagcaacaacgagcttaagcttcggagagaggaaagggaccaatcacgagtagacagtctgatcttgaaagatgagttgaaggcttgctcaagctccaaaagaaacctatctcagcggttatgcgagacagagaccaatatgttaaccatcattagcaaataccaagaagaactaaatctagccacgacccacgagcatagagtggcagacgagtatgcccaagtgtacgcagaaaaagaggctagaggaagg

SEQ ID NO: 34876 - DNA, 348 bp, Glycine max
  Peptide Sequence Number=SeqID_126561
atggagtggttttttcggatatcgcacccatttgtcacacggaccgaggagactgctgcgccgagacatccgcctccccctcatcatgaggagttcgtcgagccacccatccccgaggtttcagtcgcgaccgatctccctacgcattcagtggttcactgcgaaggatgtcaggggatggctcaggatttaggagcgattgctgaggatctggagcgggtcatcaacctcaggatggtcactgagggcattaacttacatgacatcatgactcgttgtctgaggagagctagaggtgacaccgcagatggaagtcttaggccacgccagagatgccgcatagattag

SEQ ID NO: 34877 - DNA, 87 bp, Glycine max
  Peptide Sequence Number=SeqID_126562
atgaagagatgcattaggcgagcaaggaaaccagacatgggactatcagtgacaatgcatcagcgaaaagaggaaaactctagatga

SEQ ID NO: 34878 - DNA, 942 bp, Glycine max
  Peptide Sequence Number=SeqID_126563
atgcgttacgtggatgaataccgcgcacccgagcagttgctacagcttatcgggcatctgagaacacgttcggcgctgctggactacacggcggaaaacccgcttcggatcatggaggtgttcggcggacatacgcacgccattttcaaatttggcctcgaccagctgctgccggagaacatcgagtttatccatggccccggctgtccggtctgcgtgctgccgatggggcgcatcgacagctgtatcgagattgccagccggcccgacgtcattttctgcacctttggcgacgcgatgcgcgttccggggaaaaacggctcgctgctgcaggcaaaagcacgcggagccgacatccggatcgtctattcgccgatggatgccctgacgctggcagcggataaccccacgcgcaaaatcgtgttttttggcctggggtttgaaaccaccatgcccgccaccgccattacgctgcagcaggcgaaagcgcgcagcgtcgataactttttcttcttctgccagcacattacgctcatccccacgctacgcagcctgctggaagcgccgggaaacgggattgacgccttcctggcgccgggccatgtcagcatggtgattggcacagatacctacggttttatcgctgaacagtacaatcgtccgttagtggtcgctggtttcgaaccacttgatctactgcaaggtgtcaccatgctggttgagcagaaaatagcggccctgagtgccgtggaaaaccagtaccgccgcgtggtgccggatgcaggaaatgaacgggcacagcaggcaatagccgacgtgttttgcgtcgaaggcgacagcgaatggcgtggcctggggctgattgccgaatccggcgtgcgcctgacgccggcctatcgcgcgttcgacgccgaagcgcatttccgcccgcagccgcagcag

SEQ ID NO: 34879 - DNA, 336 bp, Glycine max
  Peptide Sequence Number=SeqID_126564
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcagcctgcgcaactgttgggaagggcgatcggtgcgggcctcttcgctattacgccagctggcgaaagggggatgtgctgcaaggcgattaagttgggtaacgccagggttttcccagtcacgacgttgatccccatgggtgctgacatgcctgctgctggtgctggacctaaaattgaagaagttgactaa

SEQ ID NO: 34880 - DNA, 324 bp, Glycine max
  Peptide Sequence Number=SeqID_126565
atggagcagttcttagagagggtacaagatgcttccttcgagaccaccatcccagagccattcactcttcatcctgaggcaggggaggaacaggcgagaccagagactgctactactcctgagagatcccttgagggtacatcagagcctcctactccagtggcagacctctcctcttcacagcctgcagctgacccttccacccctttacttgacataccagaggaccagaccacaccagtcctggtactgaacacctctcctccagctactctagtacttcatttgacagatgaggaggaggctcagtcacaggatacctag

SEQ ID NO: 34881 - DNA, 321 bp, Glycine max
  Peptide Sequence Number=SeqID_126566
atgaagtcaggtgacatgcgaggttaccttatggttatccgcacctttcgtcaaccaggggcatatcagcccgttgacgcgcggagactaacatcgtcttctgcaccttttgtcgtcctgacccgtgaatcatctgacatgcggggttacgttatggttacccacaccgttcgtcaaccatgggcaaacgagcccaatgacccggagactaacatcatcttctgcaccttttgtcgtcctgacccgaagtcagctgacatgcggggttacattatggttacccgcacctttcgtcaaccagggcgaaaacgagcccattga

SEQ ID NO: 34882 - DNA, 144 bp, Glycine max
  Peptide Sequence Number=SeqID_126567
atgggggagatgcttgccacccagctcgcccaggcgagcaagaacctcatgaattgtgcaacgatgcttccttttgagttctggcatgtcacggaacttcacaaattgcctgacgatgggcgccaagtacctcaaaatggttaa

SEQ ID NO: 34883 - DNA, 120 bp, Glycine max
  Peptide Sequence Number=SeqID_126568
atgaaggaggagtgtggttgtgcatcgccattggatttcgtgagtatttatagaggaggacgtgatgtaatcgattacaaggctgttgtaatcgattacaggctatctgttcttgtgtaa

SEQ ID NO: 34884 - DNA, 579 bp, Glycine max
  Peptide Sequence Number=SeqID_126569
atgactagggacaatccaggtgatttacaaccctttgatcctgaaatagatagaacctttcatagattatttaggcatagtgtgcatcctgatcattttgtgcattctaagcattttgttgctggtgattctgaacattctgattttgagcattcggttgctaattttcatattgagaacatggctcaatctccacctcgtgagaggactcttagggagatggctgcacctaacttcacttatgaaagcttgtgcattcaatatcctgatgaggatgttccatatgttctcaagactggactaatacatttgttgcccaagtttcatggtcttgcaggtgaagatcctcataagcatcttaaggagttctatattgaagatcatatctttctaaaggcttttcctcattctctggagggagtggcaaaagattggttgtactaccttgctcccaggttcattaccagctgggatgaccctaaccgggtgttcttggagaattcttccttgcatctaggaccactgccatcaaaaaagacatttcaggcatcagtcaacctagttgaagagcttgtatga

SEQ ID NO: 34885 - DNA, 612 bp, Glycine max
  Peptide Sequence Number=SeqID_126570
atggaggaagctactcaatctagaagcattgacatcgtgattgattctctatctcccatcagacgacacgtgaagtggaagatggctcgcacaaagaaaactggccaaatgacgcctcacaggggttcgtttgtcgtccatggacgtcaagatgtactgactgctaccattaggcaactagaacaccctggtagtgtacatgctactggagccggtgtcacgatcaagcaatactttggagcgactccaaggacctcccgcacgtcttcctccatggctcccgaagacctggaccagatgcagtctcagtttcagtcgcagatgcaatcacagggactcgcactgcctcctaagcctgaggttggtcctttagctacttgtgtcagcataaagaagagttgtgttaatccgtcagggaacgatctagacacgggtgactcagataaatgcgggttgtacatcgaagagaatcctccccgcctggttgccctaagaagactttatgagggatccacaaccattcatcacattcctttgctgcatgatcaagttaaggttggtgttgaggaggttagagatgcagatgctcccattcttgtacccaacgaagag

SEQ ID NO: 34886 - DNA, 354 bp, Glycine max
  Peptide Sequence Number=SeqID_126571
atgacttcaaaagaattgaacgaggagccatatgaagtgaaaatctcatgtacgaatagaaatagaactgttcagaggttttcctatagatatcccttcaacaaacataggtcatcgaaaggatctcgaagacccaccaacgcacgaaagccgggactttctttcagaaaatggattcctattcgaagggtgcataaccgcatggataagctcacactacccgtctttgggatccaattcggttccttaggaggtactcggaaggatcgtatggaatgtaataatatcgatttccaatacagatacagaagaaaggggttctctattgattcaaacgctctacctacgagatag

SEQ ID NO: 34887 - DNA, 234 bp, Glycine max
  Peptide Sequence Number=SeqID_126572
atgaccagtcttacacagatatggatgacgttgctacttagcaacattctgcccagtgaccataatgccgatctccccctgcggaagtatcagttgggatcgcgcccacaagacacccagtggacccggaggagcccaacagggccctggggtttccaactctggttacgggcctctatcagtcctacagggtgcctgtctgatgcaatcctaccccgcaagggcattggatag

SEQ ID NO: 34888 - DNA, 439 bp, Glycine max
  Peptide Sequence Number=SeqID_126573
atggaaagaatagaaaaagtggtcaagatctcagagcaagagctagaccgagtgaagcaaaataggaatgaggtggcagggataccaaggaagcacttggaggagaaggtggaagctctggccagccaaggagagtgggcaacattcatcgatgtattagctctactagtgtttgggacggtactattcccaaatgtagacgggttggtggatttagcggcaatcgacgcctttcttgcttatcaccccaacaaggcaagcccagtcatcgctgttttggcggatgcacatgatacattcgacttgagatgcaagaagagcagtgcaagaattgtctgttgtacgcctgttctttatgtatggttggcatcccacgttgcttatcatgaaggtagatctgtttgtcccttacaaggttatcgcatgtgcttcaaaaaag

SEQ ID NO: 34889 - DNA, 539 bp, Glycine max
  misc_feature (74)..(74): n is a, c, g, or t
  Peptide Sequence Number=SeqID_126574
gtatccggaaagcggcagggtcggaacaggagagcgcacgagggagcttccagggggaaacgcctggtatcttnatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtacccaagaagtctttgacgttgttgtcagtagtgttaagtctgaggaaaacgcgttgccaaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34890 - DNA, 126 bp, Glycine max
  Peptide Sequence Number=SeqID_126575
atgggaagcaggaatggttcaggttatgaagctgaaatgctcttggcaagctcactgccgaacaaggaattccttatgctacttagagatgctacttatgttatcaaaaaagtcatgagaaattaa

SEQ ID NO: 34891 - DNA, 192 bp, Glycine max
  Peptide Sequence Number=SeqID_126576
atgagaggcaccatgcatgagcctcgagagaatctaggggtagatcaaaagttctcacccagactagggtcttcttcatcaatggattcctttgcttcttggaagatgaatggcagcggaatgaagaaggaagagagagaggagacaccacttcaaggagaagatgagtctagaagaagctcaccaccatag

SEQ ID NO: 34892 - DNA, 167 bp, Glycine max
  Peptide Sequence Number=SeqID_126577
gtggatttgttggtgcttgcgcgcttagcgcaactctggctcgcttagcacgcattagtgaattccggcttagcgcgcgtcttctcgctaagcagatggactcaagcagtgtgtttagcgggatgagccctcgctcagcaaacatgcacagctcatccttcttctag

SEQ ID NO: 34893 - DNA, 549 bp, Glycine max
  Peptide Sequence Number=SeqID_126578
agaccaagtttggtcattctgcacccttgtatcatccagatgcgtcggacccgatgatacccggagataccttacggttatccgcacctttttgtcatccagagtcggcgggcccgatgacaagcagagaccaagtttggtcattctgcacccatgatacccggagataccttacggttattcgcacccttttgtcatccagaggcggcgggcccgatgacaagcagagaccaaagaccaagtttggtcattctgcacccatgatacgcggagataccttactggttatccgcacctttttgtcatccagaggcggcgggcccgatgacaagcagagaccaaagaccaagtttggtcattctgcacccatgatacgcggagataccttacggttatccgcacccttttgtcatccagaggcggcgggcccgatgacaagcagagaccaagtttggtcattctgcacccatgatacgtggagataccttatggttattcgcacccttttgtcatccagaggcggcgggcccgatgacaagcagagaccaa

SEQ ID NO: 34894 - DNA, 284 bp, Glycine max
  Peptide Sequence Number=SeqID_126579
atggctggtcattcttcctttaaacagcaaaatagtttaacgagattaaggaagaaagaaattgttactggggtctttcgaatgagaaaagctgtgattttgcttgggaggattgatggggacccggtgttgagagaaacgaggatatgggctacatgggagtacgtgagctcagttggaggtgggcaacaggggatgatcgtgatggcggcgcagctaatccatgatcgagtagagatggagtgcctagagggagcctgggagaacctcgaaggcaacacgag

SEQ ID NO: 34895 - DNA, 246 bp, Glycine max
  Peptide Sequence Number=SeqID_126580
atggttcgccagcagacggccaaccatcgtgggcaggggcagggctccccaccttttgtatgccctacccgagagcaattcagggttgaggtcgcgtggcctggagattggcccactgaggagggaactggacctgcaagatccccgggcgaagcggagggagcccacatggatgaggatatgaccgacctgctcggttacctgggacagggcggagctacacgaccaaggtcgttgcacttgtga

SEQ ID NO: 34896 - DNA, 249 bp, Glycine max
  Peptide Sequence Number=SeqID_126581
atgcttacaaagttgagctgccctaggacaaatccttctcaagagggagagaatgatgaggacatgaccaagagcaagggcaaggatccacttgaaggacttggaggacctatgacaagggctagagcaaggaaagccaaggaagctcttcaacaagtgttgtccatactatttgaatacaagctcaagtttcaaggagaaaagtccaaggttgtgagttgtatcatggcccaaatggaggaggactaa

SEQ ID NO: 34897 - DNA, 333 bp, Glycine max
  Peptide Sequence Number=SeqID_126582
atgttgtcaaatagagatgatcacattgacaattatttcattggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 34898 - DNA, 348 bp, Glycine max
  Peptide Sequence Number=SeqID_126583
atgccgatctccccctgcggaagtatcagttggtctgtgccgtcccgacataggggtcgcccccacaagactcctagtggacccggagaagtccaacagggccctggggtctccaactttggttacgagcctctgtcagtcctacagggtgcccgttccccccagcaagggatcgcacccgcaagacacccagtggacccggagaagtccaacagggtcctggggtttccagctctgattatgagcctctgtcagttttacggagtgcctgtcacccccaacaaggtcattaggccccgcactaaccgggctttcatcaagaagtactgcgcccccaggcaggcgtag

SEQ ID NO: 34899 - DNA, 273 bp, Glycine max
  Peptide Sequence Number=SeqID_126584
atggccattattgtcaatgcggaagcttgtggttactggtggcctcttgggaatgaggcggcaattcctccttctgatgaggcatggacactaatccctgacccaactacaattcgtgcgaaaggtcggccaaaatcaacaaggataaggaatgagatggattgggtcgaaccatttgaccgccgacaaaaatgtagtagatgtggagctgaagggcacaataggtgtcgatgtccaatgcaatctgaccgtgggagtaattcatttaattga

SEQ ID NO: 34900 - DNA, 126 bp, Glycine max
  Peptide Sequence Number=SeqID_126585
atgttattaaagaatggtgggggcaagagacagatcccaatccgtgggccagctctgaaaggacataagacagatctgcctcagatttgtgcttgtgttgttattgacttggaagtgttatcaatg

SEQ ID NO: 34901 - DNA, 531 bp, Glycine max
  Peptide Sequence Number=SeqID_126586
atgaccagaaggctgcttgccggttcattggcttttgaaagccgcatccttcactatctcattgtgcgtattttacttccaagatcttcaaaccttgcacaggcattgcgattaaatgctcatttgccatatccacacctagtcactcttttccttcaacactttaacatccctcttgattttgaaccttatgttccaatcaagagatcattcttgatctgtgctactgtgattgcatcttttggttaccgcaaagagcatgatggctcttgggtaaaaaagggtgctcaacccattgatgatgaaggacacttaccaattggagaggattcctctctccttcagagaattttggacaggtttgatggtcttcaaacctatgttggtgaaaggtttgatgctttggaactgcaagtggatatgcgatttgacaagatggactcagcgatcaccaaggttgaaggagatgtcacttacatccgcacatgctttgatctaccaccaccaccaccaccaccaccatcatcttag

SEQ ID NO: 34902 - DNA, 201 bp, Glycine max
  Peptide Sequence Number=SeqID_126587
atgccaagtgtagcgaaggagtacccaaaattggtaaacataaatactgaaggcagtatgcatttgactttgtctttcttagcatcccacaatcagttcttccaaaataattattcccacatggcagcattggattactttggagttagacagagatatttttcttcccacatacgatggaaaaatggcctaagtggttaa

SEQ ID NO: 34903 - DNA, 244 bp, Glycine max
  Peptide Sequence Number=SeqID_126588
ggacagcgagtcgaggtggcaggcgaagataccttatggtcatccgtttttactctcgtcatccggaaacattcaggcccaacgacgcgcgagattcttctctgctgggcagggacgatcgagtccgatggcgaagggaagtgtcgtggggtgtgcaatagcaatcaggcccacttgggccttccaggatgttccaaagaaggcatgccttctgtgtagcacccagcttgcttggccgagctga

SEQ ID NO: 34904 - DNA, 387 bp, Glycine max
  Peptide Sequence Number=SeqID_126589
atgagaggagcatcgtcggaggaaagcatcacgcctttcatcgcctggggttttagtgaccccaatgccatcatcgaccagtacaaggaaaagctaagcctagcagtgactcatgagcaaaggctagaggacgagtatgccaaggtatcagtcctgcaagcgaagagggaagcaagggaaaaggtgattgattcattgcacagagaagcaatgatgtggatggacaggttcgcctttactttgaatgggagtcaagagcttccccgactgctacccaaggccaaggcaatggcggatgtgtacttggcacccgaggaggttcacgggctcctcaattattgccaacacatgattgatttgatggcccacataattaggagccactaa

SEQ ID NO: 34905 - DNA, 84 bp, Glycine max
  Peptide Sequence Number=SeqID_126590
atggagaaaaatgaagaaacaacaatggaggagaagcttgcttgtggagcttctatggaggcgggatctttgagcttcaatgag

SEQ ID NO: 34906 - DNA, 231 bp, Glycine max
  Peptide Sequence Number=SeqID_126591
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacgggggtgggggcgtaacggcaaaaagcaccccccggacatcagcgctggcaaagtgtagcggtcccccctgcgcgtaa

SEQ ID NO: 34907 - DNA, 375 bp, Glycine max
  Peptide Sequence Number=SeqID_126592
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaagaacttcagagaggagggataggcatgatgtttcaaggaaacggcaccgaagccgtagtccaagtagtagtccacagccaacattatctggcaaagacagagatagagaacacgatttag

SEQ ID NO: 34908 - DNA, 725 bp, Glycine max
  Peptide Sequence Number=SeqID_126593
atggctttcactcttatccaaagaaagaccaaggtcaaggaatcttatagggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaattccccttcttagacaacctccacattttctcctttgtaaaaagactcttgttagcattgccacatctcttaggcttgagtttattcctcaagtaaaggagttgttggatgagggtttggttcgcaagagattaaatccttgtgctttgttggtgcccaaaataggtattattaggcaccaaatcccaaaaataggtggtgtgatgaatgctttgggtggtgcaacactcttttgtaaaatcactcgtgcacccaacatcttcatgatttgtgtacatagggactcgttaggtag

SEQ ID NO: 34909 - DNA, 297 bp, Glycine max
  Peptide Sequence Number=SeqID_126594
atggacttaaaattaagcataaattcaaaaagaaaggaggagaaagggatgagtgaacggcagaacaagactcttgatttcaggattgtcatcatcaaaaagggtgagattgtggaagcaatgtcttccaaggttattttgatgatgccaaagaatcaagagttaagcaaagtttcaagcaaagattcaagaatcaagtttcaagattcaagattcaagattcaagaaaaatcaagatcaagattcaagactcaagattcaagaatcatgagaagactcaatcaagataagtactaa

SEQ ID NO: 34910 - DNA, 746 bp, Glycine max
  Peptide Sequence Number=SeqID_126595
atgtcgggcgggcagtgccagcgcgtgatgatcgccattgcgattgcctccaagccgcgtctcctgatcgccgacgagccgacgactgcgctcgacgtgacgatacagaagcagattctcgacctgctgatgaagctgcaggaagaatatggcatggcgctgatcctcatcacccacgatatgggcgtggttgccgagaccgccgatcgtgtcgtcgtgcaatataagggccgcaagatggaggaggcggatgtgctgagcctcttcgaagccccgcagcatccctacaccaaggcattgctttcggccctgccggaaaatgccaccggcgaccgtctgcccaccgtctccgatttcttcggcaaggagggcgccctgaagggcatcgatttcgccgtcgagcgcggcaagacgctcgcgattgtcggtgaatccggctcgggcaagtcgacgctggctcgcatcattgccctcatcgatccggcttccggcggtgaattgaagatcgatggccagccggtcgatatcgccaggcgccgtcccggcacggaaatgcgctccaaggtgcagatggtgttccagaacccctatggcagcctcaatccgcgccagaaggtgggtgacgtgctgatggaaccactcatcatcaacacgaagattcctgcttccgagcgccgcgagcgggctgaagccatgctcgtcaaggtcggccttggtcctgagcatttcaaccgttatccgcacat

SEQ ID NO: 34911 - DNA, 210 bp, Glycine max
  Peptide Sequence Number=SeqID_126596
atggatgtaccctccactagaactgatccacaagagatgtaccctctcttgttatcagtcaaacccaagcggcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 34912 - DNA, 384 bp, Glycine max
  Peptide Sequence Number=SeqID_126597
atggggatcgcacccacaagacacccagtggacccggaaaagtccaacagggccctggggtttccagctctggttacgggcctctatcagtcctatagggtgcccgtacccccccggcaaggtcatgtcatcatagggattgcgcctgtaagacacccagtggacccgaagaagtccaacagggtcttggagttgtcaagctctaattacgggtctctgtcagttctacagagtgtctgtcgcccccagcaaagtcatcagacccccctactaatcgagctttcatcaagaagtattgcgcccccaggcaggcgcagggcgaaacaccatagcagcattgggatggtcggcagcgggaaacagacgcaccgccatcacctctag

SEQ ID NO: 34913 - DNA, 261 bp, Glycine max
  Peptide Sequence Number=SeqID_126598
atggagaattgcactaagcaatcactacgcatggctccaaactcgtgggtggaggatgacatgaacgaaaacgcaattcatggggctccgaacaaagggttgagaatggagaatcgcactaagcaattcactacgcatggctcccaaactcgtgggtggaggacacatgcaacgaaaacgcatttcttgggctcaaaccagagattgagatggaagatttcactaggcaatcactacgcatggcttctagactcgaggtga

SEQ ID NO: 34914 - DNA, 690 bp, Glycine max
  Peptide Sequence Number=SeqID_126599
atggagacatttcagaaggtccgcgaggcatgggaggtgttgcaaaagaaggacaaagaactcaggggcagtaacaatgggcccatcgatggctaccgtaagtggttgaaagcccacgtgcaaggtttggattggctcccgagtttgagaaccgttaaaagggaggaagtggaggcaccagaggaagacgaagaggtgcaagcccttagggcagaacttgagcaagcccaaacagtcaaagaaaggttcaaatcaacagctctgaagatccgaaaggagaatgccgaattgagagatataaaagcagctaccaccaaagccttggaacaagaaaccaagagggctcgtaaggaagagcatggccgagacaaattttgtggagctttgtggggcagcaacagtgagcttaagcttcaaagggaagagagaggccaatcacgagcacatagcatggtcttgaaagaggagttagctgcttgctcaaggtccaaaagaaactcttctcaacatttatgcgagacagagaccaacatgttagccatcgtcagcaagtaccaagaagaactaaatctagccatggcccacgagcatagagtggcggacgagtatgcccaagtgtacgtggaaaaagaggctagaggaagggtgatcaactcgttacatcaagaggcaacaatgtggatggactga

SEQ ID NO: 34915 - DNA, 429 bp, Glycine max
  misc_feature (421)..(421): n is a, c, g, or t
  Peptide Sequence Number=SeqID_126600
atggataatgaagagggcatgcaggaacagatgaaggccgatctatcagctttaaaagatcaaatggcttccatctcggaggtcatgttaaaactccagaaagctatagaggataaagccacgacaaccgcctccagtacggttagggaagcggagtcggtgctgcagcccgccttaaattcgggccgagacagaaacacgaccgtgtttggtcgaaggtatagtccgcaagcttatccttatggcttgcctcctgacttcaccccccgtgccaccccgaaagatttaagccaagcccctactttcgaggggcaactcccaccttatgatgactatcccgggcaagacgatgaggaaggagatacccatcttggccccctaatccacctcaaagatccgtcgccccatgaactaccccaancgaacata

SEQ ID NO: 34916 - DNA, 129 bp, Glycine max
  Peptide Sequence Number=SeqID_126601
atggatacccgcatcactcaacttgaggaggatgaattaagttgtcatcaagaggatcatgcgcttctcaagtttaattcaagacaagaatccaagaaattcaagatatatgatcaagataatctctag

SEQ ID NO: 34917 - DNA, 547 bp, Glycine max
  Peptide Sequence Number=SeqID_126602
cggtggcttcctcgaaagtgcgcatgtgcatagtgcacgttatggcacggcgcaaagtgaggtcgaaaatgcgctggcggctggccgcgatgtcatcctggaaattgactggcaaggcgcacaacagatacgcacactattcccgcaagtgacctctatttttatcctgccgccttctatagaggccttgtcgcaccgcctgaacagccgcggccaggacagcgaggccgtgattacgcaacgatctgatggcgattgttcgcgcccagcgcttgcagttaaaccgccagcgcctaacggcactgacccaggctccaacttagaggtttttatggcacgtattactgtcgatgattgcttggacaacatccctaaccgttttcaattgacactggttgcggcttaccgcgccagacaactggccaacggttccgatccattagtgagtggttactcacaaaaagataaagccactgtgttggccttgcgcgaaatcgcagccggcaaaatcggtgttgagctgctagagaaaaagggccaagcataa

SEQ ID NO: 34918 - DNA, 441 bp, Glycine max
  Peptide Sequence Number=SeqID_126603
atgggtgaagtagaggaggtacaagagaagatgaaggccgacatggaggccatgaaagagcaaatggccacgatgatggtggccatgatgatcctgaagaagataatggaagccaatgcggttgcagttgccgctaccagcactgttaataaggagaacccgatgcccccatctggcctcaaccaaatgaatcatccaacttcagctatggtaggcaaagatttgggaagtacggacggccccatgatgtgcaaattcaaaacgagcacgccttcccgccacatggcttgcctcctaactatacaccacccaatgtggcgtacactcccaatgaggatgtcaataactccactcccatgctcattgagagccaacaacctcatcatatacatgtctctcaacccatgggggagacgcatgaaattccccaccacaatctag

SEQ ID NO: 34919 - DNA, 206 bp, Glycine max
  Peptide Sequence Number=SeqID_126604
gggctgttagaccttgaactaacactattgagagtggatttcctccctggcttggagcccccagatgtaggtgaggtagcaccgaactggggtcgattctttgaggatcctaacaatgagggtttgacaatcgatttcgatcgagatataagccaaacgataaacgaggaggaggaagaggacgtcctgtcaccagagttggagag

SEQ ID NO: 34920 - DNA, 453 bp, Glycine max
  Peptide Sequence Number=SeqID_126605
atgggtgccattattggatgtgtgggtagcttgtggaagttaggtggaaatttctgcctttcccctgaatgcgtaattgcttttcaagtgaatacacatcagtacgcgggcgcaccaccaccaccacctcggcaggccgattcggctgggccactgagcatggagcggtatctacaacatttggttcgccagcaagcggccaaccaccgtggacaggtacagatacatgagtgtctctaccggttcagcctcagccagcaggggcagggttccgccccttttgtatgccctaccctggagcagtttagggctgaggttgcatggcctggagactggcccgatgcccagacaggagaggagcctgtagaatcccccggtgagacggatgaaccccatatggacgaggatatgactgacctactcggtttcttgggagggagcggagccacatga

SEQ ID NO: 34921 - DNA, 174 bp, Glycine max
  Peptide Sequence Number=SeqID_126606
atggttacgcgatccgtgaaattccgtaatgtggcggaaaccaaaaggaagaattgttacgcaatcccaatcaggcccacttgggccttcccgtttcttcctccagaaggcggttgcttctggaggaagcaacctggctcgcctgggcgagctgagctcgcctgggtgagctga

SEQ ID NO: 34922 - DNA, 435 bp, Glycine max
  Peptide Sequence Number=SeqID_126607
atgtggtggaaagatttaaaacaaactgttaattctgcacaacttggagacatagttcacagcaaaatgagatggaaaattgtaagaggagataaggtcaggctttgggaagataaatggaatcatcaacaacaacctttagtagagaggtatcctagactgtaccaaatatctacacagcaaaaccaaaccattagacagatggggcagcacctacaatcaggttgggagtggcagcttctgtggagaagaccgctatttgaaaatgaaatcgagtcagcaatcaatttcctaaaggatatcgaaggtatacacattcagcagcaaggatcagatgaatgggaatggttaggtgatcaaacaaggaattattccacacgcagcgcctacaatctggttttggaagcttctacaggtggtcagcaagaggaatag

SEQ ID NO: 34923 - DNA, 198 bp, Glycine max
  Peptide Sequence Number=SeqID_126608
atgggaacccggaaaatccatatcaccttcttaaactgcacacatgggcactgcacccctgaatgcgcaagaaaaactgccaggaaaccacattacaaacgaaacctcaaagagagttgggcttcgtcctcaaaagcaaacaacactagaaaatctagccttccatggattcaaacagaaaacgcaaatgaaacatga

SEQ ID NO: 34924 - DNA, 654 bp, Glycine max
  Peptide Sequence Number=SeqID_126609
gatgaggttgtggagaaatttctcaagaaatattttcccgagtctaagactgcagaaggcaaagccgccatctcttcttttcaccaatttcccgatgaatctttgagtgaggccttggaaagattctgtgatggaaaaatcaaattgaagacccctgaagaagccattgatctcattgaaaatatggctgcaagtgacattgatattttgagagatagagctcacattcctactaaaaagagtttattggagctaacctcccaagatgcattgttggcacaaaataagttgttgtctaagcaacttgaggcattgactgaaacagatgtaccatctgtgggggagctcatgaatctggatgttaaacaagggcctagtctctatgatcgcacaacgaagttggaggagactctagctcagttcatgcaggtttctatgtccaaccagaagagcacagagtctgccataaagaatctggaggtccaagtaggacagcttgcaaagcaactgatggatagatcattaagcagttttatagctaatacagagaaaaatcccaaggaggagtgtaaagctgtgatgactagaagcagaatgacaatccatgtagatgagagtgaagctaagaagaagatggaggaacataaacaatag

SEQ ID NO: 34925 - DNA, 531 bp, Glycine max
  Peptide Sequence Number=SeqID_126610
atggctacttcaaaatctttttgccctcactcttatctaaagaaagaccaaggtcaaggcatctttggggcggtaccttctaagcccaaagatgatatggggaagacaatagaaaagcaaccccctaaggctagtatgcaagagaagactagctctataaagtgctttaaatgtctaggaagaggacacattacttctcaatgtcccaccaagaaaaccttgattatgaggggccaagacatttatagtagccaagatgaggctactacttcaccttcctctagtgaaagtgaagaagcaaaaggggaagaatctagtgaagaaatctacccccaagaagaaggacaacctttaatggttaaggagaagtgtaaggaagtgcttatatgggactccttaggtgtcgagggaaggagcccagagtatgaagaacctcgggatttgaggtcaaatcctttccaaggtgcaggggctgatgcaatcctaccccccaagggtattggctggcagactccaagaggcttgggctag

SEQ ID NO: 34926 - DNA, 630 bp, Glycine max
  Peptide Sequence Number=SeqID_126611
atgagtcttcattcttcatctagtgttaatggtgagggttctactcctaaggaccccttatataagatattagatgagttgagatcccttatgttgtggaaagaaaaacaagagagaaaagaaaaaggaaaaaaaagagtggaagaaataagtcaagatgaaagagagaaaataagagaggaagaaagaagaaaaataaggaaagaaatgaaaagagaaaaacatgcctcctttagtagtcataactcttgcaaaagcctaagtgaagcactttgtggctattatgaaggaaggcataggtcacatcttagacctcactcccataggagagaaaatgaaagaaagcctcaagaggttaacattaaactcccatacttccatgggaaggacaatgtagaggcttacttagattgggaaataagggtagagcaaaaacttaaaagaaagcctactttaaaatcttatggctatcattcttatccaaagaaagaccaaggtctaggcatcttaggggtagcatcttctaagcccaatgatgataaggggaagacaatagaaaagcaaccccctaaggctagtatgcaagaaaagactagctccataaagtgctttaaatgtcttggaagatga

SEQ ID NO: 34927 - DNA, 216 bp, Glycine max
  Peptide Sequence Number=SeqID_126612
atggagcgttatctacaacacttggggcagggtttcactccttttgcgtgccctactccagagcagtttagggctgaggtcgcatggcccggagattggcccgaggcccaggcaggggaggcgcctgcaggatcccccggcgatgcagaggaggcccgtatggatgaggagatgacggacttgctcggtttcttaggaggaagcggagccacgtga

SEQ ID NO: 34928 - DNA, 288 bp, Glycine max
  Peptide Sequence Number=SeqID_126613
atgaatgctttgggtggtgcaacactcatttgtaaaatcactcgtgcacccaacatcttcatgatttgtgtacatagggactcattaggtaggaataatcaacatgaaaatacagaaaaaggggttcccatgaaccctaagagaataaaagtcattcctgagtggcccgctccactaagtgtgttgagggaaaaatgcccagagtttcaagaacctcgggatttgaggtcaaatccttttcaagggggagggaatgatgcaatcctaccccgcaagggcattggatag

SEQ ID NO: 34929 - DNA, 996 bp, Glycine max
  Peptide Sequence Number=SeqID_126614
ctggccaccgatcgcagcaatcttgcgatcgcgaaagagacggcagagagtgcgcgccagtcactggacgtgacgaaaaaacgtatgcaaaacggagtggattcaatggtggatgtggcttcggcggataccacctatcagtctgcactcgcggatgtggccagctataccaccagcgtggcgcaggataagaatgcgctggacctggtagtgggtaaaagcgtgccagataaccttttgccgcagagtatcgaatcgattggccaggcgttacgtgaggtaccggccggcgtttcatccgaagcattgaacaatcgtccggacgtgttgcaggctgaacacaacctcaaggcggcgaacgccagtatcggcgcagcgcgagccaatttcttcccgagcatttcactgaccaccagcggtggcgttggcagtgccgatctctcgtcattgtttaaaaacggcacgggggtctggtcgttcgcaccgagtatttcgctgccaatcttcaacggcggctataacgtttcttatctgaactacaccaaagcccagaaagagtattacgtcgcggtgtatgagaagtcggtgcagacagctttccaggaagtcgctgatgcgctggcccgacgcggcactatcactgaccagatggccagtcagcgtaacaatgtggctgcctcccagacctattaccgcctggctgaattgcgttatcagcaggggatagatacttatctgaatacgttaaccgctcagcggacgctttataccgcacgcaccagtttggtcagtgttgagcaggcttactatcagaacctgaatactttctacaaggtaatgggcggcggtactgcgttacaggagtccgaactcaaaattcgcgccggaataggacaggtttccactgtcacgcgtgaacccggcctgagtgacaaagtattgagcgtgcggcgatcagacgattttgtatcaggattgatgacgatggttgcatag

SEQ ID NO: 34930 - DNA, 552 bp, Glycine max
  Peptide Sequence Number=SeqID_126615
atggctactccacctgcctcgcctcctccttctcctcctcctcctgcagacgcatcagcgtctccgtctaccttcaagcgaacacgcaaagccactagaccacctggggcagagagaccagtggcccacgtcaatcttgcaatcggcaaggctgacggtccccacaagaagaaattaagaacgtatttggggattatcgttcgtgataaggtcgatgtgacatacgagaactggaaggaagtccctgctgctcagaaggatttgatatgggaggatattcagacggtcagcgagcaatggaggcagtttaaatctaatttgccgaggaaatgggaacttgcagccggcaacgacggtgtggacgacactgtccatgaaaaatacgacattagcaaggagaaatgggctcagttttgtctgacccacagagacccctcctgggagaacaaaagctcatggctgagaagacaaagaaaagattggaggaagctacctagtccggaagcactgagggcgtcattgaccctccatctcccatcagacgccatgtga

SEQ ID NO: 34931 - DNA, 234 bp, Glycine max
  Peptide Sequence Number=SeqID_126616
atggcctccgcaaattccttatttccagaagggaattctatcaatagtctcttccactttatttggagagggttgccactcggaaaacccgagatggaactattgagattgcaccaaaatgaagataaatatctgggaacaagaaaaagaaaggaattgctcttaaagcatcatcccaccattcaagaaagacatagtgtatcaggatacatagaaaatcctagagatagatga

SEQ ID NO: 34932 - DNA, 477 bp, Glycine max
  Peptide Sequence Number=SeqID_126617
atgggtatgattatgactttatcctctcaatcggagaggcctacggggcattacgagagaaaaagctcgccgtgggtcaagaccagagagctacaggtacaccagggggcaacagagcactcaggcgggggtcggggcaaagggcagcacgtcacgggaagttctcagcttaatccttaccagcgctatatcttgggtgcgcgatatgggtggggactgtctagcacagacaccccccaagcatcccctgagttacagcaggtggcggaggcaacgcaaatcggggaaccggcaagttcttccgcagaagtaaggcagctagtagaccacctcagtgagcaagccagggaggtggccagtgaagcttcaatggaaagaacacccagagctcttgcaatgtggatggctgggctaacgctagcattcgctatctccatagcgcttgctcaaaaggtccggggttatactggttattaa

SEQ ID NO: 34933 - DNA, 579 bp, Glycine max
  Peptide Sequence Number=SeqID_126618
atgattatgaggagccaagacatttatagtagccaagatgaggctactacttcaccttgctctagtgaaagtgaagaagcaaaaggggaaaaatctagtgaagaaatctacccccaagaagaaggaaaacctttcatggttaaggaggagtgtaaggagataagtgtctcctccaagaggttagctaagaaggaaagagattttgaaataaagacaaatattaaagaaatttcccctcttaaacaacctccacattttctcctttgtaaaaagacacttgttagcattgccacacctcttaggcttgagtttattcctcaagtaaaggagttgttggatgagggtttggtttgcaagagcttaaatccttgtgctttgttggtgcccaaaataggggttcccatgaaccctaagagaataaaggtcattcttgagtggcccactccaccaagtgtgttgaggaaaaaagccaagagtttcaagaacctcgggattttaggtcaaatccttttcaagggggagggaatgatgcaatcctaccccgcaagggcattggatagaagactccaagaagattga

SEQ ID NO: 34934 - DNA, 185 bp, Glycine max
  Peptide Sequence Number=SeqID_126619
atggagaagccgatttgaggacaaatccttttgaagagggaaagagtgatgaggaaaaggcaaggaataagggcaagaaacctttagaaggacttggaggaccgatgacaaagactagaacaaagaaggccaaggaagctcttcaacgagtgttaaccatgctatttgaatttaggcccacgtaa

SEQ ID NO: 34935 - DNA, 208 bp, Glycine max
  Peptide Sequence Number=SeqID_126620
atggaggagaaagtaaagctgaaaactaatggagctttaaggagcacctacttgaagctcttgtgctctgataccacttgttggaagcttacttatgaagcttctatggaggctggatctttgagcttcaataaggttcatgagaaccctatggtcttcttcagcagctctagtccaaccctcttggaacctcttgctcatggctctg

SEQ ID NO: 34936 - DNA, 408 bp, Glycine max
  Peptide Sequence Number=SeqID_126621
atgtcattgcctagcgctgttcatgtgtcctccattatcaagcgcgaagcctctagggactgggaaatatgttcttctgttgttttccggatcgcaaaaaaagaaggagtagagacgagaatcgtcatcacggaaagggcaggatggacgaaatcagtgtcttatctttgctttcctcttatctccgatgagagattcttcctccagaaggctgttgcttctggaggaagcaaccttgctcgcctgggcgagctgggtggcaagctcctcccctattttgctataaatagggggaggagtgaagggaaaaggggttcaaccttcttggcacttctcattctctcgaaattgctgaggaaaattatttccgtgaagaaaattcaagccgaggcgcttcctcttcaacgg

SEQ ID NO: 34937 - DNA, 393 bp, Glycine max
  Peptide Sequence Number=SeqID_126622
atgacgccgatcgaggtccagggtgacgcaccacaggccgcggacgcgccgccacctcatcaggctggtccagccggattgtttgatacggagcagtatttgcggcatttggttcgccagcaggcggccaaccaccgggcatatgtacaaacccatgattgtctttatcatatgagtctcagcctgcagagccagggctttacttcttttccgtgctctactccggaccagttcaaggcagaagtcgcatggcctggagattggcctgaggcccaggcaggagagtcaccagcaggggcaccagcagaggctcccgacgaggcagatgaggcccgcgagggcgaagagatgaccgatttacttgatttcttaggagggagcgatgccacatga

SEQ ID NO: 34938 - DNA, 195 bp, Glycine max
  Peptide Sequence Number=SeqID_126623
atgttcagccgtcctggtaattcgagatcacttgaaattagtgaaaaaaattgtttccgtgaagaaaatccaagccgaggcgcttccgtaacgttccgtaacatttccgtgggtgattcgcgaagattttcaaccgttcttcgtcgttcttcggtcttcaaccgccacattggaaaccaaaaagaggtaaaataa

SEQ ID NO: 34939 - DNA, 243 bp, Glycine max
  Peptide Sequence Number=SeqID_126624
atgtcaccacaagttatgcaggatggtggaagcagtcaatactgtatcatcatcgtgattttgcaaagaatattactcggtgaaagagcagtctatgcaatgatgctgacacctattgaaccactgatggaggctttggaggaagattataaagatggaaatgagataaatgaatcaaggcagtttattggaggagtattggatcttgaaaagagaatcaatagactagatacattgacttag

SEQ ID NO: 34940 - DNA, 228 bp, Glycine max
  Peptide Sequence Number=SeqID_126625
atgactaaagcacgtcaaaaggggcaaaataggggaggagcttgccacccagctcgcccaggcgagcaaggttgctttctccagaagcaacagccttctggaggaaggatttggaaggcccaactttcgaagaagttacggaaactcacggattgcgcaaaatacctcttttcgatttccgtcacattacggaattttcacgaatcgcgtaagcctgcttccttttga

SEQ ID NO: 34941 - DNA, 396 bp, Glycine max
  Peptide Sequence Number=SeqID_126626
atggcgaccctactgggaaattgcaccctcactgtagaggtgctgtcggggaaaaatttcgctcagcaggcaatgctaaacgcaacgcggatactgagagcttttatgtatagaagtgaagatgaaaaactggccgacattgtcatgggcgatgccgtgctgcaattgttaaaacaagccggaccggtaaccactctcgcgctgctggaaaaactgcgcgcgatggcggcctcagaaaccgatccggcccgccagcgcgcgtttcgctatgcgattgctgaagtgcagaacagcaaaagtgcgccactgggcgaagcggtggcgttaaaaggtagcgataacgtgacccatatttttcgcaaccgtgataatacgggcaaaaacacccgacattag

SEQ ID NO: 34942 - DNA, 1035 bp, Glycine max
  Peptide Sequence Number=SeqID_126627
atgagtaatgaaaaggttctggttaccggcggcagcgggtttatcgctcagtactgcattattgcgctgctgcagcagggctatcaggtgcgaaccaccttacgtgatgccgaacgtgaagctgaagtcagggcgcatctgttgcaggccggggtggacgcaggcgaggcgctgcaatttgtcgttgccgatttaacggcagacgcgggctgggaagacgcggtggcgggctgtcgcttcgtgctgcatggcgcttctcccaccccgaccggcaaccaggtaagcgaagctgactgggtgaatccggcgattgaaggaaatctgcgcgtattgcgcgccgcgcgcgatgcaggcgttaaacgtgtggtgctgacctcggcgtttggcgcggtcggtatcggacatccagcggactatccgcgcccctttaccgagcgcgactggagcgatgtcagcggcgatgtgtggccgtatcagaaatcgaaaaccctggcggaacgcgccgcctggcagtttatcactgagcagggtaacggtctggaactggccacggtgaacccggtgtcggtgctgggaccggtgctgggtgccgactattcacattcgattcgcattgtgaaggagctactggaggggcagccaggctgtcctgacatcaattcatgttttgtcgatgtgcgtgacgtggccagtctgcacgtgctggcgatgccccacgccgccgcgcaggggcagcgcttccttgccagttcggggcacagcctgccgcttattgaggtcgcgcgcacgctcaaaacccatctggtagcagaagcagagaaagtttcgctgcagccaatgagtgacgccatggtgcgggcggcggcagcgcaaaatccgctgatgacgggaatggtaaaactgctgggcgttgatatgaacgtcagcgccgctaaagctggctggctgctgaactggcacccgcgcagtccgcaggaggccattcttgccaccgcgcgcagcctgattgcgctgggactggtggcaaatcactag

SEQ ID NO: 34943 - DNA, 2072 bp, Glycine max
  Peptide Sequence Number=SeqID_126628
atgcgacgtacgcagctctttgtcgtaacgcgccagctggcgcgtcatcgcgttgaagttgtgcgcgaactgcgccagttcggcgggcgctgccgaaagcgggcgcgcgtggcgcagcccgaaataggcaataaacggaatggtcaccagcaccaggatgccgacggtgatccagtccgaggaggcaatggacgggtcggagtagcgtatgccccaccagctatcgatgatctggtgaaagcgcgcgggatcgcgttccggatgcgcacgcagggcgagaaattcacgcagaaccgccggcggcatatggtgcgtgatccacaggtactgcaccgtgaagcgcagccacatgcacaaagcaatcagcactacggtaccgatagccagcgtcagaatgcgcagacaaagccagcgccagagcgtctgttatactacgtgggtatcaatcacccgctccagcgcgtcgctgtccggcatacactgctccagcaaaaacgggcggctcagcgcgcgcaccggtgcgcgcatcagcgtgaccagcagcgtgaattcggttggcgtggtatcaacgcaaagcacgttgcccgaggcctgtgtgacggtaaccgtcatcgcgctgctgttcacctccagcccctgccagcgcaggatctcttcctgcggcgtttttaccgcgctgcgccgcagcactgcctgcacgcgtgccactacttcgccgggatgataaggcttgaccacataatcatccgcgccgtagcgcagggcaccgatgcgatcgggcgtatcgcccatggccgtgaccataatcaccggcacctcgctgctgcgccggagttttgccagcacctcggtgccgttcaggccgggcagcatcacatcaagcaaaatcagatcgggctgccagcgcagggccagctcaagtccgctcaggccatccgcggcaacacgcaccgcataattttcccccccgggatacttcggcttcgcgctgcggctgcccgggcaaggggcggtaaacggaccgataaagagaccagcctgacgctcggcgcgggggcgcaattcgcgccacgctacagcggatcgaataaaacacgggtgcagccggtaccgattttccaggccagagatggcgcattttttgctgatgcccagaaaggcatcgggtacgacctgcagagcgacagcgggttttatctggaacacacgctgggttacggcctcggccgaagcgataaagattcaacgtggcgggacggcgccagccggctgcaaggcatgggaaacatcagtgcgacggtgaacactgcactggcgctgggctggcagctcacgccgtggctgagtgcagagggcaaagcggtgctgccgctcagcgatgatcagggcgtgaactatcaggcatccgttacgctggtgcctctccagcgcgacagcgataccgttgcactgcagacggcggcgctgtttggcgatgcgcgttatatgaatacctggtatggcgtgagcgatgtccagagcagccgcagccggttttcacgctacgatgccggcggcggcttttatggtgttgcgactacgctcacctggagccaccagtttgatgcccactggggcacgctggtcagcgcgggttacagctggctgggcgatcgcgccgcggacagcccgatcgtgtcccggcgcgaccagccactacgcggacatgccgccatcaatcaccagttcgctgccggtaacatagacactttcgtccgatgcgaggaacagggcagccgccgcaacttcgccaggatggccgaggcgtttggccggtatctgcgcgctgaatgtctgtcgtacctcgtcgctgacctggtcaaacatcggcgtgtccgtcgggccaggactaagcgtgttgacgcgaatgccgcgcggtgccagttcgctgctccaggtgcgggcataggcgcgcaccgcggctttgctggccgaataagcgccatagccgggattggccatgccgcccgcaatcgatcccaccagcacgatggcaccgcccttccgtcatgtgcttcaccgcatgctgtacg

SEQ ID NO: 34944 - DNA, 288 bp, Glycine max
  Peptide Sequence Number=SeqID_126629
atgtacaactatcatgagaaaggaagagctcttgatcttgaaagtgtattggcaaacttcatgacataccaagctagctctaaagaaggattgtctaatctggatgacctgttaatgcaattcaaagatactgtagattcaatgcaacaagcctttaaaagaactgaaactcagattggcaagttggtagatgacatgactaaagttgtggtcaaaagagaagaagagtatgcagagattgaagcacatcaggaaagcattcttcaagttaccacaatccatcattaa

SEQ ID NO: 34945 - DNA, 132 bp, Glycine max
  Peptide Sequence Number=SeqID_126630
atggaggctcaatccctactcatactctaccgtttgggaccctatcagagcaatcagaggaatctcaggaacttgttagagatgtctctatcgctgtcagaagacacggttttagtccccaagttgtggtaa

SEQ ID NO: 34946 - DNA, 728 bp, Glycine max
  Peptide Sequence Number=SeqID_126631
ttcctcatggactgccaccttcaagaagcatagatcatcaagtggatctccttccagaagcttcattgcctaacaagccaacttacaacagcaagccccaagagactcaacataaggatgcacatgccaaagttgagtatgtgaaaagattgtatgaccaagtgaaggtgcaaattgcaaagaagaatgaaagctataccaagcaagccaacaagaaaaggaaggaagtggtacttgaacccagtgatgatcttggacatttgagggcaaatgttttccaagaaggagggaatgatgagaatcctaaaactggtcaaatacaggctaaaggctcaagtggagaaggacgaaggcccaacttctctctgggttccttgttgaaccaatctcagacttatcaaggtaatccttgtggcgtctactctgacttatcttccttcaccgaaagtggcgtctaccctgacttatcttccttcactggaagtggcgtcatccaaaaaactctacagcctgtatcaagcgatctgctcctagtcagattcacatcagcatgctcattcaagtcatatgatttacgcattccaatccactcaattcatacaattgatcattcaggccaatcaacaaacactcagtttcaacatcaacatcaaaccactgcatataatcaattcactgtacaatcatgctttcgcacaagctaccaaacaactacaactacaaactaa

SEQ ID NO: 34947 - DNA, 564 bp, Glycine max
  Peptide Sequence Number=SeqID_126632
tcggatagtctaacaggggccttggggtttccagcgttgatcacgggcctctgccagtcattcggggttcctgtcacacctagtaaggtgatccgaccgccgatcacccgggctttcattgagaagtattgcactcctaggcaggcgcaggggaatgcaccacaggccgcagatgcaccaccaccacctcatcaggctgatcccgctgggtcattaggcacgaagcgttattacggcacttggttcgccagcaggcggccaaccactgggggcaggtgcagatacatgactgtctctaccagctcagcctcagtcagcagggccagggtttcgctccttttgcatgccctactccagatcagtttagggttgaggtcgcatggcccggagattggcctaaggaccagacggaggaggcacctgcaggagctcctcgacaatgcagaggatgcccgcatggatgaggagatgacagacttgctcggcttcttggaggaagcagagccacgtgaccgagaaattttcggcgttatggctctcagttatttcgtcaccattttgtga

SEQ ID NO: 34948 - DNA, 261 bp, Glycine max
  Peptide Sequence Number=SeqID_126633
atggacccagtccccagtggagtcgccaactgtcgcaaccttcccttatgcgggcgagcgaggcgaggtctcacgggtgcgctttccaaaggaggaaagatgcacggagtcgccaccaacgtttatttgtggaaaaaacgtcggaaaaaccgaaggaaaccggtcataaagaatattccaagttcgggagttgtattacgtttgaggaaggtattagcacctctcacgttttgtctcaaaggacaacaacctaatttttag

SEQ ID NO: 34949 - DNA, 597 bp, Glycine max
  Peptide Sequence Number=SeqID_126634
atgactcaattccctgaagtttcggcttcacgccaggacattcgtcagctcattcgtcaacgccgtcgtgcgttaacccccgttcagcaagcgcattttgcccagcaggccgccgcccgtatgatggcgtatccccctgtcgtgatggcgcgcacggttgccctgtttctgtcattcgatggcgaactggacacccaaccgctgatagagcagctctggcgcgccggaaaaaaggtgtacctgccggtgctgcacccgttcagcgaaggcaacctgctgtttttgcactatcacccgcacagcgagctggtggtgaatcgtctgaaaatcaccgagccgaaactcgacgtgcgcgacgtgctcccgctgtcacagctggacgtgctgattacgccgctggtggcgtttgatgagcagggacagcgcttaggtatgggcggcggtttttacgaccggacgctgcaaaactggcagcagtatgggttgcagccggtaggctacgcgcatgattgccagggcgtggaggcgttgccggtggagaaatgggatgtgccgttgccggcggtggtgacgcccagcaaaatctgggtctggtag

SEQ ID NO: 34950 - DNA, 494 bp, Glycine max
  Peptide Sequence Number=SeqID_126635
gaattgttggagaaatttctaaagaatacttccccgagtcaaagactgtaaaagggaaagtcactatttcatcagttcaccagttcgttgatgagtccttgagtgaagcattggagaggtttcagggaggtaagataaagttgaaaacccctgaagaggcaattgaattgattgagaatatgtctgccagtgatcatgccattctgcaagatagagttgtaccatttgtggtcaaccttcattgcattcccattgaagaacacactcaggaagttcattacatgggaaatcaacagagacaaggatacaaccaagaaggattttcggggttccagcaagtagctttgggagcaaataccgagaagaatcccaaagaaaagtgcaaagctgttatgacaagaagcaggaagcttatggcggctgaggatgaggatgttgttgctttgaaggagcaagttgctttgaaggacactactgataaaaagaagaataag

SEQ ID NO: 34951 - DNA, 141 bp, Glycine max
  Peptide Sequence Number=SeqID_126636
atggatgtgaaaacaacctttcttaatggtaatttagaggaggtaaatgtgaaacaccctgaaggtttctcctctagcagtggtgcgcatttgatgatattttacttacagccaatgaccggggtttactacatgaggtga

SEQ ID NO: 34952 - DNA, 610 bp, Glycine max
  Peptide Sequence Number=SeqID_126637
atggataatgaagagggcgtgcaggaacagatgaaggccgatctatcggccttaaaagatcaaatggcttccatctcggaggtcatgttaaaactccagaaaaccatagaggataaagccacggcaaccgcctccagtacagttagggaagcggagccggtgctgcagcccgccttgaatccgggcctagacagaaacacggccgtgttctgtcgaaggtatagtccacaagcttatccttatggcctgcctccggacttcaccccctgtgccaccccggaagatttaagccaagcccttactttcgaggggcaactcccaccttatgaagactatcccaggcaagacgatggggaaggagatacccatcttggccccctgctccacctaaaagatccgtccccacatgaactaccccaaccgaacatagtccgccatatcccggcctcacccacacccgtaaaagaatctgtccccttcgcggaagataagggaaagattgaggcgcttgaagagaggttaagagcagtcgagggccttggcaattacccattctcgaatttagcagatttatgtctcgtggccaatatcgtcattcctcccaagtcaa

SEQ ID NO: 34953 - DNA, 165 bp, Glycine max
  Peptide Sequence Number=SeqID_126638
atgtttgcacattcgattaaaggttgccgtcccttgggacggacgtgtggggtgctaataccttccccgtgttcagaaaaagcccagagttcaagaacctcgggattgagtcaatcttttaagggggagggaatgatgcaatctacctgcaagggcattggatag

SEQ ID NO: 34954 - DNA, 415 bp, Glycine max
  Peptide Sequence Number=SeqID_126639
atgcagccaatgtttttgtctatgggagggccacccccaacagcagaaggaaaggggaaactcgatctcatcgaagagatattgagggctatagaaggatttggtgattatccgttcgcagacatgaccgacctttgcttggtgtcggacattgtcatccctcgtaagtgcgggtttaagacgcgaagatctgacgatgagtcccgcaaaggtactaatattggggacccgaccgtcgatttcgagcaagaagcaagtcggacggagaatgaagaggacgaggatgtagggcttcccccagagctggagaggataatcgctcaggaggaccgagagatgaggccccatcaagaagagacaaaactcgtagacttaggaaccgacagtgggacaaacgacgttacaataggcacgg

SEQ ID NO: 34955 - DNA, 183 bp, Glycine max
  Peptide Sequence Number=SeqID_126640
atggggttttgggagactgtgactctgggtaaagttttgggtttttgtgagaagtttagtgatgttatagtgcgggaagatatgctgaggttaaatctgattaaggaagggagaatcataactgggattaaaatgaggctaatgtccgatgtaatgagtgttaaaaacatcgtgagactttga

SEQ ID NO: 34956 - DNA, 481 bp, Glycine max
  Peptide Sequence Number=SeqID_126641
atggtcccgcatcagagcgtcaatttcccggcacaacagtttcacatgcttcagtcaagtattgaaactcaggggatagacagaagaagggacactattgaagcggaagaatattcccaacaaatggcggagcgtggccatggaatgtattacacgccacaaacatttgctgagtatccgacacagatgtatcagtatccttttcagggtcatcacactgatacttctgcaagccagcaatcgttcggtggtgttgcggaaacacaagctcatttttcatggcccacaatgaccccttcacagcaatatcatgccccgttaggaacacaatggaatgtaccgggacaaatacctaatacgggtgacttattcggtgttgatttgcgtcacgcattttctgccgaggctgacgaagaagaagcggggaggcatcggggcagaagaaatcctgatcgccaagcacgaagatgggaacgaccat

SEQ ID NO: 34957 - DNA, 240 bp, Glycine max
  Peptide Sequence Number=SeqID_126642
atgatgatgacattctctgctggttttgcttatctagagggtgaatgtgttaataatgtggtatgggctttagaacggtttcacatcgacaagaatgtcaaggaaaaatgtaaatccctaattggtcaaaaaaatgctttggagtatgtgatggatgcctggggaagtttgattgattgtcgttcagaacatcagttcgatgattgccttaagaagtttgaaattgcttgttcaccttga

SEQ ID NO: 34958 - DNA, 594 bp, Glycine max
  Peptide Sequence Number=SeqID_126643
atgggatggaacctcggcgatcgcatcgcctgctggtatcacggggtggaggtcggcggcgacggcacggtgaaagacgtgccggcggtggatcgttgcccgctggtggggcaaaaatgcctgcggtcttacccggccaaagaagcctacggcgcggtgttcctttatttcggcgtgacggcggatgaagcgccggcggagctgactttcccgcaagagctggcggacgaagcgtcgtacagcaatttcctgtgcaccgccagctggaactgcaactaccaatacgccctggaaaacgtgatggatccgatgcacggcacctacctgcactcctcctcgcactcaatggcggaaggggaccgcaaggcggatatggggctggagccgaccgacagcgggtttatcttcaagaaaaacggccagattggcgtcaacttcgactgggtggagttcggcaacagcggcgcgtattggatgcgcctgtcgatcccgtacaaaaagcgcttcgggccgggcggtcacttctggatcatcggcatggtggtgccggaagacaaggatcactgccgggtgttcttctggcgcatccgcaag

SEQ ID NO: 34959 - DNA, 324 bp, Glycine max
  Peptide Sequence Number=SeqID_126644
atgactctgttgagccgtacgccatggaatcagagctccgtgggccattatttggaacgcagaactggcgatggggtgaaccggaagctgggattaggtgcccaactgcgcgtctactatcctagcgaaaccacagccaagggaacgggcttggcggaattaaacagcgggggcatggaagtcaagaccctaggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 34960 - DNA, 168 bp, Glycine max
  Peptide Sequence Number=SeqID_126645
atggcatgtccggaggggcaaaaagttgattttggtacatatactctagtggaagaggctgagtactggtgggagaatactcgccaatgcatagaggctgaagacaaagggggcatattcagaaagattgtccatatcccaagaaggagtagaatggtgggggcctga

SEQ ID NO: 34961 - DNA, 1028 bp, Glycine max
  Peptide Sequence Number=SeqID_126646
ggaagaagcctcaagaggctaacattaacctcccatacttctatgagaaggacaatgtagaggctaacttagattgtgaaataagggtagagcaacaacttaaagagaagtctacttcaaaatcttatggctctcactcttatccaaagaaagaccaaggtcaaggaatcttaggggtgataccttctaagcccaaagatgataaggggaagataatagaaaagcaagcccctaaggctagtatgcaagagaagactagctctataaagtgctttaaatgtcttggaagaagacacattacttctcaatgccccaccacgaaaaccatgattatgaggggccaagacatttatagtagccaagatgaggctactacttcaccttcatctaatgaaaatgaagaagcaataggggaagaatctaggaaagaaatctatccccaagaagaaggacaacctttaatggttaaggaggagtgtaaggaggtaagtgtctcctccaagaggttagttaagaaggaaagtcattttgaaataaagacaaatattaaagaaacttcccctcttagacaacctccacatcttctcctttgtaaaaagacacttgttagcactgccacacctcttgggcttgaggttattccccaagtaaaggagttgttggatgagggtttggttcgtattattaggcaccaaatccctaaaataagtgatatgatgaatgttttgagtggtgcaaccctcttttgtaaaatcactcgtacacctaacatcttcatggtgtgtgtacatagggacccattaggtagtgatcaaggggttcccatgaaccctaggagaataaaggtcattcctaagtggcccactccaccaagtataagaaaaatttggggcttccatgacttaacaaacttttacaaaaggtttgagggaaggagcccagagtatgaagaacctcaggatttgaggtcaaatcctttccaaggtggagggaatgatgcaatcctaccctgcaagggcattggatag

SEQ ID NO: 34962 - DNA, 564 bp, Glycine max
  Peptide Sequence Number=SeqID_126647
gagttttatgccaaccttacaactctgaagacccttcaccaaagcaagtcaaggtcagaggccacctagtgaggattgatgcagacaacctcaacatatttttggagatgcttgtgatattagttgagggcgagactttaccaacatattccggatactgcaggttgcccacagattataaagagatcgaggctgccttatatataccaggccaagggtttgttttgaactctgaggatcatcctaggaagattctcaggaaagatttgatgactcttactcagatggacatgaatgtgggagcccttatctctggtcagatcacatctatagcccagtctaacccttctagacttgggttccctgctctgatcactgccctgcgggcaaggacgaggctagctgagcctccttccacatctatagctcctattccagcacgtacctcaacaactccttttgtcccagcttctgcagattttcaacgtcttgaagccatgcttcagagcatccatcagggggaagatgaaggtcccaaaacaaaggtaccacagcatgtggagg

SEQ ID NO: 34963 - DNA, 659 bp, Glycine max
  Peptide Sequence Number=SeqID_126648
atgtggggagcgccaaccgaagaaagtctctcgcctttccttgtgagggatctaggcgcgcaaggtctcaaggttatacaaagaatccacaaggcgtggaggagtctgttgaggaaagacaaggagcttaggggcatccgaaacggcgtcattggaggttatcatggatggctaagaattcacacgcggggcttagattggctctccaaattgaaagttattgatgaggagaacttcgaggccccagaggaagatgaagaagtccgagctctaaagttagagctagggaaggcgagactcgccaaggagaagttcaaatcagctgctacacacattcggaaggagtgcactgagttacaagaggaaaacgcggccactgcaagagctcttgaacaagaaaccaaaagggcccgcaaggaggaacatggccgagagaaattccgaggagcattgtggggtagcaacaatgagctcaagctccgaagggaggagagagatcggtcacgggcgcatggcatgatcttaaaagaagagttagttgcttgcgcgaggtccaaaaggagtttggctcaacacttggaagccatggagcaaagcatgctagctatcatagggcaatacaaggaagaattgaaccagtccatggcccatgaacacaa

SEQ ID NO: 34964 - DNA, 519 bp, Glycine max
  Peptide Sequence Number=SeqID_126649
atggctacctcaccaaacgaaatttcagcttctggttcaccctctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgaagctgatgaagatgtcccaacatcttccaccccaaatgtttctgtgcctgatgtcaataaagatgttccaacatcttccggcccaaatgctgaagtccttccttcacccagtgaagaggagtcaacagatgaagaggatcaatccacggaggagacccctgcaccaagggcaccagaacatgctccaggtgatctcattgacttagaagaagtcgaatctgatgaggaacccattgccaacagttag

SEQ ID NO: 34965 - DNA, 138 bp, Glycine max
  Peptide Sequence Number=SeqID_126650
atggggaccaccataggggaggagcttgccacccagctcgcccaggcgagccaggttgcttcctccagaagcaaccgccttctggaggaagaatctgttagacaagtggcctcagatatcttaagaagggggggttga

SEQ ID NO: 34966 - DNA, 47 bp, Glycine max
  Peptide Sequence Number=SeqID_126651
atggcttctatggacacctctgctatggtcaactctaagatatttcc

SEQ ID NO: 34967 - DNA, 262 bp, Glycine max
  Peptide Sequence Number=SeqID_126652
atgactcttgctactctatttggaaagaaaaagaagggaattgctcttaaagcctcatcttcaatcagaagaaaggataaggaaattgatctagatgaagcacaaaaaagatggagacagtctgaaaagaaaaattttagtgaaaagaaattgaagaaacatacatcacatgggatgacatatgatatggaatcttctgaagattcagaaaatgaagagataaacctctgtctaatggctaaagttatgaaagtgatgagag

SEQ ID NO: 34968 - DNA, 675 bp, Glycine max
  Peptide Sequence Number=SeqID_126653
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtgctctgcctaggggaagacacggcagcaagatggcggacatgaactatgcaaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgcaaggaagatacttaa

SEQ ID NO: 34969 - DNA, 555 bp, Glycine max
  Peptide Sequence Number=SeqID_126654
ccgatcaggacggtgtcgagggacactgtctgtgacaaatacggcatcagcaaggaaaagtgggcccagttttgccagactcacagagacccttcttgggaggatgtgcgcatgaaggcacaggccatccagaagcagaatactgtcccccacgaagctgcacagtcaggaagcgttgatggcgtcatcaaccctccatccccggtcagacgccacatgaagtggaagatggcttgcacgaagaagtcaggggagatgacaactgaggccgcaaaggaaatcgctgagaagattgattcgtttaaggagcaggccacacagggatcgttcgtcccccatggacgtcagaatgttctggccgctgctattggacgtccagagcaccctggacgtgtccatgctgctggagccggtgtcaccatcaagcaatactttggatcggctccatggacgtcccgcagcgcttcctccctgcctcctgacgaattgcagcagctgactcagcagatcagggaccagctagaggagtccatcacagagaaagtgacgaggtag

SEQ ID NO: 34970 - DNA, 427 bp, Glycine max
  Peptide Sequence Number=SeqID_126655
ggaaacatcccttagcaccgccatacctcttgagcttgaggttattcctcaagtaaaggagttgttggatgagggtttatttcgcaagagcttaaatccttgtgctttgttggtgcctaaaataggtattattaggcaccaaatccctatgataggtggtatgatgaaggtgttgagtggtgcaacactcttttgtaaaatcactcatgcacccaacatctttatgatttgtgtacatagggactcattaggtagtgatcaagggcttcctatggaccctaagagaataaaggtcattcctgagtggcctactccaccaagtgttgagaaaagaattaatgagtttcaagaacctcgggatttgaggtcaaatccttttcaagggggagggaatgatgcaatcctcccccccaagggaattggatag

SEQ ID NO: 34971 - DNA, 117 bp, Glycine max
  Peptide Sequence Number=SeqID_126656
atggattcctttgcttcttggaagatgaatggtagtggacatggagaaggaagagagagaggagctcacgccacttcaagggaagatgagtctagcaagaaactagacaccaccata

SEQ ID NO: 34972 - DNA, 609 bp, Glycine max
  Peptide Sequence Number=SeqID_126657
atgctttcgcagttgttcgtctttcataaatccaagaattgtcatcccctccctcccgacggtagaaataaacgaagttccgggtctaatctgattgtgaggcatcgacatgatccttccgcaggttcagctgtgatctattcttcacaacgtacgcgggcagcgaaccgctcacgtcgccgcaatccgaacacttaccggaccagttcaatcggtaggagcgatcgggcgggtgtacagaagggcgaggccgaccgtagtcacacgcgagctggactcgatcgcttacccaacccaaggaattaccgcggctgcggcaccagacttgccctccataggacctcgttgaaggattactcagattgtagcggtcttccaaatctaccaggactcaatgagcccgattgggtaattgcggccatagtccctctaagaagctggccgtggagggtacctccacatagctatttagcaggctccctgaggtctccgttaacggaattaaccagacaaatcgctccaccaactaagaacggccatgcaccaccacccatagaatcaagaaagagctctcagtctgtcaatccttactatgtctggacctggtaa

SEQ ID NO: 34973 - DNA, 273 bp, Glycine max
  Peptide Sequence Number=SeqID_126658
atggaggattgccttgagggttcacacttaggcaatcatgaaacacagctccaaactcgaaagtggaggacacatgaacgaaaacgcaattcatggggctccgaaaaaagctccaaactcgaaagtggaggacacatgaacagcgctaaggcaataacattcatggggctccgaaaaagggtgagaatggaggattgccttgagggtcctcacttaggcaatcatgaaacacagctccaaactcgaaagtggaggacacatgaacagccctag

SEQ ID NO: 34974 - DNA, 207 bp, Glycine max
  Peptide Sequence Number=SeqID_126659
atgttcctccagaaggcgattgcttctagaggaagcaacctagctcgcctgggcgaactgggtggcaaactcctcccttattttcctataaatagggggaggagtgaaggagaaaaaggttcaaccctcctggtatctgagattcacttaaaattagtgaaaaaaattgttttcgtgaagaaaatccaagtcgaggcgcttccgtaa

SEQ ID NO: 34975 - DNA, 264 bp, Glycine max
  Peptide Sequence Number=SeqID_126660
atggatcatggctctaagccttttaaggtttatgatgcttggttgatgaataaggactaccagaaggtggtgagggactgctggtctgaaaatcagcctagggggtggggtggctatgctctaaaatgcaaacttcagaacctaaagcaaaggctaaaaacctggagcagagacaatattggagacttgggtaacaaggtgaagcagatccaacaaaagttgaatgatttggagaactctctcacagctcaaccttctaactag

SEQ ID NO: 34976 - DNA, 375 bp, Glycine max
  Peptide Sequence Number=SeqID_126661
atgacggagaaaaaaatgatgatagtagacacattaccagtattctactatgaagagatggtaggttacacaccttcaagctttgcggatttggtcttcaccggcaaaaggatcgaagtgggtctgaaaagaggcaaatttggtcatcctgctttgatgaaaactggggcaagtgaagagggtgagaatgagggagaaacccatgcagtgactgccattcctatatggccaagtttcccaccaacccaacaatgtcattactcagccaataacaacccatctccttacccaccacccaattatccacaaagttcatccctaaatcaaaccacaaaacccacctaccacacgaccaatgctaaacaccacttttag

SEQ ID NO: 34977 - DNA, 855 bp, Glycine max
  Peptide Sequence Number=SeqID_126662
atggctacctcaccaaaagaaactgcagctcctggttcacccgctgtaccatcatctccgcaccaggaacaaccagaattcaacatccaacccatacagataattcctggtcgagcttctgtccctgagaaactggttcccagaagacaacagggagtgaagattgctgtaaaccctagccttgcaacaagttctagggaagtagacacggagatggacaagaaaatccgcagtatggtgagtagcattttgaaagaagcctctgtgcctgaagctgatgaagatgttccaacatcttccaccctaaatgtttctatgcctgatgttgagaaagatgttccaacatcttccggcccaaatgatgaagtactctcttcccccagcaaagagagatcaacagaggaagatgatcaagccgcaaaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaagagcactccagtcactcctgccacatccagaagaagcaaggttgctatcccctccaagaaaaggaaagaaatttcctcatccgattcggatgatgatgtcgaactagatgtctcgacatctaagagggccaagaaatctggaagaaaggtgcctggaaatgttcctgatgcaccattggacaacatctctttccactccattggcaatgttgaaaagtggaaatatgtgtatcaacgcaaacttgcg

SEQ ID NO: 34978 - DNA, 777 bp, Glycine max
  Peptide Sequence Number=SeqID_126663
acgtcgtggcggaattgcaggcggtaatccagggccagcttggtgacgaacacgacggcttcgggatcgtcgccattgacgtggaacaccggcgcttcgatcatcttggccacgtcggtgcaatacagcgtcgagcgcgagtcgcgcggatccgacgtggtgaagccgatctggttgttgatgacgatgtgcatcgtgccgcccgtgccgtagccgcgggtctgggccaggttcagggtttccatcaccacgccctggccggcgaaggccgcgtcgccgtgcaccagcaccggcagcacctgcttgccttcggcgtcgccgcggcgttcctggcgggcgcgcgcgctgccttcgaccacggggttgacgatttccaggtgggacgggttgaacgccagcgacaggtgcaccggaccgccacgggtcgacaggtcgctcgagaagccgttgtggtacttcacgtcgccgtcggtcaggccttcggcgtgcttgccttcgaactcggcgaacaggtcgccgggcatcttgcccatgatgttcacgagcaggttcaggcggccgcggtgggccatgccgaccacgatttcctggacgccgttttcaccggcgtggttcaccacttcgtccatcgaggcgatgaagctttcgccgccttccagcgagaagcgcttctggccgacgtacttggtgtgcaggaagcgctcgaggccttcggattcggtcagctgctgcaggatgtggcgcttttcctcggccgtgtactcgcgccccagcgtg

SEQ ID NO: 34979 - DNA, 294 bp, Glycine max
  Peptide Sequence Number=SeqID_126664
atgggggtgcaaatagcacccaggcccacttgggccctccggaatattcctccagaaggcggttgcttctggaggaagcaaccctgctcgcctgggcgagctgagctcgcctgggcgagctgggcggcaaccacctcccctatttttgctataaataggggaggaagtgaagaaggaagggccgaggcgcttccgaaacgtttccgtaacgttttctgtgaggaatttcgcaaagatttcaaccgttcttcgacgttcttcattcgttcttcatcgttcttcgatcttcaacgg

SEQ ID NO: 34980 - DNA, 415 bp, Glycine max
  Peptide Sequence Number=SeqID_126665
gagccttctagaactcatagcccaagatgcaacactggcctaaaacaagctattggcccgataaacagaggccctgacggagaccctcaacaagctccctcagcaactacaagcggtaagtccctctcactcttcaatcatacaaatagaggatgccacatttgcgatggaacacatgagccaaggcaatgcataacccaagaggattcttccagggaggtgaactacatgggagctcagaatcgccacagattcctagggtacaaccaaggaggactgtcgggattcaaacaagggaggaattttacacagggcttaagctggaggaatcatctaaggaaccaattcaagaaggagcaaagaagtcaacttgtccagaattccaaccaaggggtcgatctttatgagaagacta

SEQ ID NO: 34981 - DNA, 216 bp, Glycine max
  Peptide Sequence Number=SeqID_126666
gtcgacggtatcgataagcttgattccgatacttggtggatgagttgttccgagttatcaagccagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggc

SEQ ID NO: 34982 - DNA, 249 bp, Glycine max
  Peptide Sequence Number=SeqID_126667
atggagtcgccatctgtcgcaacctaccattcgacaggagtgcaaggtgaaaagccaaaggagcgtcttctagaaaggaaaatgtgtgggagtcgccaccaacgtttatttgaggaaaacattagaaaaaccaaaacgaggtctgtgaattttgaaaataagggtttgagagttgtttacgcatggggaagggtgttgcccctgctcatacgtatccttaggtgtgatgagaaattcagacctacgtag

SEQ ID NO: 34983 - DNA, 222 bp, Glycine max
  Peptide Sequence Number=SeqID_126668
atgccagagccacgcacggagaagcaggttcgaggtttcctgggcaggttgaactacatcgcgagatttatctcggagcaactcacccctacctgcgaaaagccctcttaccaaattgaagaaacccaactggtgaacttagggaccggagaggcgaaagaaagaagtaaaagtagcctcggaacccggtgcatgaccgcacctgaatccgccaaggcttga

SEQ ID NO: 34984 - DNA, 838 bp, Glycine max
  Peptide Sequence Number=SeqID_126669
atgggcttaagtcaaatgccttcacttaaaaagaggttctatcaagtcaaagtcaagagcctaggaatcaccagtctaaaagagttagggcagttgatgggtcagctccagcggcaagcttttcgcaaagcttacgccgttgagatgcttcacttttgggacttccagctatcacccatggtggaagaatttgaagagatcctaggatgtcctctagggggaagagaccatacctctaagatagtccaaatctcggcgcaggaattagaccacagaaagcaagtcgaaaatggggtggttggaataccgagaaaatgtttggaggaaaaagcaagaaccttggcaggtagaggcgaatgggccccgttcatagacatcctcgtacttttgatcttcggaggagtcctctttccaaatgtggatgggttggtggacctggcagtgatcgacgcttttctcgcctatcatgaccgcaaggaaagcccggttgtcgctatactagccgatctatatgacaccttcgaccgaagatgtgagaagagcagtacaaggattgtttgctgtacttcggccctctatgtattgttggtttcacacctttttcaccaagagaatgagcgtctgtcaactggttccctcgatggaaagaaggaagaatcgggattcttatttcgtgcggagggggcaccactagaggaagagctcgcacctattattgcacgaggtttcaataagaccaacgtggaggcacttcagaaggtccgcaaggcatgggatatggtgcaaaagaaggacaaagaactcagaggcagtaacaacgggtccatcggcggctacc

SEQ ID NO: 34985 - DNA, 348 bp, Glycine max
  Peptide Sequence Number=SeqID_126670
atggcccgcaccaagaaaactggtcaaatgacgtttgaggcagcaaaggaaattgctgacaagattgatttcttggaggatcagacctcacagggaagttttgttgcccatggatgtcaggatgtactaattgctgccattgggcgaccagaacaccctggttgtgtccgtgcggctagagtcggtgtcacaatcaaacaatactttggacctgctccaaggaccttccgcacgtcttcgtccatggctcctgaagacctagagcaactgatgcaaaaaatcagggaccagctggaggagtcaatcacagaaaaagtgactcaacaactaatgttgtccttcagctag

SEQ ID NO: 34986 - DNA, 186 bp, Glycine max
  Peptide Sequence Number=SeqID_126671
atgaagcttgcttctacaacttcttcctccaagctcttatccatggcctcctatggtgtggcatctcctctctctcttccttctccagtccgctaccattcatcttccaagaagcaaaggaatccattgatgaagtacatcctaggcctacaagctccaatggagcttacatcagaaggcacatga

SEQ ID NO: 34987 - DNA, 276 bp, Glycine max
  Peptide Sequence Number=SeqID_126672
atgacaagaggaaatccatctgacttacaaccctttgatcctgagatagatatgacacttcatagattagttagacatcatttagtaccttttgagcatcttgagcattctgttattggtgattttgagcattatagttttgagcattctgattttgaatattctgagaacatggcacaccctccacctcgtgaaaggactctaagggaattggctgcacctgatttcacctacgaaagcttgtgcatccaataccctgatgaggatgtcccataa

SEQ ID NO: 34988 - DNA, 783 bp, Glycine max
  Peptide Sequence Number=SeqID_126673
ggctacacgccctcaccatcagaggactacatgtcctcaccttcgtagggctacacgccctcacctttagaggactacacgtcctcgccaacagagggctgcacgccctcacctttagaggactacacatcctcgccttcagaggactccatgtcctcaccttgagagggctacacgtcctcgccttgagaggactacacgtcctcgccttgagaggactacatgtcctcaccatcaaagggctgcacgccctcacctccagaggactacacgtcctcgccttgagagggctacccgccttcgccttggggctacatgccctcacctttagaggactacacatcctcgccttcagaggactgcacgtcctcaccttgagaggactaaacgtcctccccttgagaggactacatgtcctcaccatcagagggctgcacgccctcacctccagaggactacacgtcctcgccttgagaggactacatgtcctcaccatcagagggctgcacgccctcacctccagaggactacacgtcctcgccttgagagggctactcgcccttgccttggggctacacgccctcacctttagaggactacacgtcctcgccaacagagggctacacgccttcacctttagaggactacacgtccttgccaacagagggctgcacgccctcaccttgagaggactacacgccctcacctccagaggactatacatcctcgccttgagagggttgcacgccctcacctttagagggctacgtgtcctcattttca

SEQ ID NO: 34989 - DNA, 300 bp, Glycine max
  Peptide Sequence Number=SeqID_126674
atggaaattaaatgcacagtggaaagtaaaagagtaggaaagaaggaaacaaacacaaaagagtttttatactggttcggcaacaacccgtgcctacctccagtccccaagcgacctgcggtccttgagatttctttcaaccttgtaaaaatctttttacaagcaaagatccacaagggattggatgtaccctccactaaaactgatccacaagagatgtaccctctcttgttctcagtcaaacccaagaagatgtaccctctacttgtaccacaaaggatgtaccctccaatgtgttaa

SEQ ID NO: 34990 - DNA, 420 bp, Glycine max
  Peptide Sequence Number=SeqID_126675
atgctttacggtgcccttaccgtaacccgtgctagagctagagtaatgggtgaagtagaggaggtgcaagagcagataaaggccaacatggaggccatgaaagagcaaatggccacagtgatggaggccatgatgagcatgaagaagataatggaagtcaatgcggttgcagttgccgctaccagcactgttgctaaggtgaacccgacgcccccatctggcctcaaccaaatgaatcatccaacctcagatatggtacgcaaagatttgggaagtacgggtggcccccatgatgtgcaaattcaaaacgagcacgccttcccgccatatggtttgcctctcaactatacactacccaatgtggtgtacactcccggtgaggatgtcaataactccgctcccatactcattgagagctga

SEQ ID NO: 34991 - DNA, 461 bp, Glycine max
  Peptide Sequence Number=SeqID_126676
ccacctgggatgtggtggcatggaatcatccggcgacggttgtgctgaaggattacgggcaacttccgcccgcgcggcgcaatattctgcgcctgctgtttaccgatcaggaagcgcgggggatgcaagacgactgggagggcgttgcccgtctcatcgtcaacgcctttcgggcggatgccgcgcgcctgggggcttcagaggaaattgatcgactggttgaggagctatccgctcaaagcgctgacttcgcccgcctgtggcgtaacaacgatgtggccgggcatggcgaagggtttaaggtgctgcatcatccgcaaatggggacgattgccctggagttctcgaccttttctgttgaaggcaggccggatttaacgatgatgctctttaatccggcaaccgatgaaagcagagcgaaaacagagcgctggatttcacagaacccagctcagcgcgta

SEQ ID NO: 34992 - DNA, 555 bp, Glycine max
  Peptide Sequence Number=SeqID_126677
atgaagcacttcactgacaccctcatcagtgccacatactggcacgacaggtttcccgactggaaagcgggcagtgagcgcaacgcaattaatgaaacagctatgaccatgattacgccaagctcgaaattaaccctcactaaagggaacaaaagctggtaccgggccccccctcgaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 34993 - DNA, 668 bp, Glycine max
  Peptide Sequence Number=SeqID_126678
atgggtgatcaagaggagacccaggaacagatgaaagccgacatgtcggctctgaaagaacagatggcttccatgatggaagccatgttaggaatgaggcagctcatggagaaaaacgtggccaccgctgccgctgtcagttcggctgccgaagcagacccaactctcttggcaaccgcgcaccatcctccctcaaacatagtaggacggggaagggacacactggggcacgatggcaaccctcatctgggatacaaccgagcggtttacccttatggattgccgcccaactactcaccacccgtcctgcaagacgatgcgggccatattgcttctcccgtccttgaaagagagcctcctcaacagcccgacgaggtccacaaagaccctcaagactatgctcgaagggatgtcgagttctatcccccgatccccgaagggccggcacccagcacgttgcctcagcccaacatcacgacacaaccaatagttttttccatggaaggaccgcccccggcaactgaagaaaggaggaagctcgatctcctcgaggagagattgagagccgtggaaggatttggggactatccgttcgcagacatgatggatctttgcttagtacccgatgttgttatccccccgaagttcaaagtaccggacttcgacaa

SEQ ID NO: 34994 - DNA, 231 bp, Glycine max
  Peptide Sequence Number=SeqID_126679
atggtaactatcatggtttttcacttaaggcttgtatttgctgagcttcaacaacaaaaccagggaaacaaggccaaaatgggcttcaaaggaattaattccgaagccttttgcactcctgggcaaaatgaaacaaagaacaaaatccaaggatatcagagggagacaaacaaaaacattcacatatttctcaatgaacatcaaggaatgaaaggaatgggtaacatctaa

SEQ ID NO: 34995 - DNA, 87 bp, Glycine max
  Peptide Sequence Number=SeqID_126680
atgtctcaggccacggtcaaaagtcaagacaagtcaatggcagaaatcaacccaaggtacttagggatggaagcgaatgaaggatag

SEQ ID NO: 34996 - DNA, 414 bp, Glycine max
  Peptide Sequence Number=SeqID_126681
atggtaggtttggaaggcaaggagttgggaggtacgggcggccctcatttagtgcaaaaaacaagcttgccttcccaccatatggcttgcctcccaactatacaccacccaatgtggcatacactcccagtgaggatgtcaataactccgctcccatactcactgaaagccaacaacctcaaattgatcatgcacatgtctctcaaaccatgggggagacacatgaaattccccaccacattcaagctgacttcgagccttgcctcggatatgccactgaagggcaagcaattggtggtatacctctgcaaaacactttggagaggccttaatttttccctcaaccacaacacttctatggaaaatggtgggttacacaccttcaagctttgcggatttggtcttcgccgatga

SEQ ID NO: 34997 - DNA, 381 bp, Glycine max
  Peptide Sequence Number=SeqID_126682
atgggttcgtcgggctttgatcccattccgttccgaagcgttctgctcattgagttttgtaaaaggttccggtctttcttcggtgaatctcgaggtctttctgatggctgcgctcagcctaatgttatctacgttgacccttctcagactagtttacaacgtgtgactatcccatcctacatgggtttcaggctgaaagagggctttctggcgaaaaggaggaaagcattggtttatgcccacccggctgaaaggaggctttctggccggactcgcagacaacttccaatgccttccaggcagaatgaaaaagctatggaaggtccaaaagggactatcttcatagtaaagaagctatcctttcttgcgtcatcagcttga

SEQ ID NO: 34998 - DNA, 261 bp, Glycine max
  Peptide Sequence Number=SeqID_126683
atgtcgatggattgctacgaaggcgactgtgaagtccatatctatagcgacctacgatgggggcccattgctgtcagaaatcgaccagagaggatcatgcgccagtttggatatgtccaaagtattcctatagaggctgtcaattcatgggtgtcatttgaagaaatagacgacaggtgggtgcactactcataccatcttgcaccagcaggtgagatatgtcttatgccaggtcagtgtgcgcctgagtacatggactag

SEQ ID NO: 34999 - DNA, 166 bp, Glycine max
  Peptide Sequence Number=SeqID_126684
atggatgactcctcaaccattgaagaaactgaggtaaattctaaatttgaagaagttttggaagcatttactgaaatgcatgaggaagcgcaaaggcttgctgtttcaaacaataagctgagaagcgatctaaaattgcataccactaaattggcttcaacacaaa

SEQ ID NO: 35000 - DNA, 402 bp, Glycine max
  Peptide Sequence Number=SeqID_126685
atgtgcgaagatcaatggacgtatgactatgcgatgtcacaagaagttcatatggattatgattatgatgatgaagaagaatgtggtgtgaatgaatcacatgtcaattgttcaaatgcttttaatacgtctcaggtatttggtactcgagatgatgttttgcagtgggctcgaacagttgcccatgaaaatggatttgttgcagtgattatgaggtctgacacagataccggaataaagaattcgttagaaaagacactgggagtaggaaatgtggttgtcccttcaggcttcgtgggaaccagtgcatggaggggaaggttgatggtgaagttgatctgtgggattcacaatcatgaattggccaagtccttagttggacatccacaccgctggcattga

SEQ ID NO: 35001 - DNA, 1035 bp, Glycine max
  Peptide Sequence Number=SeqID_126686
atggagtggatcacgcaccaactacaagaaaggaggatgagacgacgtatgaggataagaaaaactagacaagcttatggtaaaaatgaagacaacgaggactggatcagtgagagagaagttgatggtgaaactgaggacgatggggacatgatcagtgagaggaaaagaaacattagagaagttgatgctgaaaatgaagacaacggagataggatcggtaaaaggaaaagaaacattagagaagttgatgctgaaaatgaacacaatggagacagaatcagtgagaggaaaaaaaacatcgctagagaagttgatggtgaaaatgaagaccacaggccagacaggatcagtgccttgcctgatagccttctgttccacatgataaattttatggacacaaaatctgctgttcaaacttgtgtcctgtctaaaagatggaacgacctttccaaatgtctcactaatctcacatttaattctgatctcccaagcgaaggcctggatagaagttttaagaaatttgagtcttgggttttgtctagtcgcgatgactcatatcccctacttaatcttaccattgagagttggatcgatgctgatgttcaagatagggtcataaaatatgctctgttgcacaatgtccagaagttgaaaatgaatataaattcaacaacctatagacccaattttaagtccctccctttaatctttcgcagtcagtctttgacatctcttgagctttccaataagttgagcccttctaggttaaaacttccaaaatctctatgcttgcctgcattgaaaagcttgcatcttgcatatgttacattcaccgcaagtgacaaagaccgtgttgagcccttctcaaactgtcatgtgttgaatactttggtcctgagaaatttttctttgagtgcacaagtcctcagcatatctaattctaccctttccagtttgacaatatttgaaggacaagcttgttcaattgtgctttctactccaaatcttagttctttttccatcacgggttcg

SEQ ID NO: 35002 - DNA, 1998 bp, Glycine max
  Peptide Sequence Number=SeqID_126687
atgggagaaggaacctttcgctttggccttgatcatgccactccaaaacccgagccaaacgaggccaaacatgttgcacccattgtgtcctcttacaacgagcgcatacgtcctgttcttgatgctgtcgagaacctgaggcgcctcaacatcaccaaagaagggatacagcttccaaccatagttgttgttggtgaccagtcttctggaaaatccagtgtcctagaatctctggctggaatcagcttaccccgtggacaaggtatctgcacaagggttcccttgatcatgaggctccaaaaccactcacttcccaaacccgagttggtgctagagtataatgccaaaatcgtgtccacagatgaggctcaagtctctgatgctatccgagttgccacggatgagcttgcagggggtgggaaaggaatttccaacaccccattaactcttgtggtgaagaaggacggtgttcctgatctcactatggttgatcttccaggcatcactcgcgtgccagttcatggtcaacctgaggatatatatgaccagattaaggatataattatggagtatataaggcctgaagagagcatcattctcaatgttttatctgccactgttgatttctctacttgtgagtccattaggatgtcacaaggtgttgacaaaaccggtgagaggactcttgctgtggtcacaaaagctgataaggctcctgagggcttgcatgagaaggtaactgctgatgatgtcaacattggacttggctatgtttgtgtcagaaatcgcattggggatgagtcctatgaagatgctcgagcagaagaagtcaacctattcaggactcatacacttttgtccaaaatagacaagtccattgtgggggttccagttttggcacaaaagctggttcaacttcaagcggctagtatttccaaaatactgcctgaaattgttaagaagatcaacgacaagctcggttctcagctttctgagctggacaaattccccaggaaacttacttctgtgcctaatgcaatgtctgctttcatgcatatcattgggttggcaaaagagtcactgaggaagattcttctcagaggagaatttgatgagtaccctgatgacaagcacatgcattgcactgctcgccttgttgatatgctggatcagtactcaaatgatctttacaagggtcctgaaagtgatgctggtgagaagtttttgatggaagaaattaaggttctagaagaagccaagtggattgggctcccaaacttcatgccacgcagtgcttttcttaccctcttacagaataaagtgagagcaatttcaagcatgccaattgagttcacagtcaaggtgtgggactatcttgaggaagtggtggttgctgttctgaagcgtcactcagaacactaccaccaacttcagacaagtacaaaacgagcagggaagaacctcattgctaagatgaaggagaattctatgaaatatgtgatggaggttgtggaaatggaaaagctaactgattacactagtaatcctgaatacatgagtgagtataacgagctaatggccaaccaggatgaattcgtggagaaagttaatacaggcaactatcatgaagttgcccttgatggttttgagcaggcgattaaggttggtcatctgagtcagtactcaactttacttccgcaggcatttgacttgaaaatgagactgagagcatactggaagattgtgcttcggaggctgatcgacggcactgccctgcatctgcaactcagcattttcaaccttgttgacaaggatctgggagatgagattgtgaaggatatgatgtctccatatgcaggtggaattgagaagttgttggaggaagctccttcagtttcaatgaagcgtgacaaactcaataggagcattaaagttctgagagaaagcaaagaagtcgtggctaacataatggacaaaatttctagctatgatgattag

SEQ ID NO: 35003 - DNA, 219 bp, Glycine max
  Peptide Sequence Number=SeqID_126688
atggctgatataattagtttgtttgctattaagaaagttaatttctatgataatcaaagcccaccaaaccagtctcagaaaaacgacgatctcgaacccgttcaccgttggatcgtcgtgaaatttgagtatcatgttcgcaacacaattccgagcattctcaccgttgggaatttcgatatcatgtctgaactgagagaaacacccttcgcattgtag

SEQ ID NO: 35004 - DNA, 1239 bp, Glycine max
  Peptide Sequence Number=SeqID_126689
atggatgaacttctgaagcgagcttccatgtatgagtatgatgacgatggcaacaaacccctgcaaaacttgggggataaagatcaacagacagacccttatagttttgatggtgggggtagtgttactttggccgatatcaccgaagagcagcaacatttgaccatcaaaggagagcccaagcatcaaaagattggaggtaaaaaagatgaaaacccactaggatcgagcctcaatctttattgttgtcattgtacatcaaaaaaagatgagaaaaatgaaaagataagcaccaaagaaaagaaggtgttggagacaccgatattaatagctgcaaagaacggtgtgacagaaatggtagcgaaaatcatggactcgtttccagtagctgttcatgatatggatgccaagaagaaaaatatagtgctattggcagtagagaacagacaaacctatttatataacttcttgctcagcaagaaaaatctaaaggaaagtaatatattcgaaaaagtggataacgagggaaacagtgcattgcacttggcagccaaacttggagactataagccttggctcattcctggcgaagctcttcaaatgcattgggaaatcaagtggtacctatttgttaagggatcgatgcaacctcatttctttagtcactacaacaatgaaaacaagacaccaagagatatcttcagtgaaactcacaaggacctcgtcaggagtggtggagaatggctgaaaaaaactgctgaatcttgctccttggtagcagcactcatagccgctgtagccttttccacatccaccaacgtccccggcgacttcaaagatgacaccggctccccaacccttgaagaaaggccagaattcaaagcctttgccatcgcatctctcattgctctttgctgctctgtcacctcactggtgctgttcctctcaatactcacatctcggtatcaagagcgtgattttggtaaaaatcttcccaggaagctgatcctaggtttgacatcattgttcatgtccattacctccatgatggtttgtttctgtgctggccatttctttgtgctaaaggacaaactcaaatctgttgcctttcctgtatatgccgtgacatgtcttccagtcacactttttgccttggctcagtttccactctacatcgatctcacatgggctacttttaagaaagtgccacagcgtggctacaaaacctctctaacatag

SEQ ID NO: 35005 - DNA, 474 bp, Glycine max
  Peptide Sequence Number=SeqID_126690
atgaagctcgagcataatacaagagaaggacaacatttgaaaagcggcgggaagacaggtagaaatgaaccacctacaactccaaggaaactatcagaatgggaagagattgataaactttggaggaaaaaggaaatgcataatttagcaaaggaacttgtaaacttgctagcaccaaaagactattcatggcgaaatactgctatagcaagggatagaacagtttccatggggagatcacaacaagaaggaaagtctaaagaaataaaaggggaacaagagggtgcaaggaaaccaacttatacccccttgcttatggctgcttgcaatggaattacggagattgttgaagtaataattcatttccatcctcattcaattgagcatgttagtgacgacgagcagaacatattgtacatggctgtcaaacaccgccagaagaaaatttaccaaatcttaaagaaattgaaaatg

SEQ ID NO: 35006 - DNA, 444 bp, Glycine max
  Peptide Sequence Number=SeqID_126691
atggccaccggcgccgtcaacgcctccgtcaccggaaccgtttacaccgacaacaagctcgccatataccaggtggacaaagtgcttctcccccttgaccttgtgcttcccagcgaggctccggcaccggcgccgggaaaggctaaaggggcgtcgccgaagaccgataagacgaagtccggcgccgatgacggtgccgccggtggcgatagtgacaatggtgataacaaggacttgcctgctgaagcttcttctgctggttccgtgcagtggctttacccgaacaagtgtgtgaacccaagtgcagtgcgacacaacttaaatcaagcagctgcagggaaagggtgcaggaagggacaaggtgtgacagctttgggaagagaatggagtggggaaaaaacactaccaaggggcataataatctatttgggttcattattttag

SEQ ID NO: 35007 - DNA, 1569 bp, Glycine max
  Peptide Sequence Number=SeqID_126692
atggtagccttgtgcaaggaaactattggtcatcaagacattgtaagttcgttgtttaagggaatgcaaaaagagaaaaagactatcaactctgtagaattgtcaaaagcaatgttcgatgcagcacaatcaggaaacgttacgattttagagtttctttttaacaaccatccagatttgctatttgaagtggattccacaaagcaaagaagcttacttcatattgctattctatatcgacaagaatatgtataccgactaatattaagcaagggtgctttcaagaatgttatgatacagttgattgattccgacggtaacaatgttcttcacttagctgcagagttcgattctaaagaaagattaggattaccatcactccctgttctaatgtgtagtgaggagaaatggtttcaggaagtggagaaaatagttccacctgctatgaaaagaatgaaaaataatgatggtttgactcctaaagaagtatattaccggtcacacaaagatttgcacacagaagcggcatctatagtgaaaaatttggcaaatactttattagtggtggcaattctaattgtcaccctagggatcaccggagctataaccgttcctattaaggatcttgatagtacaagtagtcctttttttccaaagaagacatggtatacgttcttttttctatcaattgcatttggaacatggctttgtgcttcatctatgttctgctacgcttccgttattcttcctcaaatcatgtatactgctgctatttctggtgccatagtggtctttgacttcttatccaattggagcatttacctcatttgtggatttggggcccctaaacccccagccaaaccagcccctgccacaccaactccagctccagcaaaatcattggttccctcattaccccaatcacctttctctgattcttcttctaatcaatacaacttcaaaattctaaggaagaccaaatcattcagcacactaatccgcttgctcaaaaccacccaaattatcaaccaagtcaatgcacaacttgtaactacaaaatctggaggaggtttaaccatccttgcacctgatgatggtgccttctcacatctccaagcaggttacttcaactctctcggcgatcgccaacaaaaagcattgatacagttccatgttcttccagtttctgtctcaagctctaattttgactctcttagcaatccagtaatgacactggccacttatgggaacagtgtgaatatttcaactggggttgtgaatgccactctcacaggcattatgtacagtgataagacacttgccatacatcatgtggacacggtgcttattcctttgtatttctcaaagcctaagcctccagctcctgctcccacgttggcaaaggcacctaaagctgataaggataactcatctgcgcaagatgatgatcagggagagtcaaataaggccacttctgctgccaatgccatcaatttaattagcattcacggaacaatgttggtgtcccttggtgttgctttagtggcagcagtaacattctccatatga

SEQ ID NO: 35008 - DNA, 4077 bp, Glycine max
  Peptide Sequence Number=SeqID_126693
ggttggtgttctgatcatgactagggctgtccgtagtagggtacttaaagatgccaatggtgatattagtgatcatctacgcaaccacattcatttgactaattgtattcacctgaagaaccatatgcacaagaacagccccatactggctgataggtcaatcatgagggacctagttgtgctgcagagatcgcggtctcttagagacccttctgcaagtcctccatcatggcactcgccttctgtagttgacttgcttttcaaaagagttgaaaatgatgccgtgtctcaagggggaaggatgtctgtaggtgccgagcgaaggaaggaagggagaagattgtctggaacttcaccacccttggtgagtataggttcatcaagagttgctccgggtgagattggtaggggtaatgatgggataacggcacctagtgaacgaagtagcaggagtggattgggagatggaaggagagttgggagagaagaatctggtaggaagaatgataggcctgactttttggatgttaatccagaggagcctctctatcaaggtggcaaaagcttggctgaagatgttatttcaaggcactcagagtctaaagctagaaagagcaaacaaagggggaagaatgttcgagatgcccaagttaagaccctttctgagcagctgaatgatgttccattggatagtgatgatttagcatcatcgaacattcattttcgtggaaggtttcctagacaggagaaagttattgaggaggtagaatcccggatgcgcagtcatggcagtggaatgaataagggaaaaaggcgtaagtttcgaagcgtgcgaagaactcgggttgctacaacatcaagagatattggagctgagaatgaaatctctgtggcttccaactcattagcccaccataaatatcacttggaggaggctgatgagtttgcagatgaaaatgttaccagggctccaaaaaatgggtgtggcattccttggaattggtccagaattcatcatagaggtaaaacattccttgacctggctggaagaagtttgtcttgtggtttatctgactcaaggttgaagaaagggacatttactgccaatggaagaaatatttctgagatgcctgtggcatctgagcgctcaagctcatgtacgaagtctgatgcagaggcactgcctttactagttgaggcttctggatctcatgcaagcactgaaaatgcttgttgggatcatgactactctggggaactaggtctttttggtgataatttattcaagcatgatgttgattctgacctcgcttcagaagctagatctggtgatcagcgtaagttgagagggaatcgtcacagtagacaccaaagtttaacacaaaagtatatgcctcaaaccttcagagatatgattgggcagaatttagtggcacaagctctttccaatgcagttatgaaaaggaaagttgggttgttgtatgtgttttatggcccccatggcactggaaaaacttcctgtgctcgcatatttgccagagctctgaactgtaattcttcagaacacccaaaaccttgtggtttttgcaattattgcgtagcacatgatatgggcaagagtagaaatataagggaagttggtccagttagtaattttgactttgagggcatcatggacctacttgacaatatgactctttcccagcttccgtctcattacagagtgtttatttttgatgactgtgatactctgtcaacagattgttggaatgctatatcgaaggtcattgatcgagtacctagacgtgtggtttttatccttgtcagttctagtcttgattggattgcaaccaaagaaggtctagaaattgataaggatgccctgaaactcattgcatcaaggtcagacggatctttgagagatgctgagatgacccttgaacaacttagtttgcttgggcagagaatatccgttcctcttattcaggaattggtagggctaatctctgatgagaaattggtggatctgcttgatttggcattatctgcagacacagttaacactgtgaagaatttgagagtgatcatggaaactggtgtcgagccattggctttaatgtcacaacttgctacagtaattactgatatacttgctgggacctatgatttcacaaaagaaaggcgaaggaggaagttcttccggagacaaccattgtccaaagaagacatggagaagctgcgccaagctctgaaaactttatctgaggctgagaagcagttgaggatgtccaatgacaagctaacatggttgacagctgccttacttcagcttgctccagaccagcaatatgtgttgccaacttcatctgataatagtttcaaccacagtccctttgctttaaaagatgcagatgcaagagaagcagctagactgactggtaatcctgttgacattcctaacaaagggagacggttatcaatggatgctagaattgaaaatttccatgctggaagctcagcagatggtatgacaaggggtcttggttctgagaaaaaacgacatagcgtgtctggttttactcctcaacatgctcattcacaaaccactgataagattaggatgagcgagaggcagattttgggtaaaaaccataaagaaattgaagagatatggttagaggtacttgagaggatacaagttactggtctgaaagagtttctgtttaaagaaggcaagctgatctctgttagttttggggcagctccaactgtgcagctaatgtttagttctcaattgaccaaatctactgccgagaagttcagaggtcatatcttacaagcatttgaatccgtccttggatcttctataacaatagaaattagatgtgagttaaataaagatgcagcctcggctgttcaacaacctcttacattgcccgctaccaatgatagttcgtcccagattagagactttaatggtgttggcactctagctcatccatcagtaactgattctgttgaaaagagaaggggtgaaattgtagaagaagcagcttctcaagtggagcacatgaatagcgagcagcaggttgatgctcatggaacatcttataaaagtttagaaggtacaagtataggacaatcatcagcttcccaaaaaatgccaattgttaagtcgcatttagacgaaagaaagcttatggagcaaggtcaaagtcggagtcttgtaagaagcaaagtatctcttgctcatgtgatccaacaggcagaaggtcagagaagtgggtggtcaaaacgtaaagcggtttctattgctgagaagcttgaacaagagaatctgtatgagactggaaccaagatcaaggagcttgatatgctggaaagcatcaagagtaacccggcgaaagctgtcacgcttgaaaattcgaagccgaaagccacgtgcactgctgaatcttgtctcatgtgggaaatgtctgtctacaaaatctccaagggtatggaagaagagaaagagcctctcaactctgaacaattgtcaaaagtagtgttcgatgcagcaaaatcaggaaacattatgattttagaatgtcttttgaaatatcatccagatttgctatttgaagtggattccagagagcaaagaagcttgcttcatattgctattttgtatcgacaagaatctgtataccaactaatattaagcaagggggattccaagaatgtgatgatacaattggttgattctaagggtaacaatgttcttcacttagctgctggagagttggcacctgaagaaagatttggattaccaaaccatgtactaatggctagagaggagaattggtttcaggaagtggagaaaataggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcg

SEQ ID NO: 35009 - DNA, 246 bp, Glycine max
  Peptide Sequence Number=SeqID_126694
atggccggcaccggggctaggaacagatcgcagaagaatttgttcagtgcttatgaggtgacgcgcaatgagcttctcatcgaccacggtggagtgtccttttctgctgggtgtggaagttgggacgatgaagctttctggcttctagacacgaacaaagggaagcaaagagaaccaagaatagaacaaggtgagagccaaagcgtgccatggaaagtggaaactgaaacaagggagaaagagtga

SEQ ID NO: 35010 - DNA, 273 bp, Glycine max
  Peptide Sequence Number=SeqID_126695
atggcttttgtcctgttatcaggacctcacaaaggtgttcataccaactttaaagacctttgccttgcaaaggaggatggattcaacccctcaatcaatgagactataaacctgattcaggcagaaatgatggactacattaccatcaaaataacaacttgcccgagcagctttactgttcagaattacccatgtcatgttatgagactcttacctgaggatcatagaaactatctctgtctagactatctctattatgaatacgaaatttga

SEQ ID NO: 35011 - DNA, 216 bp, Glycine max
  Peptide Sequence Number=SeqID_126696
atgatactggtggcgatcgtggcggaggtgctggaggagtatacggcgttgctggccagagtggtggagcaggtgttccgttccgcccctgtccctcgacggtggatacatagatcatctgtttcgtttaacctctcactcttgcctctttgccttccctgcatcactctagaaacttctttcacctctttattatattattatgttaagctctaa

SEQ ID NO: 35012 - DNA, 288 bp, Glycine max
  Peptide Sequence Number=SeqID_126697
atgtggaggcccttggcagtgagggacttggaggggggttttgtcgaggtgtgtttggaccttgatggtacagttgttggagtaatagtggtggaggggggagggaagggtgaggaaccaggttttggagtattggggggaaagggtggaggaggtgaagacgaagaagagagtgaggaaggagacaaaaagggtgaagtagaaccagaagaagaagggattgttgttgggtttggtgggtgggatctgtttttcagaatttcctctcacctaataagtggtgattga

SEQ ID NO: 35013 - DNA, 1269 bp, Glycine max
  Peptide Sequence Number=SeqID_126698
atggaaaagcctactgtttggatggattttgccggtaagcccactgcaggtgaggtcgagctcagtcacgtgaccggagatatggtggcaggagttcttgaactgaagcaaggcaaagctgtcatgggggaaccaaagattgctgcttatgtaagagaaggtctatatgatgatgcaataaagttattctatgaaatggaaagcaaaggggttagtccagatgtttattccatgaatagtgtccttcatgcttgtgcttgtagcaactcattggataaaggcagagatgtacacaattacattagaaaggacaacatgaccttgcgctttcctgtgtctaatggtctcatggatatgtatgcaaaatgtggaagcatggaaaaagcttatttagtcttctctcaaattccagttaaggacattgtctcatggaataccatgattggagcttgtggaagcctagctgctctagagataggcagagggatacatgggcgcatattgagaaatgggtactcatcagagttgcatgtagccaatgcacttatcgatatgtatgtaaagtgcgggtcactagttcatgcacgattgctctttgatatgattcctgagaaggatttgatcacttggactgttatgattgctgggtatggaatgcatgggtttggaaatgaagcaatcgccactttccaaatgatgagaattgcaggtattaagcctgatgcaattaccttcccttccatctttatgcttgcagtcattctggattactcaataagggatctccttgcccgcactggaaatcttttgaaggcccacagcttcattgagacaatgccaattaaaccagatgctacaatttggggtgccttattttgtgggtgcaggatccatcatgatgtggagctagcagaaaaagtggcagagcatgtttttgagctagagccagacaacacaggatattataagttagctatggcttttggtatattaaattttccgtctgggaggactattagtgtcaccaagaatctacgagtatgtgatgattgtcacgagatggcaaagttcatgtccaagacaaccagaagggaaattatcgtgagaggttcaaatcggtttcaccatttcaaggatggtttctgttcttgcagagatttctggggatctctgattggagttgagaagcagtatgcttatatggaaaatagattatcggaatattgcaattggggaagacagagaggggaagctctcagtttgccttga

SEQ ID NO: 35014 - DNA, 1122 bp, Glycine max
  Peptide Sequence Number=SeqID_126699
atgtcagaagggtatgaaattcataacaatgaggaaacttcatcgggatgttcccagaaatgctcttcatttgacttgaatgaagaattagcttgcagtactgaagataacactgatacaaaagagtgctatgagctcacaacaaccaatgagaaagcaaaggatgagggcacttcagcgaatggaagtagcatatcatcaagagaaggaaatgagagaagaggaacaacggtaagacaatatgttagatcaaagatgcctaggcttcggtggactcctgagcttcatcattcatttgcgcatgctgttgaaagacttggtggtcaagagagagctacacccaagttggtgcttcaactgatgaatgtgcgaggactcagcattgctcatgtcaagagtcacttgcagatgtatcggagcaagaaacttgacgaggctgggcaagtactaagtcaaacgtacaggtcaaaccaggaagtagttcgtagacctctgatactccatcagtccataagtcctcaacaacatcttaagatgggaaatggtggaattattctagcaagtaatttcaacaaacatagtcatttcccaagtctcctgcagccctccttctccctatcacgttcacttacaaacgacaccgattcaaggcaccagcattggtacatcaatcatcaagcttttagaataccaatagcttcaggccaaattcaaccaaaggatacacgcggcagaattgcccccatgagaccaagccaattgcttgaagagaaaaggtggcctccgttagaaattttgaacaatcatcaatcgaagttccaaaagttaccttccattgattctcctaaaattgggtcacaagctattcaaccagctgaatggagtagttttatgaacaacacaagcatcatagattatctatcgaacaactccaatgaacctcgcaacaattccaacagcttaaagctagaatttggtcctccatttcggattaagaaagacgagcaacaatttcttgatttgcaactgggtttgagtcacacatgtacagttggaaccgatggcaagatggatcattatagagaaaccccagaaatcagcactaagctttcactttcttag

SEQ ID NO: 35015 - DNA, 765 bp, Glycine max
  Peptide Sequence Number=SeqID_126700
atgaagaatcccgtggccgagagtttcaccgacttctacgacaagtgggtttggaagctcgaggagatcctacaccagctcctcgaggtgtccaaacagagaactgaggtggtcaaaactgagcaagagctgcaggttttggtgtcaaaagtcacatcccatttgaaggaatactacactataaagtgggcatccgcacatgaagaggtgcttgtgttcttctcgccggcgtggttgagtcctctggagaatgcttatttgtggatcacagggtggaagccctccatggtgttcaagcttctggaaactctcaagaagcaagcgagtggtggtgattttgtgatgacggaggagcaggtgaggaagatcgaggagctgaggaagaggacgaggatggaggaggagaaggtggagagggagatggagaggcagcaggtggccatggctgaccgcaagatggtggagttggtcaagctcaccggcagagcaaggaacaacggtagtggtggtggtggtgatgcggtggatgcggtggtggaggtggccttaaaaggggttcttgcggggttggagagggtcatgaaggcttcggattgcgtgaggctcaagacactcaaaggggtgttggatgtgcttagtccaatgcagtgtgtcgatttcttggctgcaaatattgctatgcagctaagactcaggcaatgggggaagaagaagagggacattgctgctgcaggatccacactcaatgtgaatcaggacaactga

SEQ ID NO: 35016 - DNA, 502 bp, Glycine max
  Peptide Sequence Number=SeqID_126701
atggacgaagaagcagagtcagtgccccatccacaatctccgaaactagggtttcccctcccctcctccgccgccgctgacggaaacctcatcacaggcctcagcaccatcatggccgcatcgattcaggacgccaagaaccgcatctcgcagatcgagcgtgcgaagcgaaacgccgcgttttcgaagctcgagagctgcgagggcgagaaggcgacgctgctggcgagaattgacgagttggacgagaaattgagattgaagacgcgggagattgaggaggcggacgggaagctactcgagcgcgtggaggcgctgacgtgcgagttaagggatgagaaattgaagaggaatcgcgtgacggaggcgtataagaggcttaagtctcagcacgtttaccttcggagaaaggttggtctcggtgaagagaatgtggttcaggaaaacaaattggagtgtgcaagtgaattggagatgcttcagagtccaatcgtaaaacctg

SEQ ID NO: 35017 - DNA, 612 bp, Glycine max
  Peptide Sequence Number=SeqID_126702
atgtgcaacgatatgatcatatgtgcatgcggcgcctcacatttgtgcataattaagctggaagttacaaagtctctgtctccacctctcacttcgattcgtttcaatatgaaaaaagctacgcttgatctcggagcttctaccgaaggagcgggagggccaagcaatgccggcgccagtgctggtgcagtgtgcttcttactcttcttcgtcttcttctttgacttgggagcgggaacctcagcgctgggtggtaccacaggtgccggagttgtcggctccagtgcagggggagagctcaccggaacaggcgttggtggagaactcatcggaactggcgttggcggtgagctcacaggtgtcacagtaggaggtgtagtcgtaggaggagtggccgcgagaggtgtggccaccggaggagtggttgttggagctggagcagcaactttagacggaggagatgctgccatgggagatgaaatggcgggaggggttgcagttggagcattgggagatgaagctggtggatatgaagtgagagaagtaacaggcgcagttgattttggtttagaagaggctatggttggggatgctatcaacacttttttttaa

SEQ ID NO: 35018 - DNA, 285 bp, Glycine max
  Peptide Sequence Number=SeqID_126703
atggataatttgttgatgcaatacaaggaagtcattgaatctactcaaccaacatttaaaagtctagaaattcaagttgggaagctagcaaaagaagtgactaaatttatggccaaaagagaagaaaactttgtagaggttgaagctcatgaggaaagccttgtaaaagagcatgactcaaaagaaaaagatgaagagaaaaaatacatgactttcatggcgtctctagctaagaggcgaaaatgtaaggaagatgtgttctacgtgaccttaatgccaccttga

SEQ ID NO: 35019 - DNA, 510 bp, Glycine max
  Peptide Sequence Number=SeqID_126704
atggcaaaaactacaatcatcatccttgcctccaccctttgcttcttatccttcctaggctccgcttatgcccgagaccgcttcatggtggagggcaccgtttactgtgacacgtgtcgcgtccaattcctcaccaagttgtctgagttccttgaaggagctaccgtgcgtgtggtgtgttcacaagttgataatgcgaagaacgtgacattcagcaaagaggcagtgacagatgcatcagggtcatacaaagtggaggtggacggagaccacgaagaagacacgtgtgaggttaccctcttgaagagtccaagagcagactgctccgaggttgatcaagagtctcaccttcagcaagctgcaaggatcagcatcaccaaaaacaatggaattgtgtccccaattcgccaggccaaccctcttggtttcctcaagaaggatcgtctccctggctgcttggacctcctcaaggagcttggaatcaatgaagatggcaccctcatcgcttga

SEQ ID NO: 35020 - DNA, 315 bp, Glycine max
  Peptide Sequence Number=SeqID_126705
atgaatagcgtaatgaaaccaagtcactatataaatacccttttggtaccaagaaatggtgaaattccagttgatgtggactgtctggctgcccaaggaatatttgacgtgattagtgatttaacacgggatcatattcatgatggatatgagtattcttattttcgtacaggatccatgatagttgttgactccctaagagatcctaaagtaggtataatttatgacccgaggtcactgataagatctctagttgacttaatagacagatacatgaagtcgcaagttaatggcttaattgataccagacgttaa

SEQ ID NO: 35021 - DNA, 1098 bp, Glycine max
  Peptide Sequence Number=SeqID_126706
atggttgcttttgtggcagtttcttcttcagcaagcttgttggtggcatgcccatacagatccatgttcagcttcggtgattcacttgcagacactggcaacttgtatctcagttcccacccacccaccgaccactgctttttccctccctacggtcaaaccttctttcaccatgtctctggacgctgctctgatggccgcctcatcatcgatttcatcgctgagtcactgggacttccactggtgaaaccgtattttggtggatggaatgtggaagagggagccaattttgctgttattggagccactgcgttagactacagtttctttcaagacaggggcatttccattccaaccaattattctttaacaattcaattgaactggttcaaggaattgcttactgctctctgcaattcatccacaaattgccatgaaattgttgagaactcattatttcttatgggtgaaatcggaggaaacgatttcaattatcttttctttcaacaaaagagcatagcagagattaaatcatatgtgccatatgtgatcaatgcaatagcttcagctatcaatgaattgattggtctaggcgctcgcacgctcatggttcctgggaatttaccaataggatgtagtgtaatttatttaacgatttatgaaaccatagataaaacccagtatgaccaatttgggtgtttgaagtggttaaacgagtttggtgaatattacaaccataaactacaaagtgaattagataagcttcgagtatttcatcctcgtgctaatatcatttatgcagattattacaatgctgcattgcctttatatcgtgatcccacaaagtttggttttactgatcttaaaatctgttgtggaatgggaggaccatacaatttcaataaattaacaaattgtggcaatccaagcgtgattgcttgtgatgatccttctaagcatattggatgggatggtgttcatttaactgaggctgcatatagatttattgccaaaggtttaataaaaggaccatattctctccctcaatttagtaccctgtgtttcaggaatgtaagctttggctatttcaatagctaa

SEQ ID NO: 35022 - DNA, 153 bp, Glycine max
  Peptide Sequence Number=SeqID_126707
atgtattttgccatccctagaggtggagttggtggcgcgatggttgttggggttggatggaggtggtggtgcgttggttgttggagttgggtggaggtgacgactagggttgtgcaggagtactggaagcaaaaaggagagtacgtgaagtaa

SEQ ID NO: 35023 - DNA, 792 bp, Glycine max
  Peptide Sequence Number=SeqID_126708
atggaagggttgggaagggagagaatgagcaaagagttttgggggcagaatgcagtgatcgagatgctgggaaagacgaggaaggtttcggcgcgtggcgaatccgtggcggcgaactacgccttcggtccctccgaagatgacgtaatcatcaagcacaggcttctcacgcgcaccaccaccaccaggggcgaccctcccttgaagaagcttcagaagaagttcacctcgttcgtctccgaagtggacaaggacgaagacaacaactacaacgaatgcgacaagctcgccagagcctttctgcaggagctgacgacattcgagattcctcttctgaagagcaaggcgattgtggaggccaacattagggagaaggagaatttcaacgagttgaaggaggaaatgaatcgccagatcctgcaggcgcaggatgacattgaggatctcaagaagcagcttgaggagagcaaggttgagagaaggcacaaggaggagtgcgaggctattaggaagttgattgccatgcagcccccgaggtccgagactatgaaggttatttcagagttggagaacgaaattgccgctttggacgccgagaacacggctggttcgaggttgttggagctcaggaagaagcaatttgcgctgttgttacatgtggttttaagtgggaaaggttggcctgacactaattttggatcagtagtgactggatttggaatggatggctggggaaagacaaatgagttacttgtggaaacggacagctggcaacatggagtggagaagtaa

SEQ ID NO: 35024 - DNA, 606 bp, Glycine max
  Peptide Sequence Number=SeqID_126709
atgtcgcagttctggaagccagggacggagaggcctcagggtcgcgtggtggacgatgaagaaggcggtgttctcttcttgtccggctctcaccattcctcttcttcttctcgatacggctacgccagcatcgataagcagcgccagcgtttgcctgtgttcaagtaccgcaccgccattctctacctcgtcgagactcgcgccaccactatcatcgtcggcgaaaccggaagtggcaaaaccactcaaattcctcagtacctgaaggaagcaggttgggccgctggtggcagactcattgcttgcactcaacctaggcgacttgccgttcaggctgttgcttccagagttgccgaagaaatgggagtaaaactcggtgaagaggttggctacaccattaggtttgaagatgttaccaaaccggatgtaactgtgctaaagttcttaactgatggagtgctgctaagggaaatgatggacgatcctcttttgaccaaatacagaaattgtgagttagatgtcaaagtgcctggacgagcatttgagcatgaactagagaaactgcggcagttgtattttattttatcgacaaatttcaattgttag

SEQ ID NO: 35025 - DNA, 2820 bp, Glycine max
  Peptide Sequence Number=SeqID_126710
atgcatttcctttcaactattcctcaaacactagcaatgatttggctcttttatttactcatctctcttggtctcattagtggctaccaaaatgaagctacaaatgcaaataacaaagttatatctattggggctatcattgatgttaattctcgcattgggaaagaacagcaagtagccctggacattgctgctcaaagttacaatagcacttcaaggacctacaagttggctctctattttcggaactccaccaaggatcccctcagagccatcactcttgttgaagagatgatttataagcaaaaggtgcaagtgattatagggatgcacaaatggtcagaagcagctctagtggctgaaataggaagccaagctcaagttcctatcatagcatttgcagaacctacaattaccccaccattgatgacagagcgatggccttttttggtgagactggctaacagtagtacaacatatatcaaatgtattgcagatatagtgcaaacttataattggcagagagtagttgccatctatgaagatgatgcatatggtggagattatggtatgctagcactgctatctgaggccctccaggatgtaggttcaatgattgaataccacttagttcttccacctatttcttctctacatgatccaggcgggcttgtacgtgaagagttgcttaagttgtggcaaacacaatctcgtgtgttcattgtgctgcaatcttcatttgaaatggcgattcatttgtttaaagaagcctcaaaaatgggactcgtggacaaagaatcagtttggatacacccagagagcataactaatttgctggactctgtcaacaagtcttctatttcctatatggaaggagctttaggaatcaagacctactactccgaaaacagcactgagtaccaagattttgaggctcaattccggaaaaaattttggcctaagaatgctgaggaagataatcgctacccaggattttatgctttgcaagcatatgacagcattaaaattgtgactcaagcagtagacagaatggccggtagaaacactagcagcccaaagaatttactaagagaaatactgtctagcaactttcttggtttaagtggtcaaattcaatttgaagatggacaactcctgcagaatcctattttgaggatagtaaatgtggctgggaggagttacaaggaagtatgcttttggagtcaacaacatgggttcaccacaaacctccctataggacaaggtggatataatgttgcaggtaatacaaaatgtttcaatggtgtacgttggcccggggatctgaagcatgatccaaagggctggaaaatgcctactaaacaaaatccattgagaatcgcagtccgaaacagaacctcattttccaagtttgtcaactatgatcagaataaaaaaatatatagtggattctgcattgatatttttcagagtgtgctcccccttttggggtatgacttgccatatcaatattatcccattgatggaacctataatgatttggttcagcttgtttataacaagacttatgatgctgtcgttggggacatgaccatactagaggaaagaatgcagtacgtggattttacagtgccatatgcagaatcaggattgtcaatgatagttccatcaaagtcagaagagtcagcatggatgttcacaaagccctttacctgggaactgtggatggttacaggtgccattttgatttacacaatgttagcagtttggtaccttgagagagaatccaatcctgagtttcatggcaattggaagagccagatcagtacagctctttggtttaccttctcgtctctgttcttcgctcatagggaaaaaatgagttgcaacttaactcgtatggtgatggtctcatggctcttgctagttctgatccttacttcatgctacactgctagtctttcttcaatgctcacagttaaacaactgcaaccaaatgtcacagacattcagtggttgaagaggaacaacatgaaaattggttgtgatggtgactcatttgttcggtcgttcctggagaaagtagaaaattttaagcctgagaacatcataaatgttactgatgaatacaactacgatggtgcgtttaaaaataacagtatagcagctgcctttcttgaactcccatatgaaaaggtgttcataagtgaatgctgcaacagatacattggtttcactcccagaaccagatttggaggactgggctttatgttccagaaaggctcgccactggccagagacgtgtcaaaagctatattacatctctcagaaaaaaaagcagagctgaagagattggaagagaagtggttgattacctcaccggcatcatgctccaacgtgacctccgatgatacggacagtttgaagctgagaagtttatggattctatatgtcatctcaggtgccacttccaccatttgtgtgctactatcagccatccagtctctagtaaaatcctgtcaccaatgtcaagcagtggcaccagaaggcaatgacacaccaagtgatcataaagtgtgggaaaaggtgattacacatgcaaaacagatttttaacaaaaagatcaataattcaagtgaggcacaggaacaggttgtgactgattgttctttgagatgggatcgcgtgaacatgactgtttcccctgagcatcagcaggaaatggcttctccgctacccggaattttaatgctaccttctccacccccagaggttcagatgacaactcatgatttaggaatcaccaacacttcaaagtag

SEQ ID NO: 35026 - DNA, 1599 bp, Glycine max
  Peptide Sequence Number=SeqID_126711
atggaaaccccaacgagattctcaagttgccgaggcgtggcctttgaggtgaaacctcacgctgatccctttgcaatagtaactacacccacatcccaaagcctctcaaacagcaaacgaatttggcctttagacacttccagagtcttcccttcttcatcacaaagatccttcagcagtgtcagtagccatttctgtgacctcgacgacgacgatgaagaagaagatgctcctgaaagcatctttgaaaaaacctacgatgtagagaaacaaaaccaacttgccgctgtgcacaataatggtattgttggtagcactagcaagtctgagcaaccctcaaagccttcaagaaaaaacgaatcaagactctcagtcatacttctagatcaaggcttgttcactgtgtacaagcgacttttcatgctttgcttaacctttaacgttactggcttggttcttgcagccacagggaattttccctatgcaaggaatagagctgctctattctctattgggaacatactcgccttaactctctgtcgaagtgaggccttcttgcgtcttgtcttttggcttgcggtgaagacccttggaaggtcctgggtgcctctcttcctcaaaacagccaccacttctcttttacaaagcttgggaggcatacacagtggttgtggcgtgtcttcgattgcatggctggtgtatgcattagtcctcactcttaaagatagagacaacacttcaccagagattattggtgtttcctctgccattcttggccttctttgtctctcttctttggctgcattcccgcttgttcgccatctccatcacaatgtgtttgagaggacacatcgttttgctggatggatggccttgtgtctcctttgggctttcatcatgcttactatttcttatgaccctaaatccaaatcctactcaaaagaactcggatcaaggttggttagaagccaagagtattggttcacagtgactataaccgtgcaaataatcttgccatggttgactgtgagacgtgttgctgtgaaagtgtcaagtgcttctggccatgcttcaatgataaagttagagggagggataaaggcagggatacttggtaggattagcccctctccactctctgagtggcatgcttttggcataatctcggatgggaagaaagagcacatgatgcttgcaggtgcagttggtgatttcaccaagtctttggtctcaaacccaccaagccatttgtgggttcgccaagtgcactttgcgggactcccttatttggtgaacatgtatgatagggtcttgttggtggccactgggtcgggaatttgcgtgtttctttcgttccttttgcagccatctaaagcggatgtttatctgctttgggtggcaaagggtgttgagcaaaactttggtgaggaaattaaggaaatgggtaggccaaacgtgtctcaattgagtgttactgctgcaaagaaatggaatgttgaagtggtaattgtcacaagtaatccagaagggagcagagatgttgtcaattcatgcaaagcagatggaattccagcctttggtcccatttgggattcctag

SEQ ID NO: 35027 - DNA, 183 bp, Glycine max
  Peptide Sequence Number=SeqID_126712
atgttcattgttgtggtggttgattcgtcaacggcgacatatgaggaaatggcagaaaagctacagaaggaaatgaaagggagtggtttgcgtctcaaaggcatgacaaggggtttgattagagctgtcaaggagatggacaaggaggttgtcgaggctgagagtattgttgtagtggtgtaa

SEQ ID NO: 35028 - DNA, 651 bp, Glycine max
  Peptide Sequence Number=SeqID_126713
atgaatcgccttcttcttgttcgtcatcctctgctagctctatccaagccaccattatcacccttttcccaaacctattattattcatacacgccggcacgaataaattctgaattatataagattaaggacccacctggagtctcttctgttcacacaagctctacattttgcactaccaacaaagacttatcaactgagaactgtgtaccgtgcaatacaaaggacttgcagcccatgaccgaggatgcagcacgcacaatgcttcaacagtggaatttggttaatgaggatggtgtgttgaaattgaggagatcatggaaagtaaagacttttaccaaaggattggaatttttcaggataatagctggtcttgctgaagctgaaggtcatcatcctgatcttcaccttgttggctggaataatgttactatagagatttggacgcattctgtggagactcagagcaattacatttgtgaattgcatcaaagagctaatatggctatttcaaatcccctgcctaccccaatggttcctggactgaagctatcagctttgggtgggctgacacagaatgacttcattctagctgctaagatcaatgagcttaatttgcatgacttgctaagacggaagacttctaactga

SEQ ID NO: 35029 - DNA, 798 bp, Glycine max
  Peptide Sequence Number=SeqID_126714
atgaaagtatctagtattgctaatttctctgtcatctcttctcagaatgatgacatgcctattggttggccatttgggcttggcttcttgaacatgatgagacttagagttggggaatccctcccagcagcttcaatggccccttaccaattgcacgtgccatccaccagtttctcttcattttcatcctctaaccttgatactgagtcaacagcatcgttcttccaagacaacagtgtatcccttgcacagctaattggaattagaccaggtgacagaggacgcttgtacttcccaaactcactgaggtttgaagaaaggaagaagaaattagcgaagagttccggttctgatggctctaaagtacaaggaatggatatgtctcgacccaatgaagaagcacttgatgttactaggcccaaggaagtccaatgtagcagcaatccaaaaagagaatccaagcccatcgcgcttgagcgaaagtgtttgctgcgctccgccgtctcccgagctgccggtgcggcaaatctggctgccggagctagaacgaagcctgcacgatctccgtttcggctcccaaagcaaacctcaatctccaatcgcgttttcaggttaccggtggaagcgagtttctgcgtggaatcgatgcttccttatcacagtgctactgcttctgcattgctgaattcgatgctctctgtgtctcgccactcctacggttggacccctgaaggtattccctcccttttctctttacttccattttctgaaatgagacatgattcatacaagagctaa

SEQ ID NO: 35030 - DNA, 1041 bp, Glycine max
  Peptide Sequence Number=SeqID_126715
atgaggggtgacaaggctttgtcacacagtgtaagagaccggttgattgaacgctggcatgatactcatgtttacgtcaagagaacaaaacctaagcgcctctacttcctttcgcttgagtttcttatgggtcgttccttgtcaaatagtgtcatcaatcttggcatccaggatcaatatgcagaagccctaagccaacttggatttgagtttgaagttgtggcagagcagatttattatctcagagtgagccttcaatggtgttatttttatccccttaatatacatgtatgtgacatccatgacaaggaaggagatgccgccttaggaaatggtggccttgctcgtctatcagcatgccaaatggattctttagcaactttggattatcctgcatggggttatgggctgcgatatgaatatgggctgtttcgtcagatcatagtggatggctttcaacatgagcaacctgattattggctgaactatggaaacccttgggagatagaacggattcatgtaacatatgaagtgaagttctatgggactgttgaagaggttgagatgaatggagaaaaacatcaagtttgggtccctggagagacggtagaagctgtggcttatgacaacccaatacctggttacgggacaagaaataccatcaaccttcgactatgggcggctaaacctagtaataaatttgatttggaggcctataacactggagactacattaattctgttgtcaacagacaaagggcagaaactataagtaatgttttgtaccctgatgaccgtaatcatcaggggaaggagctgagattgaaacaacaatatttctttgtctcagcatcgttacaagacatcatccgaagtgattctgttccattaggatttatggagttttcaggttatcccaggctagacatgggttattctgagtttttagggagagagaaaagaaaaatggagaaagaatgctttggcagtgtccagtgtttacagaattatgaagaatctaaggagaggattctcttttga

SEQ ID NO: 35031 - DNA, 1554 bp, Glycine max
  Peptide Sequence Number=SeqID_126716
atggaagagttgaagaaaaagattggtttagattacaaccggctgtcccggatgtcaattgttgaagaaggtgctgtgaagatgccaatttaccatgtatttccatggatcagtggtggcttcaataccacagcaggttccctcagttcagcatgctgtagaactgggctcaaacacattgagcttggacctgagatgcaaaaatctactagtaggagggagaggcttggtgagagtcagcccgttgatcctgaacagggatgtgcagaattgacagttagcattcgaatggccaacttgtcaattgttggctcccatgctgtgaatggtgtttcaaaattacatttagatacactgaaaatgaatacatttaaggacttctatgagctatggcctgaaaaatttcaatacaagacaaatggtgtaacccagcgtcggtggattgttgtgagcaatcccagtttatgtgctcttatatcaaaatggctaggaactgaggcttggattcgtaatgccgaccttctgacaggattgagagatcttgttgacaatactgatttccatcaagaatggaaaatggttaaaaaggtcaataaaatgaggcttgctgaatacatcgaaacaatgagtggtgtgaaggtcagtttggatgctatgtttgatgttcaggtgaagcgtatacatgaatacaaaagacaattgcttaatatacttggaataatccatagatatgattgtatcaagaatatggacaagaatgacaggaggaaagttgtaccccgtgtttgcataattggtgggaaagcagctcctggttatgaaattgctaagaagattatcaaactttctcatgctgtggcagaaaaaatcaataatgacactgatattggagatcttctgaaattggcaagttttaagtcacaactgttcatttgtgtttttatccctgattataatgtctctgttgctgaattggtaataccaggggctgacctttctcaacatttaagcagaggtggagcagggggttgtgctgggtatgagttgaatatgagcccacttggcactgcaggacatgaagcttcaggaactgggagcatgaaatttatgatgaatggatgtttacttttagctacggcagatggatctacgatagaaataattgaagaaataggatcggataacttgtttctctttggtgcaaaagtgcaggaagttgcagaactgcgtgaaaaaggatctactttaaaagtacctctacaatttgctcgcgtgttaaggatggttcgagatggatattttggtcataaagactacttcgaatccttatgtgacacggtggaaattggtaatgatttctatctgcttggccctgattttggcagttaccttgaggcacaggctgctgccgataaagcatttgttgaaccagagaagtggatcaagatgagtatccttagtgttgctggctctgggagatttagcagtgacagaaccattcaagattatgcagagaggacatggaaaattgatccctgccgatgccctctctga

SEQ ID NO: 35032 - DNA, 1566 bp, Glycine max
  Peptide Sequence Number=SeqID_126717
atggctaatgtttcagagacaactttagagaacacaccaacatgggctgtggcaacagtttgcttcataatgatagttatctccatttttattgagcatttgctccatatattggccaggtatttcaaaaggaaaaggaggaaatccctcactgaggctcttgaaaagattaaaacagaattgatgcttttgggtttcacatctctgctgctaacggtgagcgaaaaatcaattgcaaatatttgcattccaaagggtgtaggtgaaactcttattccctgcgcaagcatagcttttgacgatgctgaggaagaaacaaaatgtgcagagcagggaaaagtatcattgttgtcgagggaaggtgtcagagagctgcaatacttcatctttcatctggctgtgtgccatgttgtttcctgcattctcacctttggtcttggaatggcgaagatgaggcgttgggagtcttgggaaggagaaactaaaacattggaatatcagtttgcatatggaaacttcattaatttcattacttgctttggaagtgtagatccacggaggtttcagctcactcgtcagacaccatttggaaagcggcatcttaactattggagtaacaattctgtaatgtattggcctgtctgtcttgttagacaattttatagatctgtccccaaggttgattacttcactcttagacatggattcatcatggcccatttttcagaagaaagtaactttgatttccaaaaatatatagaacgggctctggagaatgattttggagttgtcgtgggattaagctggtggatttggatcttctctgtactttacatattcttcaatgcaaatgcattctacagccatttctggctgccttttattccgctaatggtgcttttattggtgggaacaaagctacaaagcataataacagatatgtgtttggatagtcatgacaaatcccatatgatcaaaggaactttgcttgtgaggcccagtgaccactttttctggtttggatggcccaagctgctgcttcatctcattagcttcatattgtttcagaattcctttcaactagcatttttcacatggacttcgatccgattcggcatcagatcatgctttcatgaagaaattgagaatatcatcataagggtagctatggttgtttcagtacaaattctttgtggctatgtaacactaccactttatgctttggtaactcagatgggtacctcgatgagaaaagttgtgtttacagagaatgtgattagaggaatccaaatttggcaggataaggccaagaagaatatggctcttaggaatccatattcacaaggcacaagcttagacacttcgctttcacttgaaacttcactagaggcttcgccttctttcaggcttggtgcatcgctctccaattttatggatcgtccattagatgttaataagcacatgaatgttaatattacacaaggagaaatagtgagtgaacaacaagaatccgagaatcaggcatcaaatctaagttcatttcaaggatttaacctgcaactttga

SEQ ID NO: 35033 - DNA, 2169 bp, Glycine max
  Peptide Sequence Number=SeqID_126718
atggttctgtcggatgccgttaattttgctcggaatttcgcagttatggtcagagttcgtggccctgacccaaaagggttgaagatgagaaatcacgcttttcatcaataccgtatgtgtagttctggtgaaacaaccctttcagcttcgggggtacttgtacctgatactctttgtgattctcaagtagctacgcgtcttaatggtgataactgtgaggatagggtattggttgtaacggttgcttcagttgttgagccttttctgtcacctcaacagagagacaatattcctcagggtaggccagacttgattgccggtgttcagattgatgttatgaccgaggaaaccaatgaaaaatccaatcggggaactccttgttggcttttggcacagcttttgtcattagtaggcattttgaaccttttagatccttattatgctgttgatattcctgcttcatcgaattgtctccagtcacttattgaagcgtctttgggcttgccagagcatgaatgggaggacttgctggatagtaaagtatctgccatgaataaaagaggtgattttcttctggcagttggatctccttttggagtcctgtcacctatgcacttttttaacagcatctctgtaggatgcattgcaaactgctatcctcctcattcatctgatggatcgttgctgatggctgacatacgctgtcttcctggaatggaaggcagtccagttttcagtgagcatgcatgtcttattggtgtcctgatcagaccattcagacagaaggcgtatggagcggaaatccagctggtgattccatgggatgccattgtgactgcttctagtggcttgctgcacaagaggcctcagaacacacagaaaggtttatgtaatcaggagggcaacctttatgctgcaggaagtgtacctttttctgacactgacaaattagatgtttgctctaggaataaacacgagcatttatattttggtagctcgtcaccattaccaattgagaaggcaatgacttctgtctgtcttgttactattggtgatggagtatgggcatctggtgttttactaaatagtcaaggtctcatacttacaaatgctcatctgttggaaccatggagattcgggaaagaacatgtaaatggaggaggatatggaactaattcagaaaagatttcttccatgttggagggaactgcatatgttgttaacagagttgagagcaatcaagttagtcaaacttcaccgttgaagatgccaattctttatcctttcgctgcgaatgagcaggggggatataagtcgagtccaacttatgacaaccatagaaacatacgtgtacgtcttgatcatatcaaatcttgggtttggtgtgatgcaaaagtagtgtatgtttgtaaaggaccatgggatgttgccttactgcagcttgaatctgttccagatgatcttttgcctataacaatgaatttttctaggccatccacaggatcacaggcatttgtcattggccatggattatttggcccaaagcacggattcttcccatctgtttgctctggtgtggtagcaaaagtggttgaggcaaagactcctcaatcttatctgtccgttcagccagaacatctccacaaccatgagcacttcccagcaatgcttgaaacaacagctgctattcatcctggtgctagtggtggtgctattatcaattcagatggtcacatgattggcctggttacaagcatgatgctgtcttttcttgatcctaatttactcataggagctcagcctgctctgtctggtccaattgtttatctcaatgcaaggcatagtggaggagcaataatacctcaacttaattttagcattccatctgctgctttggcacccatcgtcaacttctcaaaagccatggaggatttatcacttctacggattctagacgaaccgaacgaatacctttcatctgtatgggcattgatgcggccatcatatcctaatccccatcctatgcatgatccacctcagtcggttacagacaataaaagtaaagagaagggttctcggtttgctaagtttattgctgaaagaaaggacattttcaatgctggaaagagtggagtgatttctaaggaagttattgctagtaagttatga

SEQ ID NO: 35034 - DNA, 171 bp, Glycine max
  Peptide Sequence Number=SeqID_126719
atgaagcagaaagtgaaagctttgagagagaggaacatggaagcggagaagggaagaagcaagaagagttggaccacttgctggggtttcagttgtgaaacagacaaagtaaaaagtttactctactcacttgctattgctcacctacgtaaatcgttttcagagaaataa

SEQ ID NO: 35035 - DNA, 1884 bp, Glycine max
  Peptide Sequence Number=SeqID_126720
atggagctagaagatacagaactaaagaccatgttggaatcctatagtcaaatggatttagccagaagaggtcctttccgagctatacaagtagtttctgttctcatattttccctaacgaatctgattgataaacttggaaaagatgaatcagaaaacaaaaatgatggacagttaatgcaactggcattaactgctgcattcagcttgatgggacgtttcattgaaagatgcctaaaggctagttctttgatacattgccccttgttgccctcagtgctagtttttgtggagtggtgttcaagcatacatgaagatgacaaaaaggaaaccgagaagcatcttgatagaactcctctttgggaggattatgagttaaggggctttgtacctatagcttgttcatatctctcattggatttttgcggtaattgggaacacatagacaactttgaaagtggaattgaattgcgtactgagcgcatccgagaagcagcaatcaagatagcaagcagttcaaataattggcagaagtggattacatgtgataaattaggaaacaaattttatctggctagatcagatcaagatcatgacaagaaagaaacaaaaaatgtggagtccaacagccatagtacaaaattggaagagcctaatcagcaaaccaacaaagacacgggagaacagggtaaatggatggtaaaggataatctaagtagctccagcaccaatggaaaatcttctgtagtggaagaagaggaagttattctcttcagacctctcacaaggtacaattcagctccatcacactgctctatctctactgatgacaagatgacaccaaaagacaaggacaaccagagcttactgtccgatgattgtttgcaccgtgctagttctctacttatggcacaaaacccagctcaaactcaaagtgatccatgggaattcagcattttggatttcaggagtgacaaatcattcaaacagcaagaatcttcaacaagggaatcaaatgcacatactttctccgaagccccaatctctgctggccctccttctctcaatgcttgggtccttgatagaggaagcttgagccacaacagaaacaatgggacaaatggccttagtgagcacaggttgcagcccattgaggaaatagcttcttcatccttggccagtatttccatcaataaagctgagaattcagtcacaagctcaatggttgagtcttcaaacttccattactcctcttctgctacatattcccttccagtaccttctgctccattacttcctgataatgctgcatggtttactgatgcacaatctagtttatcttctccattatttcctgacaactcagtaccaaaaagtggttatccagattggagttctacttatggaccacatggatatgatcctagatttcctgttctatcaagtggatacacaccacctggcagaatgacttcttcggaatggctgcgttggtacagagaaaattacaaacctgaaaggactaacaattacatgcagcccactcatttgaatagtcctggtcctggtaatcatgtgaacgttccctatcatgatacttacaggtttggtcaatttgatagatggagcaaccctttgccatctaaccagtacacatatatggagtccccagggcccccaccattgcagccaggttttttgtctgcttttggtgagcacaaaggaagtgtctacaacaattttcaaagaccaaccccttatgcgtgtggtgtagtgacagacccgaggaatgagccacagtctctattagagtgtctgaaggagaaggaatggcgactccagccggatcctaatgtcagagggcctacattcatgggaaattag

SEQ ID NO: 35036 - DNA, 319 bp, Glycine max
  Peptide Sequence Number=SeqID_126721
atgggagttgctacgtgcacccagcattattgctggggcacccagcaaacagtgaagtggcgaaactgcccttcagcaattattcttccggaagaagaacgtcatccggaatgtttccggaagaagcttcttccggaagaattccagtgtcttccggaagaagcttcttccggaagtcttccggaagaagcttcttccggaagctgtgttgtgttttactgcgctttctttctttcttcttccgtttgctttgtttcttcttccgtttgctttgtttcttcttccgtttgctgttgtttcggtggtggtcccttcagca

SEQ ID NO: 35037 - DNA, 2701 bp, Glycine max
  Peptide Sequence Number=SeqID_126722
atggctatggtaaaagaaattatgggacaacgtatggtggaagcattttgttctgatgtttcaagatgttcttcacaacctaaccgtttctgcattaagaggcagaaaacagtttccatacttcccactttctcggagctgaagacgatgttgcaactacctgccccatattcgcaaccaccatttatcaaattagatgagtcttccaagagagaccttgccttgaatccgatgagtgtgaccataacgggaactataaccatcaagaatagtgatattactgatcataaggagatgatggccatgatgcttcaacactttggtactttcaaaaatgctcttcatgaaagaggaataattgtgttgcagctagttagcaccgaaattgacccgagaacgatggagccaaaactgagcaacccagttgaattggagtggttgaaatgctataaggtgggggctgagaggtccacatacaaagtagaatttgagatagattcagattttgggttcccggtagctattactgtgacaaacaaatacgacaaagagatctttttggaaggcttttccattgaaggtgttgtggatattgcctgcaattcttggattcaacctgagaaggttcatccagaggagagagttttctttagcaacaaggcatacttaccatgtcatacaccagcgggtctgaaaaagctaagaaaagaggaactgaagcagcttagaggtaatggaaaaggagtgagaaggggatgtgaaagagtgtatgactatgatgtctacaatgacttgggaaatccagacaaaggacaagaacatgtgaggccaatattagggaccagagactacccatgtcccagacgctgcagaaccggtcgtcctcatgccacaaccgacgagaagtatgagtcccctataaattcatccgtggaaagttatgtgccaagagatgaagcttttgaaggtgtgagaaaggaagctcttgatgtggaaaagttaaaaggggcaacccggaatttgattcccttcataagaacttgtatcaccaagtgtggaaatttcaagcagctttcagatgttcaacagatatacaagagaaagcacgttgataaaatgaaacccgagaacgtaaccacaacaaaatggcctctacctatgaatatgatgagcaagatccaaaatgacgtggaagagtattttaaattcgatactccgcgtattatcaatggtgggaattgttgttgcataaaagatgaagaacttgggcgtcaagcattggccggtatcaaccctctaagcataaaaagacttgagactttcccacccgtcagtgatctggatccttccatatacggtgcccaaaagtctgccctaaaagaagaacacataataagccatttggatggaatgcctgtacaacaggcaatggcagaaaagaagctattcatgttggattatcatgatgcctatctcccatttctgaatggcatcaatgctcgtgaagataggaaagcttatgcaactcgcaccatcttgtatttgacaagactaggtactttgaagcctattgccatcgagttgagtcttccagaatcgaaacaggtccttacccctccattggatgccacctctcattggttgtggcaaattgccaaagcccatgtttgctccaatgacgctggtgttcaccaacttgtccatcattggttgagaacccacgcatgcatggagccattcatcatagctgctcatcgccaactaagtgcaatgcacccggttttcaaacttctaaagcctcatttgaaacacacgttgcaaataaatgcattggctcgtgaggctctcatcaacgaaggaggcatcattgagactgatttttcttctggcaaatacagcactgagattatctcagctgcttataaagattggtggcgttttgacatggaagcccttcctgctgatctcattagaaggggactagcagaacctgatccaacacatccccatggactaagactactgattgaagactacccttatgcaaatgatggacttcttatatggtttgctttggagaacttggttaggacttatgtgaactactattacagtgataggatcatggttcgatctgatagtgagcttcaatcatggtatagtgaggtcaccaatgttggccacgctgatcatgcaaatgcaagttggtggcccacactctccactcctagtgatcttacttcaatactcaccacactcatatgggttgcttcagttcagcattcagctgtgaattttgggcaataccctcttggtgggtatgtcccaatgcgttccccacacatgaagaagttgttgcccaaagaggatgatttagagtacaaagaatttttggaggacccagaaggatacttgctgtcttgcttgccaaatatgtttgaaaccaccaagtttctagcagtggttaacatactttctcagcattcgcctgatgaagagtacatggggcagaggaaggacttgtcagattggactggcgaccctgaaatcataaaggcattctatgagttttccatggatataaagagaatagaaaaggagattgacaagagaaataaagacacaacacgtagaaatagatgtggtgctggaattccaccatatgagttgctcgtagcctcctcggctcctggagttacag

SEQ ID NO: 35038 - DNA, 3561 bp, Glycine max
  Peptide Sequence Number=SeqID_126723
atggagatgtctatgcaactaaactgcaaaacggtgtttccctacagaggcggttacatatgttcaccgtgcaaagcaggttggggtgtttcgttcgtccgtgccagtgcagatttttctcggaagaggcaacagaagaaggtgtcagttgcaaggactaagggcacttctggaaagggttttgtcccaagcaaaaagaatacaagaatgaagaagggagacacgttaacttcagtagtcagtgaggtttcagggggtgataaaaagcaaacagttgaagtcaatgtagatgatactgataaagaaggggaacttgaattctcccaagaggagaaatttgaggctgtagatagaattgatgaaaatgttggggatgtgggggatttatcattgttagatgagacagtgggggagttatcgttgttagatgagagcaatcaggctaccatttctgtatttgatgaggatgtcgaggttcttgagtcatggaaggaggagtttccttacaatggaggtgttgggattgttgaagattcttcggaagaagggttgttagagagtgcagaaattgatgaaaatgttaaagatacagatactgatggtgatattactgaggaagctgttgaggaatcaagcagtgctgatgatgatagaataaacgaggaagctgctgggctgttgaagttagagttggaagcaaatcagcgcaggcaggagatagagaggattgcagaggaaaaactttctcaagggattaagctgtttgtatatcctcctgtggttaaacctgatcaagatatagaactttttctcaacaagaacctttcaacactaagtgaagagccagacattctgatcatgggggcattcaatgattggaagtggaaatctttttccattaggttgaataagttgcatctcaagggcgattggtggtcttgccaattatatgtgccaaaagaagcctacaaggtagactttgtgttcttcaatggacaaaatgtctatgacaataatgaccaaaaagacttctgcatacccgttgatggaggaatggatgcattagcattcgaagatttcttgcttgaggagaaacgtaaagaattagaagaacttgctagggcgcaagctgaaagggaaagacaagctgaagagcaaaggcgaatagaggcagacagagctgcaaaggaagaggacagggcacgggcgaaggcagagattgggaaaatgcgagaaacattgccgcaattgttgaaaaatgctgtaaagtccgttgataacgtttggcatattgaacctagcgaatttaaaggcaaggacttgatcagattatattacaacagaagctcaggtcctcttgcaaatgctaatgaaatatggattcatggggggcacaataattggaagtatggattatcaatcgtcgaaaggcttgtcaagtctgttttaaaaggaggtgaatggtggtatgccgatgttgttgtacctgaccaagctcttgtcctggattgggtctttgctgatggtccacctaagaaggcagttgtctatgataacaatcgtaaacaagatttccatgccattgtccctggggctatacctgatgaacagtattgggttgaggaagagcagctgatatacagaaaatttcaggaggagaggaggttaagagaggatgcgatacgtgcaaaggctgaaaaaacagcacaaatgaaagctgaaacaaaggaaagaactttgaaaggatttttgctttctcaaaagcatattgtattcactgaccctctcgatgttcaagcagggagtacagtgacaatattttataacccgtccaacacaaatctgaatggaaaacctgaggtttggtttagatgttcatttaatcgttggtctcaccgtaatggtccattgccacctcagagaatgttacctgcagagaatggcactcatgtcaaagcctctttcaaggttccactggatgcatacatgatggactttgtattctctgagagtgaacatggtggagtttttgataacaaatttggaatggattatcacataccagtttttggaagtattgcaaaggaaccacctttgcatatcatccatattgctgtggagatggccccaattgcaaaaacttcttttattgccaaggctggcaaattgttggaaattagaattaagaatttttactatttgtcatgtgttgttcagaaaaaggttggaggccttggtgacgttgttactagtctatcccgggctgttcaggatttaaatcacaatgtggacatcattcttccaaagtatgactgcttgaaccttagcaatgtaaaggactttgactatcacaaaagctattcctggggaggcactgaaataaaagtatggcatggaaaagttgaaggcctctctgtctactttttggagcctcaaaatggattctttcaggttggctgtgtatatggtcgtgggaatgatggagagagatttggttttttttgtcatgctgctcttgagtttctactccaaaatggatttcatcctgatatcatccactgccatgattggtcaagtgctccggttgcatggctatttaaagacaactatgcacattatggtcttagtaaagcacgagttgtcttcacaattcataaccttgaatttggagcccattccattggaaaagctatggcatatgctgacaaagctacaactgtctctcccacatattcaagagagattgctggtaatcctgtaattgctcctcatcttcacaagttccatggtataataaatggaatcgacccagatatatgggacccatataatgataaattcattcccgtatcatactcttcagaaaatgttgttgaaggaaaaagagcttcgaaggaaaccttgcaacaaaggcttagtttaaaaaaagctgatcttcctttagtgggaattattactcgattgactcatcagaaaggaatccatctcatcaaacatgccatatggcgcaccctagaacgtggtggacaggttgtactacttggttcagctccagatcctcgtatccaaaatgattttgtgaatttggccaatgaattgcattccgctcatcatgatcgtgctagactttgccttgcatatgatgagcctctttcacacttggtaacttatgaaactgaaaaacctttgatatatgctggtgctgatttcattctagttccttcaatctttgagccatgtggactcactcaactcacagcaatgagatatggttcaatacctgttgttcggaaaactggaggactttacgatacagtattcgacgttgaccatgataaggatagagcccaagcgcaaggtcttgagccaaatggatttagttttgatggagctgatactggaggtgttgattatgctctcaatagggcaatatcagcatggtatgaaggccgtgattggtttaacagtttatgcaaaagggtgatggagcaagactggtcttggaaccggcctgctcttgactatttggagctttaccatgcagcacgcaaggcagaatga

SEQ ID NO: 35039 - DNA, 876 bp, Glycine max
  Peptide Sequence Number=SeqID_126724
atggagcaagattccacatttcaatctatgttctttgtggcttttgtttttcagcttgaatcttctatgccacatctcaatggttcaaaagaaatggccacagaatggagccctactctcaatgaagcatccaatgagttcatcatgatccatagcaggaagcttctcgaagacaaaaaattagtaggtgaccataactctgttgtctccactttgctagaagaactccttcaagctcaaagatccatcaataaactcaaagcagagcaaaagaccatccagaaaaacgttgaacattttttgcagaatctcaaagatgacaaaatctttttgaagagcaaggaacaccacaagattaaagcaacaataggtgaattaaagggtaagttggaaagggaaagaagaagtagagagaggatggagttacttaacaccaaattggtgcatgaactagctgaagccaacttattaaggaagcagtttatgacaaactgcgagaaagagaagaaagagagagaactaatggaggaaatgtgcgaagaactagccatgcaaataggagaagacaaggctaagcttacagtaatactaagtgagtccaagagaatttgcgaggaagtggaagaagagaggaacatgatgcaaatggctgaactttggcgcgaagaacgcgtgcaaatgaagcttgttgatgcacaatttgttcttgaagacaagtataaccggttggtgcaacttgctgcttctcttgaaaggttcttgatatcaaggggtgctgaacttgacactacggaactagaggatgctgagttgatcaaacaagaagttgaatcattgaatattcaacgtgttatggagctttcttttgatgtctaa

SEQ ID NO: 35040 - DNA, 135 bp, Glycine max
  Peptide Sequence Number=SeqID_126725
atgaataacacaatccatatatccaaaagaaacatctttcctgtgcccaaggttttaatttttttttctccttggcgtttacggtttcagagttctgcagaggaagaaggaagtgagacagattcagagcgctga

SEQ ID NO: 35041 - DNA, 219 bp, Glycine max
  Peptide Sequence Number=SeqID_126726
atggagctgaatttgagggggaaaagagaaatcggaatatcagagttcacaatggagaagagattaacgattgttttgaggaatggagaggagggttggtgggaaaatgtaaagttggaaacggttttcctaggtgaggaagagatgctagatttggacattatatataagacaaggatgacatgctttgtaacacctaaccgcgtagattttaactga

SEQ ID NO: 35042 - DNA, 114 bp, Glycine max
  Peptide Sequence Number=SeqID_126727
atggtggatgaactaagattcaaattttcgcaagagaagtgtccatattcagtatttggccatatttcactaagccagtgccttcagatgaggatacctgtattgaacccatga

SEQ ID NO: 35043 - DNA, 672 bp, Glycine max
  Peptide Sequence Number=SeqID_126728
atggcacctaccatacttccaactcagacatatggtcattctctttcatcatcatacccaagactacacccatatgatccccaagccatgtaccaactacgacaagaacccttgcaacaacaactaaccaacttctgggcaaaaaaacgccaggagattgaggagaccactagtttcaagactcatagcttgcctttggcaaggattaagaagattatgaagggtgaggagggtgtgaggatggtatcagctgaggcttctgtggtgtttgccaaggcctgtgaaatgttcatgatggagctcacaataagggcttcaggtagtgctgaggagaaccaaaggaagataattaagaagtgtgacgttgcatctgcaatctcaaggacagatgtgtttgattttctggttgatattgtctcagggcacaacaaaataatggagcaacaagggtttgtaggcataccaagaattggcactgctctaactccaacagagaatgttccttactatcagatgccccctcatcaatcgcttgttccgggccctccatatggttcttcaggaatggttgtgggaatgcctgttcattatcaaaatcatcctgggctgcaaactccaacaatggggcccacccccaatccacaaaactcttctcgtgattcggattcctga

SEQ ID NO: 35044 - DNA, 2271 bp, Glycine max
  Peptide Sequence Number=SeqID_126729
atgtcttcctctttctccatccatttcttcctcctcctctcaatagcccttttctcagtttgttgcttagcagcatctcaagctcccaccaccaaatcacacccctatatccttcccattaagaaagaccccgcaacaaatttgtactacacttcagttggcattggaactcctaggcacaactttgatttagtcattgatctttctggtgaaaacttatggtacgattgtgacactcattacaactcatcatcctacagacctatagcttgtggctcaaagcaatgccccgaaattggatgtgttggttgcaatggccccttcaaaccaggttgcacaaacaatacatgccctgctaatgtaatcaaccaattagccaaattcatttacagtggtggcttaggtgaggatttcatattcattcgtcaaaacaaagtgtctggtttgctttctagttgtattgacaccgatgcattcccatcattctccgacgatgagttacctctatttggcttacccaataacaccaaaggaatcataggcctttcaaagtcacaacttgcattaccaattcagcttgcatcggcaaataaggttccttcaaagttcagtctttgtttgccttctttaaacaaccaaggtttcactaacttgctcgttagagctggagaagaacatcctcagggaatatccaaatttctcaaaaccactccgctaattgtcaacaacgtttccacaggtgccatatccgtggagggtgttccttcaaaggaatacttcattgatgtgaaagctgttcagattgatggaaatgttgtgaacttaaagccttcccttttagctattgacaacaagggaaatgggggaaccaaactcagcaccatgagtcctttcactgaattacaaacaactgtctacaagactttcattcgagatttcatcaagaaggcttcggacagaagattaaagagggtggcatcagtggcaccatttgaggcatgttatgattcaaccagcattagaaattcctcaactggactagttgtgccaactattgatctagtgctgcgaggtggagtgcagtggactatttatggagccaattcaatggttatggcaaagaaaaatgtagcatgtcttgcaattgttgatggagggacagagcctagaatgtcgttcgttaaagcttcaattgttatcggtggatatcagttggaggacaatcttttggagtttgatgtggcttcctccaaattaagcttcagctcatcgctgttgctccacaatgccacatgttcacttggcataggaaatccacgacacaacattgatgtagccattgatcttacaggagaaagcctctggtacgactgtgccattaactacaacacattatcctatattcctgtcagttgtgactcacattcatgccccaccaaaagcactattccatgtgttacttgccatggccctttcaaaccgggttgcacaaacaacacatgtggtacttacaattacaaccccttagctcaagtaacttttccaggggacttggctcaggatttcatattcatttctcaaattcaagtgtctggcattcgttctggctgcacaaatgcacataaattcactagcaatcttgtaggagggttacccaaaggcagcaaaggaatgttaggccttgcaaggtcagaacttgcagtgccaactcagcttgcattgctgaagaaactccctcttaagttttctctatgtttaccttcttctaacaacatcggattcactaacttactcattggacctgagggacatgaacaatctcaggatgtttccaaatatattcaaaccactcctcttgttgtcaaccacttcgacacaggtcctttgtttgaggaaggtttccttaagaaggctgcggaccgaagactaaagagagtggcatcagtggcaccatttgaggcatgtttcgattcgagaagcattggaaattccttcactgggtttgttgtgccaactattgatttggtgctacaagggggagtgcaatggactattcatggagccaattccatggtaatggtaaagaaaaatgtagcatgccttgcatttgttgatggagggacaatggcaacaatgtcgttttttaaagcctcaattgttcttggtgcgcatcagttggaggaaaatcttttggcgtttgatgtggcttcctccaaattaagcttcagctcttcgcttttgctccacaatgtgacatgttcccacctttga

SEQ ID NO: 35045 - DNA, 161 bp, Glycine max
  Peptide Sequence Number=SeqID_126730
atggacaagattgagctcttcccgtaccaaggaagccagagactagagaagaaggcttcactgcaacttggcgtgtctcttgttctcgcttctcacactcaggaagaagctttgtgtgtgcggaggtcgagggacgaagggttagagaacggcattgttag

SEQ ID NO: 35046 - DNA, 165 bp, Glycine max
  Peptide Sequence Number=SeqID_126731
atgaaaatgaggttgttacttgacgctgagatacttactacaggagacaagaagtcagaactctcgagtctaaactacactaaaaccaaggttgcattagcatattcacccaatccaacaaaattgagagcatgtgaatttgacctcgatgatgctaggcaataa

SEQ ID NO: 35047 - DNA, 1110 bp, Glycine max
  Peptide Sequence Number=SeqID_126732
atggttgatcaggttcagcaccctagaatcattgagaaggttgcaggccagcagcatctccgtactggccttcctttgtaccaccagtggcgctcgtttgctaattactcaaatggtgcattgcagtatccagtgatgccagcatgcagagctgcaacagcagcctcccatgtgtttgttgcagctccttctgagaaaggacacttccttattgactttctcatgggtggagtttcagctgctgtgtccaaaactgctgctgcccccattgaacgcgttaaactcttgatccagaaccaggatgagatgatcaaagctggtagactctctgaaccctacaagggtattggtgattgttttaagagaacaatgcaggaggaaggtgttgtttccctgtggagaggtaacactgcaaatgtcatccgttatttccctactcaggccctgaactttgcattcaaggactacttcaagaggcttttcaatttcaggaaggacagggatggttactggaaatggtttgctggtaacttgggctcaggaggtgctgctggtgcctcatcccttttgtttgtatactcccttgactatgcccgtactcgtttggccaatgatgctaaggctgcaaagaagggtggagaaaggcaattcaatggtcttgttgatgtctacaagaagacattggcatctgatggtgttgctggtctgtaccgtggcttcaacatttcctgtgttggaatcattgtgtaccgtggtctctactttggaatgtatgattccttgaagcctgttctcctaactggctctttgcaggatagcttttttgctagttttggccttggatggctcatcaccaatggtgcaggtttagcctcatacccaattgacactgttagaagaagaatgatgatgacatctggtgaagctgtgaagtacaagagctctatggatgcatttacacaaatcctcaagaatgagggtgccaagtccttgtttaagggagctggtgctaatatcctccgtgctgttgctggtgctggtgtgcttgctggttatgacaagttgcaggtcatagtatttgggaagaaatatggttccggtggtgcttaa

SEQ ID NO: 35048 - DNA, 1323 bp, Glycine max
  Peptide Sequence Number=SeqID_126733
atgaagatcggggttatggtcgtcgacctcgaggcgcagggtgtctttgtggacattgacgtagttccttatcttcttggcggtctggtggtcgacgacgagggacgggccacgcggcgagctggggctggggctgggggtggtagtaatgctgcgggtagtgaaagcgaggggcgagagtgggagtgccgtaggaattggggttggagctgtaatagaaagaaattgagtgggtttgtggtggtggcggcggcggcatgggagggggaggggcgtaaggggttgctgaagggagaaagtaaccttgcggctgcggtggtggtgcagggtgggattctgtatggtagtagtaagaagggggtggaggtggtggtcggttttggagttctccttctcctgcgagaaacagaactttcagaagcggaatcgctcactattgatccgattccaccgtcatcggatctttctgcagccaccgtctatcgcacttcgttgccgtcattggcgccggtaaacctattcaaccactcttcttttccttcttcaatttccggatctgttactactgaattgattctatcgattgcggtggttccgatggactgtgattttcacagtcttgcatctctctctcaattttctggaaattcgagtcttatatatgtaagtaacttaatggtgcatgtagacagcttaaacaatacaaggatgttttcgttgttttatggactatggaagtacttgttcagcaagatggagcttcatgtactcattctggggattgacaaggctggcaaaacgactttgctggagaagatgaagtcggtgtactcaaatatagaaggcattcctcctgatcgaattattccaacagtgggattgaatattggtcgcattgaagtggcaaatagtaaacttgtgttctgggacctaggaggtcagcctggtcttcgctcaatatgggagaaatattatgaagaggcacatgctgtaatatttgttgttgatgcttcttgtccgtcacgctttgaagatgcgaagtcagcactggaaaaggtgcttcggcacgaggatctgcaaggagcccctcttttgatattagcgaacaagcaggatattcctgaagcagtatcagctgatgagttacctcaatatttggatttaaagaagctggatgaaagagttttcatgtttgaagctgtgtcagcatacgatggaatggggattagggaaagtgcagaatggttggtggaggtgatggagagaagcaagaggactgaaatgttaagagcgagggcaggtgcaatgggtgcaggtccctag

SEQ ID NO: 35049 - DNA, 192 bp, Glycine max
  Peptide Sequence Number=SeqID_126734
atgaacatctcaatatcagcctgcgcctgcaaacaggagctgcccctagtaagcttccaaaagggatcactatcgatggagtcgttgtttcataataggaataaggagaaggtggtggtgataatgggggctactggtaccggcaaaacgaagttggccatagacgtggccaaacacttccaacccgcggag

SEQ ID NO: 35050 - DNA, 879 bp, Glycine max
  Peptide Sequence Number=SeqID_126735
atgaacgtggtgagcgcgttaatggtgactcggaaccaactcggagcacctgaaggcatacccttcggatcggtatggttgttcgtctacgccgggatctccttttccctcgtcatcttcgccggaatcatgtcaggtctaaccctaggtctcatgtctctcggcctcgttgaccttgagattcttcaaagcagctcggttatacttccggtggttcaaaagcaacaccagctgctagtgactctgcttctgtgtaatgctgctgccatggagatagttccatcagatatgcctctttacgatatactgaatgagtttcaaaagggaagcagccacatggctgctgttgttagggctaggaagcagaatgagatgtcagaaaatgttgttgccaacattgacaagttttcaaggcctccaagcattaacaagtcaactggtttgcaacgtagtgattcccggacaaatggttccttttcagataatattgaagatgaagtgattggtgttatcactttagaagatgtatttgaagaacttttgcaagaggagattgtggatgagacagatgaatatgttgatgttcataagagcacgggctccatcaatccgaagattgactgtccaaaagggagctgggtttgggttagagctattaataggggccaatctggcccacagagtgggaaggaatggggagcaatgaggcacaagaaagaggatcagaaaagggtgggaggagctcgtggagaagcaaaatgctcccaacaactggttgccgcaaccttacaagaagatcatggtgggtcacctgagcggtgcaccagtaaccttgagaaccatttaaataagccttacaattgcagtttggaaaactga

SEQ ID NO: 35051 - DNA, 438 bp, Glycine max
  Peptide Sequence Number=SeqID_126736
atggcgtttgccctttttgggaccggaggcctcgagtttggcgacggggcagccacagggcgcccggaagagcaaaagcgcacggccgttagggggagccatcttcctgagctcggacctgaggcagtcgtaatcggggttggcctcagtgccgcccttccaggggagcttatcgatttcggcggaggaggagccgaagcgctgaatctgcaaatcgaactccatggccttcttgaggcccttgcatccctggcgctggcagcggcgggatcgggagccgcagaagaaggcggcgagggagagggagaagaagaggaggaaggggaggaggtaggagagggggagggaggggaggaggagggagagggagttgaagatgtagcagaggtaggaggagaggaggaaggcgccggagaagaggaccaggaggaggattag

SEQ ID NO: 35052 - DNA, 141 bp, Glycine max
  Peptide Sequence Number=SeqID_126737
atgattggtaagtggacaatttacaaggaaggttgtgatacgagcaagcttataatcccagaaaatagaggaagcaccagcagcaaaggtgcaaagagaagaagagaccaagagaagagtggtgaagccagcataccttga

SEQ ID NO: 35053 - DNA, 726 bp, Glycine max
  Peptide Sequence Number=SeqID_126738
atgggggacgcgccaagacccttatccgttccaatccccactttggaaaaagcagaacgctccgaccttctccgcgccctagaagcttccatgggttcccctttcagctcggagcctctctccccaaaccctaactctctcatcatcgtcatcagcggtcccagcggcgtcggcaaggacgccctcatcgcgcgcctccgcgacaactcccgcctcgccctccacttcgtcgtcaccgtcaccacccgcccccgccgccccgccgaggtcgacgggaaagactacatcttcgtatccaaggaagagtttctcgggatggtggagcgggaggagctgctggagtatgcactggtctacggtgactacaagggggtcccgaagcagcagattcgggagtgtctcgcgaagggctgcgacgtcgttctgagggtggatattcagggggctgccacgctgaagaaggtgctcgggaagtcggcggtgtttgtgtttgtggcggcggagagcgagatggcgttggtagagaggctcgtggaccggaagacggagaccgtggagtcgttgttggtgaggattggtactgccagggaggagatgaagcatgttaagaattttgattatgttgtggtcaatgctaaagggaagcttgataatgcggtcaagttgatggagtctattattgatgctgagaaagctagggtttctcagaggactcctcttttgtaa

SEQ ID NO: 35054 - DNA, 1839 bp, Glycine max
  Peptide Sequence Number=SeqID_126739
atggtttcaacggaaggacgtggaggtatagtgaaaattctgttgataaaaaacagccgtggggatgttcttcaatgcagccattacatgcctatagtcagtcctgatggaaagcctctgccatgtgtgatatattgccatggaaacagtggatgcagggttgatgccagtgaagctgctctaattttacttccttcaaatattacagtttttactctggatttctcgggatcaggaatctctggaggagagcatgtcactctaggttggaatgaatgctttattatagtgaaagttgcctattggacattgaagcagcaagaagagccaaagaagaaaaaaagcatagcagggattgaggtggatgagtgcagtgacatacaaaaatgggagtttttgaaagttagagtagcacctattaagaagaagctgacaaaagcttacccagggtggtttgatcataaggatgatctgagggcagtggtcaactatctgcgggcagatggaaatgtctctctgattggcttatggggacgctcaatgggtgctgtgactagccttatgtatggagctgaggatccttcaatcgcaggaatggttttagacagtcccttctctgatttggttgatttaatgatggaacttgtagatacatatagagtccgtctgccaaaattcacagtgaagtttgcaattcaatacatgcgaaaaacaatccagaagaaagcaaaatttgacataacagacttgaacaccgttaaggtagcaaaatcttgttttgttcctgctctagtagggcatgccattgatgatgattttattcgtcctcatcactcagatcgtatacttgaggcttacatgggggacaaaaatataattaaatttgagggagatcacaactcttcgcgtcctcagtattattttgattccgtaaacatattttttcacaatgttttacaacctcctgaagatgagcttggggaatcattttttgacattatgaatgattactttgaaacatcaacaagcagtactgtggaagacattaagcacgtccgttcaaaaaaaccaatgagtaggatggaggttccatcacatatttcttcaaaagatgcacatctcgactgtgaggcacagaaatgtgatgatctttcctcatcatcttctacaatgattagttttgaattatcaaatggtcgtctctatagtcccctcgttccaaccgatctagatgatgaccactttgtggaatttcaacttgatgactttacaggctgtccatctagtgcaaagaaagaacaaaaaatgttcacggaagcagtgatagattcattgaaagaccgggaaatacgaattccagaggtagaacaaccacctgttaggagtgctagtagtaccatgtctatagagccatcggataagaatgactcacatgcttctaattcacatgagatttccaaacctgtggagacagaatcttctttactcaaccacagtgataaaacaatttccacttcatctgatgcattggagcccttgaaaactgagtcaaattccatttcagtgattccaagtcctgtaacaagtctttcatcaagcaaaataccatcatcaccactaccaccattggacacttcatcggtcaccgagtctggcgatacagaaagtgcttctactggtaatgatagttctgctagcttacaaagttcatcagacactgacatttcacacaatacaaaagccacattaactgttattaagaatccaacaggtcatgtcttgaacggcttactgcgacgttgggatttcaagtttttcagaaacagtcagaatcgataa

SEQ ID NO: 35055 - DNA, 2067 bp, Glycine max
  Peptide Sequence Number=SeqID_126740
atggcacagattttggctccctctacgcaatggcagatgagaatctcaaaatcctctcccaatgcaactcccattacatcaaacatgtggagttctttattgtggaaacaaaataagaaagtttcacctaccagttctgctaaatttagagtgctggcaattaagtctgacaatagcaccatcaacaggctcgagggtctacttaatttggatatcactccattcactgacaagataattgctgagtacatttggattggggggacaggaattgatgtgcgcagtaaatcaagaacaatatcaaagcctgttgaagatccctctgagctccctaaatggaactatgatggatctagcactggacaggcacctggtgatgatagtgaagtaatcctatatcctcaagcaattttcaaagatcctttccgtggcggtaacaatattttggtcatttgcgattcttacaccccacaaggtgagcctatccctacaaacaagagacacagagctgctgaaattttcagtaacccaaaggtccaagctgaagttccatggtatggaatagaacaagagtacaccttacttcaaacaaatgtgaaatggccattaggatggccggttggtggctatcccggtcctcagggtccttattattgcagtgctggggcagataagtcatttggacgtgacatatctgatgctcattacaaggcttgcttatatgctggaattaacatcagtggcaccaatggggaggttatgcctgggcagtgggagtaccaagttggtcctagtgtaggtattgaggctggtgatcatatctgggcttcaaggtacatcctcgagagaattactgagcaagctggtgttgtgctctctcttgatccaaaaccaatagagggtgactggaatggagcaggatgccacaccaattacagcatgagggaagatggaggctttgaggtaataaagaaggcaattttgaatctatcgctacgccacaaggatcacatcagtgcatatggagaaggaaatgagagaaggttgacaggaaagcatgagacagcaagcattaacacattttcttggggagtggctaaccgtggttgctcaatccgtgtgggaagagacacagagaagaatggcaaaggttacttggaagacaggcgaccggcttcaaacatggatccatatgttgtgacatcattacttgcagagactacactattgtgggagccaactctggaggctgaagctcttgcagctcagaagttagcattgaaggaccccacccacctcatgaactgtaaccatgccgccaccaccttcctttcgctcgctctcccaccaccgccaagttccgcgcttttcccaaaacgcccttccgcaatcctcaggccgtaccaaacccttttgtccagcaacaccaggctcggactcagagttagagcttcaaatggtgatagtaacgttcaaccagcaaattggtcccagtggatccctgcaggatctttcgccgccgataaagttttcaggttaatccccggtgccaccgccagtccgattggccagtttgttccgtcccccgccacgtttcttcactccatcgaccctcgagtcaaattggatcaactgggaagagtttatttgctatctgaattattattcataacatcaggattgggttcagatggtgtgcctgcaattgttcagttgagaacaccaccacctgcaatgatggggcttcctaatcttccagtatctttaacaggttatgcatatacaatcatgaagttaggtccattaacctttaccaggaaaggcctatctgtagcaagcactgttgcatgtttgacttttacagtatttcaaagtgcaagtccctgcctcactgctacatcccctgaacagttagcatttgcattgcgatggtttatgctccctctgaaatacataggtgtttctgtgtcagaaattgtgcttacacttttactgtcattgaggtttatcagtcttgtttttgatgagggtggggatgttgttctgatagatatggctgatcactga

SEQ ID NO: 35056 - DNA, 204 bp, Glycine max
  Peptide Sequence Number=SeqID_126741
atgaacgacgttaatagaatcctcgtcggcgcttccgaatccctcaacgaacaatgtgaatcttctccttctctgcagtggcatgaatcctcgtgcatcttccaattcgagggttggactgcgatatcttcaaccacgcttttcagttattcagggattgagaaactgcaatgtggaggcgcttgctactgcaactctcgttga

SEQ ID NO: 35057 - DNA, 516 bp, Glycine max
  Peptide Sequence Number=SeqID_126742
atgggtcgacagtgtcgtgctgaggccttgtggccgctattgttcttaacgttcatgttcataattgttctgattacgatagaccatgcgtcaactgggatttttatatttttgggttccatattgggtttgttcctatggtattggttaggatcgcttgtattagatcgtgacaactgggataactcacacgacgtggatgatgagagaacgagagagtttcaaaacattgagtcgtctaatgctagtgatccgcagaattctctccctctcacaaggactcgcattgtgatcgcgagtgtaagggctcgaagggaaccttggcaagatggtgatgacgaatcccaacgtgattgtcctatttgcatggaagatttcaagaatggagagttaattcaaccttttggagtttgtgtccatgagtttcatttgtcatgcgttaactcttggttactcggtggtggaaagactacttgtccggtttgtcgcaaggatttatcaattagtgtagactag

SEQ ID NO: 35058 - DNA, 4332 bp, Glycine max
  Peptide Sequence Number=SeqID_126743
atggttaagtgcctttccagaatttcaagatttccaaacccagagagaaccagatctcctcctatatcatattcagatttggatactgatactccagaaaggccatctccagtcacaacttttattgcttcacgtgattccgcaactggtgttacagccagaatttcaagatttccaaacccagagaaaaccagatctcctcctatatcatatgcagatttggatattgatactccagaaaggccatctccagtcacaacatttattgcttcacgtgataccgcaactggtgttactaccagaatttcaagatttccgaaccctgagagaaccagatctcctcctatatcatatgcagatgttgaagctttgaggaattctgatcaaactgttctaagaaataagccttctctgtctcctcctagactgggaagtacatcaaatgttccgaggactgtccctcattctcaaattcaccagaaatctttcccgtctaatgtttctgaagccactgtaagcaagcccatcagctccactgctcctaaaagatcaagatcacctcctccatcatttgcagccaatgtaacccttgaaggaaactcaatttcctcagaagacaactctgaacgtgaaatgttagccaaggcaaagcgtttagctcggttcaaggtagaactaagcaaatctgaacaaaataatgatgatattcccaatcagacggcttttgcaaatagacatgaacaatctgtgttggagcagaaatatgtgagagggaatttaatggattcagctagaaactttaccaatggtcttgctgtttctgacaatgaaggcttggaaacatccaatttaattattggcttatgtccagatatgtgtcctgagtcagaaaggggagaacgagaaagaaaaggggatcttgaccaatatgaacgtgcggatggggatagaaatgtaactagcagacttcttgcagttaagaagtatactaggacagcagagagggaagccattttgatccggcctatgcctatcctgcaaaagacaattgattatctgctcactttgctagatcagccttatgatgaaaggtttcttggtgtatacaacttcttgtgggataggatgagagcaattcgaatggacctcagaatgcagcacattttcaatcaaagggctattactatgctggaacagatgataaaattacatatcattgcaatgcatgaattatgtgaatacactaaaggagaaggattttccgagggctttgatgctcatctcaatattgaacagatgaacaaaacttcagttgatctgttccagatgtatgatgatcacagaaagaaaggaatcaatattcccaccgaaaaagagtttcgaggctattatgctcttcttaaactggataagcaccctggttacaaagttgaacctgcagagctctcacttgaaattgctaagatgactccagagattaggcagactccagaagttctattttctcgcagtgtagcaagagcgtgccgaacagcggtaaagttgtgccttggtgacttgttggtcatgagttcgaatccggaaacagcctctttgcatatgcaagggctacatctgatcagaaatcctaacctttatgtcttgtgttacttttacaagttgcgtacccaggcacttgcttctctgcattctggtctacagaatagccaaggtctccctgttgctcatgttgctaactggcttgctatggaggatgaaggtatagagggtctcttggagtatcatggattcttgctaaaaacatttgaagagccatacatggtgaaggaaggcccatttctcaatgttgatgttgacttttccacaaagtgttcaaaacttgtgctcaagaaaaggtctggaaggatactcgaggatgtttcaccctcaattcaagctgaatcaccacgtgttgagactgtgaaagagattcagatgaggaaggtatacaagcatgaaccacaagtagtttcagctgttgaaaatgatacttctgtgcagatacttgatgaggaaattccagacgctgaagctattttctccccaaaggatagtaaatcaggaaaggcatttaaggatgttcaggacaatcgaaaagatcacaatatgtccactactagtccatcactgttgagcttcccttttcctaatattatacctgaaccacaacttcctagaattgacgttttaaaggataccaattccgatttaattgcaagaggttctccaaagagaaacttgccgtctaatgttgatggaaggccattggagattgtacccaaagcagctccaccagaaagttcattagggaatagtttttttgtgccacctcctgtggcccggggtatatccaaggatgagtctctgattattcaccaagaacatcacgatgaaattgatgaagttagagaaaattgtcaagatgaagaaattgctgaggccaagctgaagttgttcttaaggttatggaggaggcgagcatcaaaattaagaagattacgggaagagaggcaattagcatcaaatgctgcactaaactcgatgccattgggccccccaattcaacattatattaatcgacctggtaacttcaacaagtttgacattgatatagctatgagggagagatatgaaaaccaggaaaaatcatggtcgagacttaatgtttccaatatagttgctgatacactaggccgaagaaatccagatgctaaatgcttgtgctggaagatcattctatgctctcagatgaacagtggatatgaaatgggagcggcaggcacttggttgacctcaaagttcatgccttctagtgatgaagatgcggttatttcatctcctggcttggtaatatggaggaaatggatttctagtcaatctggcatcaaccctacctgctatctctctgtagttagggatacagcatttggtagtctagatgaggcggtatctggggcaggtgcggttatgtttcttgtgtctgagagcatctcatgggaacttcagagatctcatcttcataatcttctgatgtcaattccctctggggcctgcttgcctctgctgatcttatgcagctcatacgatgaaaggttctcttctgctattatcaatgagctgggtcttcaaagcattgataaattgaagattagtagctttctgcttgtttttcttagtgaaaaccagcagcagatggaacacttgggtggatttttcagtgatacacgattaagggaagggctgcaatggctggcaggtgaatcacccttgcaacccaaccttggctgtgtgaaaatacgagaacttgttcacgcccatcttaattctttctcagagatgctggacattgccattaactccaacgtgggtcctaatgactatgtttcattgttcaatgaagccttagatcgttcaactaaagaaattattgctactgccaattcaaatcctactggttggccttgtccagaaattggtttacttgacaagttttgtgatgaagatagagtagtaaaaatgtgcttgccaactttggggtggagctcaagtgtgaaaaccgaaccaactatttgtgctttgcaaaactgtaagctccctaatttccctgatgatatatcatggttggccagaggttctaaagttggacatgagattgaaagccacaggatacagcttgagaattgcttgatccagtacttggctcatactagtaagacgatgggaatttctttggcaacaaaagaggcgcgtgtcacaatgcaaagctgtgctagacttgagctgcgtggctcaagctaccatgtagttccacattggggtatgatttttcgtcgaattttcaactggcgtttaatgggtttatctagcagggaagtctctacggcttacatcgcagaatgccatcatgttgctcttccaaatgtgagctccgaaacatggctgtcttattatccagatgcgtctttagatgaaataatcagtgttagctgtaactctcctcttcccgttaatgatcagctgaggccggatgcccttcaaagtcctccacatagggattcaaatgatgtattccatgagactgttaacgtgatgtatactgaaagcaatcttccaattgataaattacctagcatggatacaactggaacatatggtttatacagtgctaattctaacagtggagcattaacgaatgggaaaccaaccaaagaagctgacaagttaagcaaattattggagcaatgtaacttgctgcaggatggcatagataagaagctttttttatacttttaa

SEQ ID NO: 35059 - DNA, 336 bp, Glycine max
  Peptide Sequence Number=SeqID_126744
atggagaaaaagggagcaaccgtagtggtggaagctctcagacggaggttctatggagggcaatcttgggatagtctaaaaaaagagagcctcttcactatggacttcgtaacccattgtccagaggctcttcactatgggaaggtcaaaatctcactctcctctaccctccaaaactttcctcctgcaacattgtttggcacttattcagctgcatggtgtcagatcggaggtgatgaagggtgcgatggtgatgccgagggattggagggagatggcctaggatttgaattggtagaggaagagagagtacaagagatagcgcataggatttga

SEQ ID NO: 35060 - DNA, 414 bp, Glycine max
  Peptide Sequence Number=SeqID_126745
atgggcacggaggttctacggccacaagattgtttcacccaacgcatcggtgttccaccgcctggcttttcccggcgaagaacctatggtacccaccacaacaacaaaaacaataacgttaacaattatttcaggggtaaccggaagccgacaacccgacccgaacaaagaaaacgggttgtggacaaaaggcccagtttagatgattcgaggttttcgagtttggagatggagaaggctcggacccgacccggatatggtcccgaagcagatccggatcgtggatttcaggtccgggcgcgagatttacgccggatccgcgttcgcggtgtcgccgtcgccgagcgcgctgcccttgccgtctttttcgaagaggcagccggcggtggcggttgccgactctgcgacccgtga

SEQ ID NO: 35061 - DNA, 1486 bp, Glycine max
  Peptide Sequence Number=SeqID_126746
atgtttccaatgagggtatgggtagctgtggtattcattatgttagtaactactgtggcggccaagcctcgtcgaattcttttggatacggatgttgatcttgatgatgtatttgctcttctctaccttttgaagctcaacagatcagagtttcaattggagggagtcacaatcaatgcaaatgcttggactaatgtcggacatgctgtgaatcaagtttatgacatactttacatgatggggagagatgacatagcagttggaatgggaggtgagggtggaatactcccagacggtaccattctcccaaatgtgggtggatatctttcaattatagaacaaggaatgacaacgacaggaggctgcagatacagacaggccattccaataggccatagagggatcttggatattgatactatttatggcatccgaaaagctttccttccacaggggataaggaaatatactcccttaggacaaccaactgctcaacaagtgttgattgacaaaatatctgcaggtcctataactttgattgtgataggagtgcaaacaaatatagctatttttctcatgaacaatccacacttgaagaaaaatgtacaacatatttacataatgggcggtgctgtgaggtcaacagacccaactagttgttgccccaaaaatgcatccttttcttgcattcctgggcagtgtggtgaccgtggcaatgtattcacaaattatgaagcgaacccttatgcagagttcaatatatttggtgacccttttgcagcataccaggtgattcattctggtatacctgttacccttgttcctcttgatgcaacaaacacaatccccatcaatgaagaattctttaatgaatttgaaaaaagtcaagacacatatgaagcacaatattgtttcaagtccttgaaaatggctaaaatggctcgtgataagcttgacaaccaattctatacgagttattttatgtgggactctttcgcatctggtgtagcggtctcaagcatgagaaactccaataaaaaaaataaaagggaaaacgaatttgctcatatggagtacatgaacataactgtaattacttcgaacaaaccttatgggatatctgatggctccaacccattttttgatggcctcaaagttcctaaattcaatctaaagaaaggcggggtgcatagtggtcatgttcaacaagggcttagagataaattttgttttgtgaagaatgggaaagggagatgtcaggacggttatacagctgaggtggatggtcctgactcggtgaaggtacttgtcgccactaaagcaaagcctaacagggacgttaggagtaagcttgacaaagaatatttcaaaagcttcttgaatgtgctaaagcaaccacaacatgccgggaggttcaacttcactacacaatttccttactacgaagaagttacttacatgccagattttcaaaacaaaacactgg

SEQ ID NO: 35062 - DNA, 1416 bp, Glycine max
  Peptide Sequence Number=SeqID_126747
atggcaattgagcagcacaaggatgtggagagtggatatttgcaagagcccttcattcaaccagaggaggttgcttgtaaagaagttggatcagataagagtgtggaaaatggatccattggaatggttttgcttagcacacttgttgccgtttgtggttctttcacatttggaaattgtgtgggctattcatcgcccactcaagcggctataagggaagatctcagtctatctcttgctgagttttccatgtttggttcattagtgaccattggtgctatgcttggggctataaccagcggccggattacagatttcattggccgcaaaggggctatgaggatttcaacgggattttgcattactggatggttagctgtcttcttctcaaagggttcttactcccttgacctgggaagatttttcacagggtacggcattggacttatatcatacgtggttcctgtatatatagcagaaatagcacccaaaaatcttcgaggaggacttgcaacaacaaatcagcttttgattgttactggagcgtcagtctcattcttattaggaagtgtcatacattggagaaaacttgcactagcggagaggtataactgttggcttggtttgaactttgaagggttagtgccttgcatttgcttgctgattggtttgtgctttatccctgagtcccccagatggctggctaaggttggccgtgaaaaagaatttcaactagctttaaggagacttcggggtaaagatgttgatatttctgatgaagctgctgaaattctggactctattgaaactcttcgaagccttcctaagattaagctgttggatttgttccaaagcaaacatgtgcgctctgtagttattggggtcgggttgatggtatgccaacaatttgttggaattaatggcataggattctacacagccgagacttttatagcagctggactttcttcaggaaaagctggtaccatagcatatgcttgtttgcaggttccatttactgtattgggagccattttgatggataagtctggaaggagacctcttatgatggaccaaagcttaatgcttgagtgcgcaccgatatttgcagttgctggtgtgttgatctacatagcagcatattcaattggtgtaggaccagttccttgggtgataatgtcagagatctttcccattcatgtgaagggaattgctggaagcttggtggttttggctaattggctaggagcttggatagtttcgtatactttcaactctcttatgagctggagttctcctggtactttgtttttgtatgctggaagttccctcttaactattctgtttgtcacaaaattagtcccagaaaccaaaggaaaaactttggaagagattcaggcttggattagtccatag

SEQ ID NO: 35063 - DNA, 1236 bp, Glycine max
  Peptide Sequence Number=SeqID_126748
atggaacccctgtctctccctcctctcccagtcatggacgacgccgaagacccttcctccatttgggacttctcttacctcctcgacttcgacctcgacgaccaagatattattattaataacaacaactctctccctcttcccttaaacgaccaccccgctccaagcgagatccctcaaaacgacagggtccgaaagcgcgacccgaggctcacatgctccaacttcctcgcgggtcgggtcccctgcgcctgccccgaactcgacgcgatactcgaggacgagggtttgcctggcaagaaacgcgcccgcaccgcgcgtgcatctgcatccgctcgctgccaggtccctgcctgcgaggtcgatatctcagagctgaaagggtatcaccgccgacacagggtttgcttgcgctgcgctaatgccgccaccgttatgctcaacggcgaggccaagagatactgccaacagtgtggaaagtttcacgttttgtcggatttcgacgagggtaaacggagctgtagaaggaagttagagcggcataacaccagaaggagaagaaagcctacggcggattctggaggggctactcatagtgaactacttcaacctgttgccgaaaacgaggaaaacaattatgatgtggaagctggaaaagattgttcgaatttgagtaccgatatcaacgacgttggagtgtctctggatcttgaagatgaaccggctcccattccgagctcggctcctgaagcccagaatattaatagtgatagtgttgtgtctttggctgtttctggtgaaacgcgagtgaatagtgggaacacttccaattcgccttcttattgtgacaataagagtgcctattcgtctatgatattccaatggttggcaagtatgcctgtggagttggagggatatatccgccctgggtgtacgatcctgacaatttttattgcaatgcctaacatcatgtggataaatttactgaaagaccctttggagtatgtgcatgatattgttgctcctggaaagatgctatctggaagaggcactgcactagttcatctgaatgacatgatcttccgtgttatgaaagatggaacttctgtgacgaatgtcaaggtaaacatgcatgcaccgaagcttcactatgttcatcccacatactttgaggctggcaaacctatggagtttgttgcttgtggaagtaacttactgcagcctaagtttcggtag

SEQ ID NO: 35064 - DNA, 2082 bp, Glycine max
  Peptide Sequence Number=SeqID_126749
atggctgagattgacgttgaaagtttgtttaactatgcggtgaaggggcagtggagagaggcattagatgcctacaacaaaaacccggaaacattggaagctaagatcacaaaagtggaagacacagtgctacacgttgctgtgcatgtaggccaaacttgctttgtgaagagtgtgttagataacatcgacaaagaggtgtctctcaacatcttatgcatgcaaaactcaaagggtaacactcccttgcacctttcagcacagcttgggaacgtggaattgtgccacaacatggccaaaagggaccccaaactcgtttgttttcgcaacgttgaaggtgagacccctcttttcttggcagctgttcatggcaagagagaggctttcttttgtctccatgaaaaccaacaaagaagacgtgatgatgaggaggatggctcgttgttggttaggaaaagcaacggggataccattcttcattctaccgtcgttagtgaatactttggtttggcgcttcaaataatagagttgtacccaaaccttgtgaattctgtaaaccaggacgggttatcacctctgcagattcttgcagcgaagcctaattgtttcaaaagcagcacgcggatggagttacttcagagtattatttacaagtgttcgattgttgatgagattgaggaaacatatgatatacgttgtaatgaagcagacacaactcatcactaccctatgaactatgaaacatgcgccaccttcttatcattgttgaagagtacttcaattggaaaagatgacaacgctgcaagcaatgatgaagagaataatgtctcccgaaaatctgaggaagaacaagcaaagaaattggaaaagaaacgctacctgttccctcccaattggggagcaacgatccgattcctaacccatatgatgaagatcttgctaatcatttgcggttttggagcatcttggatagggaaaatccaacgaaagaaggtgaaacacattctagccaagcaagtgatgaatgaactaattcagcgaacttgttcttcttccctgtacaagcatgaccacactggaacaagtaacataaatagtagtactagtagtaataatcaaagtaaggagaaaggaggttttcagaaaataagaagaacagattcacctattttgattgcagcaaagatgggagtggcagagatggttgagaagattcttgagacagacccagtggcaatccatgacgtggacgctgataacaagaatgttgttcttctggccatagagaacaggcaacctcatgtttacagcttgttgaatgagaggagcatgattaaagagactgcatttcgtcaagtggataaccaagggaacagtgctttgcatcttgctgccacctataggagttataagccatggcgtgtccctggtgctgcattgcaaatgcagtgggaatacaagtggtataagctagttaagaactccatgccaccaaatttctatgaacgttacaacgagaacgggcaaacagcgaagcaggtattcataagtacacacgagagactcacaaaggaaggtggtaaatggctgtccaaaacctcagaatcatgctcgttggtagcagcacttgttgcaaccgttgcattcacaacctcaacagctgtaccaggcggtccgaatcaaaacacaggttatccattgtttcaaggaagactggctttcaacatcttcgccgtagcatcacttgttgcactttgttcctctgtcactgcccttgttttgttcctctcaatactcacatctcggttccaagaaaaggatttcgctatggacttgccgagaaagcttcttctgggattgaccacactcttcacatctatagcatctgtcttggtctcattctgtgcaggacatttcttcatcgttgaagacgagctgaagtttgcagtttatcccatatatgttgctacgtgtttgcctgtgtcattttttgcatttgttcaacttcctctctactttgatctgtccttggctatgataaggaaggttcctcagcgcagctataaatcacatcatcattag

SEQ ID NO: 35065 - DNA, 912 bp, Glycine max
  Peptide Sequence Number=SeqID_126750
atggctacccatttgcaggtatcagaaggtgcacccactgaagcattcgacccttctccttctcttgcaattggagaatacgacctcttaatcgttggtcctgggattcttggtcgtttggtcgctcacaattggcgccaggaatatcctggctgcaaagtttttggacaaacagcaaccactaatcatcatcaagagttaactgaaattggtatcaatccgtctttgaagtggaccaaagcctcctccttcaaatttccctatgtcattttctgtgctcccccttaccaatccccggactaccttggtgatcttaggctggctgcatcatgctggaatggtgaaggtgctttgctgtttacatcaagctctgctccttatgattgtaatgataatggattgtgtcatgaggataatccagtggtgccaatgggtaggagccccaggactgatgtccttctaaaagctgaaaagatagtgctggagtttggtggttctgttttaagactatctggactttatatatcctcttcagaattcagtttactaggattccaactgttcattcatcttggtggtgcacatgcttattggttagataaggggattgtcgaatctcgtcctgatcacatcctgaatcttatacactatgaggatgcggcttccctctctgttgcaattttgaagaaacaatttcatgggcggattttcttgggttgtgataatcatcccttatccaggcaagaagtgatggatttggtttacaaaagtgggaaatttagtaaaaagtttgagaaatttacaggaaccgatgatcctctaggcaagagattgaacaactctagaacatgccaggaagtagggtggcagcccaagtactctagctttgctcatttccttgagaccatctga

SEQ ID NO: 35066 - DNA, 1026 bp, Glycine max
  Peptide Sequence Number=SeqID_126751
atggggaaaactaggtggttgataatattggttacctgtttatgcctgctttccttttctgatggcagagaactcaaggttaggcataaaaagcaacattaccaatacaatcatacagttgctacaatattagtggaatatgcttctgcggtatacttgtcagatttaactgaactttttacttggacgtgctctaggtgtaatggcttgaccaaggcatttgttggagtggccgatgatcctcatgccattatcattgcattcagaggaacaaatgaacacagcttacagaattggattgaagatttatattggaagcagcatgatataaattatccaggcatggatgatgcaatggtacaccgtggtttttataccgcgtaccacaatacaacaatacgtcctgcaattttagatgctgttgaaagagcaaagaagttttatggagatattgaaattatagcaacagggcattcaatgggaggggcaatggcttcattttgtggacttgatttaacggtaaatcaaaatgaaaaaaatgttcaagttatgacatttggacaacctcgtattggaaatgctgcttttgcatctctctatacgaaactagttccaaataccatccgagtcacaaatgaccatgatattgtacctcatttgcctccatactattattatttaccgcagaagacataccgccacttcccaagagaggtatggctttataacatcggattaggtagtcttgtgtacagtgttgagaagatttgtgatgaatctggtgaggatccaaattgcagcagatcggtgactgggaatagcattgctgatcacttggtctattatggcgttgacatgggatcagatgagccaagttcatgcagaattgttatggattcttatgttcagaatactaacatcaaagattcaagaggaaacttaatcttgtccagagatcctgcaacccccctcatcaaattgagtggagagggtgacaatcaggaaaatcccattaatgttgattga

SEQ ID NO: 35067 - DNA, 684 bp, Glycine max
  Peptide Sequence Number=SeqID_126752
atggccccattggcatgtttgcggcttcccacccgaatccgcctccgaacctcccacgacccggactcaatcctctccctcttcaaatcccacggcttctccgactcccaaatccgccgcatcattcaaacatacccttacttcctctcctacaactcccgcaaaattatcctccccaaactcaacttcctcctctccaaaggcgcctccacccccgacctcatccgcatcatcaccaaaaaccctaaaatcctccgcttaagcctctacaactccatcaccccacgttacgatttcataaaaagattcatgctttccgacgattccactctccgctccgtcaaagtttgcccctgcattatgctttctaagaatcctcttcttaacatcgaatttctcctccacaacggtgtcccagaatccaaggttgttatgttgcttcgttactggcccccgctctcgttgccaatgcccccactttccagaacgcggtccaggaggttatggaattgggcttcgagaccagcaaaacgatgtttggttaaggatgttaattgggcctccgcgtttttagtctctgataagattttcttgcagaaatttgtggtttcctttgagaaggaagccgatcggcttttgaagctctatgaagagaagatgatgttcctagataacactcactga

SEQ ID NO: 35068 - DNA, 597 bp, Glycine max
  Peptide Sequence Number=SeqID_126753
atggttacgttcagggtgcgtaagattcacgccattctgtgtttgatttcatcttccttcgattatgatttttacgaggtagtggtcgggagggctctcccaacggaagcagatcagcatccgaagatctaccgaatgaagctctgggccaccaacgaggttcgcgccaagtctaagttctggtattttttgaggaagctgaagaaggtgaagaagagcaatggtcaagttcttgctatcaacgagttgatcacgatttttgagaagaacccaaccaagattaagaactacgggatatggttgcggtatcagagtaggactggttaccacaacatgtacaaggagtaccgcgataccactctaaacggttcagttgaggcaatgtacaatgagatggcttctcgccacagggtcaggagcccatgcatccaaattatcaagactgcaaccatcccagctaagctttgcaagagggagagcaccaagcaattccacaactccaaaatcaagttcccattggtcttccagaaagttagaccacctaccaggaagctgaagaccacatacaaggccaaaaagcccaatttgtttatgtaa

SEQ ID NO: 35069 - DNA, 120 bp, Glycine max
  Peptide Sequence Number=SeqID_126754
atggtggttgcgttgattggaggatcaagagacaatgggaacggatggctcatatggttcatgacacgtggtgctggcaggcgatggcttcggaatgtgatggtgcataactgcacttga

SEQ ID NO: 35070 - DNA, 774 bp, Glycine max
  Peptide Sequence Number=SeqID_126755
atgccttctcattcttgcatcctcaaccaccaccgccatcgctctctcccactccctctccctctccatctctctcgccgcaaacgcctctctctccctccaaccccttccctcatctattctcccagttcccgcttcgattgcgccactctcgagttacatccgtcgattattccgcagaatgaatgctgctttccacgcaatgttgctcctacgagagccttcgacgattttcactgtggcgttactcttactgttcgtaatagtactcgttactcagtggaagtgcttgatgctctgaaagattcgtttgacataccaatgcttgattattgggatgctgatgataattcttctgcgtatatgctctcttctagtgatggggaagacagtgatggtgaaatttttcttactccagtgaatgatcttgatttgccttctgtttcggcgtcaaataatgatgctctaacagtggctgctcatcgttttgcaaatcttgggaggggacgcaagaaatctaggcaaacaacacccacattgggtggtttgctttttatacctgttggtgtagttgttgctcatgtctttgctggttcctcatctatagaagtgtctggggcagctggagcaaccattggatttgctgcagttggtttacttagtgatatattaagcctcaccaagaatcattggagaggtttgcctgcattgacagaagttctattggagggtctgtttggtaggaaggaagtaggtgagaaattgggtggatag

SEQ ID NO: 35071 - DNA, 2274 bp, Glycine max
  Peptide Sequence Number=SeqID_126756
atgtcggtttcttgtgttaaaaacttcttccagaggttctggcaagatgaatttcaaacgggaaatattccccatggaagctttttggccaatgatgatctccttccatctcttggagctaggataaaccaggaaactagacttagaagatacataatctctcctttccatcctcgctatagggcttgggagttggtactggttgttctagtcatatactcagcttggatttgcccatttgagtttgcatttcttccttacaaggaaaatgctctattcatcgcagacaacattgtcaatggcttctttgccattgacatagtgttgacattctttgttgcataccttgatcgccattcttatcttcttgttgatgatccaaagaagattgcgatcagcttcctcttcaatcatagcagtgaacttggcttcaaagttcttaacatgtttcggttatggaggttgagacgagtcagttctctgtttgcaagacttgaaaaggacattcgcttcaattatttttggactaggtgcacaaagctcattgctgtgaccttgtttacggtgcattgtgcgggatgctttaactatcttattgcagataggtatccagattccaaaagaacatggattggtgcagtgtacccaaattttaaagaagaaagtctttgggacagatatgtcactgcaatatactggtccattgtcactcttactaccactggctatggggatttacatgctgagaacacgagagagatgctgtttgatatagcttacatgctcttcaacttgggtttaacatcatacatcattggaaacatgactaaccttgtagtccactggaccagccgtaccagaaattttagggacacagtgaaagcagcttctgaatttgcttcaagaaatcatttgcctcatcgcattcaggatcaaatgttgtcacatatatgtttgaggttcaaaacagaaggactgaagcagcaagaaacattgaatgatcttccaaaggcaattcgttcaagcattgcacaccatctgtttttccctgtcgtgcaaaaggtctaccttttccaaggagtctcacatgatttccttttccaactggtttcagatatggaagctgagtatttcccacccaaggaggatgtgatactgcaaaacgagtcttccacagaactttatgtgctggtttctggggtagtggatctggttcgctacatcgatgggcatgatcatgttcatgggaaggcagctgcagtagatgcatttggagagattggagttttatatcatataccacagcctttcacagttcggaccacagaactttctcagattttaagaatcaacaaaacatccttaatgaatgtcttacacgcaaatccaggagatgcacaaattataatggataaccttttaatgagattaaaggggcgtgaaggttttggctttgaatatccatgcacagattctggacggtttccacatgaagtgcttcaaggaggtaacacgagaggaggcccttctcatgagtgtacaaataattcacttgagcattcattaatgcatgaaggagagtgcatatatattggaaactcggagaccagtttgcataaggggaccaatgatgatcatttagtcagcaaacataacatgatccctgagcatggtagaagagatattcatgcccctgcaaataaagggaatctagacattgttgaaattctgcttgaaagagatgcatatcctatcccaaattccttagggatgacacaaaaagctcaagtaaaacggccaaaaaacaagagcatttgtgcccaaaaaatgagttgtgaaaatgagaagttagatgaatttagaatacagatagcagagccaaaaatccttgaccttgacaggaatggctcgaccagaaacagaagacaagatggtattagatctatcaagttcccattagagaaaacaaacacaaactccaattcaagaaattctaactgtccaagtgatagagaatcggcaaggctcaccaagaagagagtaacaatccatttgctacacagcgggagtacctcacgaggtcagcatggaaaattaataatcctgcctgattcattagaagagctgctccaaattgctggtgacaaatttggtggcttcaaccctacaaaagtaattaatacagagaatgcagagatagatgacataaatgtcatccgggatggagatcacctctttcttcagtgcagcaataatgaagatttgagttcatga

SEQ ID NO: 35072 - DNA, 180 bp, Glycine max
  Peptide Sequence Number=SeqID_126757
atgggtagtggagatggaaaaagagaattctgggatggagaagtttccgcttctgtctcattgaagacagtgggtttagcggaaggaactagttcttcacatggtaaatcagttactttgggtgatggtgttggatccgtctatgagagagtacaagatttagttactttgggtggttag

SEQ ID NO: 35073 - DNA, 573 bp, Glycine max
  Peptide Sequence Number=SeqID_126758
atggaaatattttatctcctttgctctatcgtctccacttccctcacctctcttcttctctcccttgtccttccctttcacacgctactgcagcggtggaattcctcacgcgccgcttcttccttctccgatgacgaagctgaacccatatctctctacgaaggcacagtttggcaccaacgtcgccacccagtcaaccattccttccaataccaggtccgctatgcgctcattgacctcgatcgtgcgcctcatgcgcctcacgatcatctttctctcgatgaagctcgccaaattactgataccaatgggcccattttgctcctgacaatccctcctagtgtgggttatgaacagaatcctttgagtgtgtattattgttatgctgttgaaggctctactaaaaggttgaagaagtgcattgctgaggtgacaaatacaccatggggtgaaagagtatcttttgttttcaacccacactctgatctagtggccaaggctttgcatgttagtccttttatgcttgaaatgatgttgcctgttgaggtctgggaagttccagaaaaggattaa

SEQ ID NO: 35074 - DNA, 588 bp, Glycine max
  Peptide Sequence Number=SeqID_126759
atggaagcggtgaagatggtaggtttgaggcgactgatacgacagcgttcaagtctcagagactccttagccgagaaggtccatagtccagttccctcgcagcatttggcacgcctcacccccaaacgcttcttcgatcttcatcagcttggaaataaggaagcaattgagaaggagcgcgctcgacttgcagatgaaatgactaggggatacttcgctgatatggctgagttcaaaaagcatgctggtaagattgctgtagctaataaattgataataccagcaatggtagccacaaagtttcctgattttgaagtcagcttcacagatggtaaaacaatgaagcttcctatccgtgtttctgatcgtgcagttgattctgataaatcgtctgtccccaaggcatctttggtttgtctttcatttcgagcaagctcccaggaaatgatcaattcttggagtgtgccttttactgaagcatttagaaaatcaaatgatgttcatttatatcagcacatagctgtaatatccctccctaaatgtttagcttcctgctttggaatttctgaagaaaaagatgatgagtga

SEQ ID NO: 35075 - DNA, 210 bp, Glycine max
  Peptide Sequence Number=SeqID_126760
atggaacttggaattggatcacttcaagccttaaaagtttgcaagttggaaggtcacatttcaaaatttaaggacagagaagttgctatgatgactttaactttggatctttatcccttacccaccccacctcaagtatccagtgttggaaaattaagggcagaaaatttattgatcagggcaagaaagtggttcaggagtagcaactga

SEQ ID NO: 35076 - DNA, 471 bp, Glycine max
  Peptide Sequence Number=SeqID_126761
atgattcaagcactgccatgggaggcgcagtggttcaccatgtgggaagcagcatctgcagaaaatggtgatggggtgaagaatgcaatggtgaagggactcagatcttcgatggtgaaaacagaggagtcgaagcaaggggttattcgcgtggcgaagatgattgaggtggttttgaacgatcgattggggaagaaggtgcgcgtgaagtgcaacgacgatgataccatcggcgacctgaagaagcttgtggcggctcagactggcacaagagccgacaagatccgcatccagaagtggtacaccatctacaaggatcacatcactctcaggattacgagatccatgacggcatgggtctcgaactctactacaactaaacacaacaaggtgtgttttatgcgtaatatactatgtgctgggaatgggataagcgctaaatgtaattctgacttgcgaaagttcccatga

SEQ ID NO: 35077 - DNA, 576 bp, Glycine max
  Peptide Sequence Number=SeqID_126762
atgatgaagaagaaaccgagcgcgagagagaattcgtcgtcgtcgtcgtccacggcggccagagaagaagagagcgaatgggaaatgaggcccggaggaatgctggtgcagaaaaggaccgcgaatacggatgctgctgtaacacggaatttgcgcctccgaatcgcctacggtgctctccgttacgagatctgcgtcagttccatcgccactttcggggaagtgaagaaggtgctttgtggggaaacggggttagaggtggatgaacagaaactggtgtacagaggcagagagcgagaaaatggagagtacttggacgtgtgcggagtgaaggacagatcaaaagtggtgttaatccaagacccttcaagcattgagcgacgcttcatccagatgcgtatcaactctaagatccaaacagcacatcgcgcaatcaacaatgtcgctgtccaacttgatcagctcgcggaccagttggcaaaagcattgtttacccgctactgcttcaaaacggataaggaaaccctactcaaagtctcaaactgtcttattctcaaccatgatcgtaacatttga

SEQ ID NO: 35078 - DNA, 2625 bp, Glycine max
  Peptide Sequence Number=SeqID_126763
atgagactttcttcagctggttttagtcctccaccccaggaaggggaaaatcgagttctagattcagaactttggcatgcatgtgctggtccccttgtctctttaccagcagttggaagccgcgtggtatactttccacaaggtcacagtgaacaggtggctgtgtcgaccaacaaggaagtagatgctcatatcccaaactatccaagcttgcctcctcaactcatttgtcaacttcataatatgactatgcatgctgatgcggagactgatgaagtgtacgcgcaaatgaccttgcaacctctgaatcctgttttaactaaggccgtgtttgcagcaagagcaaaaggaggcatacctgccagcggagctgggcaccccaaggcagctgaaaaagtgtttcctccattggatttctctcaacaacctcctgctcaagaattaattgcaagggatttgcatggtaatgagtggaaattcaggcatatcttccggggccagcccaaaaggcatctacttacaaccggatggagtgtctttgtgagtgctaaaagactagttgctggtgattctgtgctgtttatctggcaaaaccaactactacttggcatccgccgtgctaatcgaccacaaactgtgatgccttcttcggtgttgtcaagtgatagtatgcacttggggcttcttgctgcagcagctcatgcagctgcaacaaatagtcgtttcaccatcttctataatccacgtgctagcccttcagaatttgtcataccattagcgaagtatgttaaagctgtgtatcatactcgagtttcagttggtatgcggttcaggatgctgtttgaaacagaggagtcaagtgtgcggagatacatgggtacaataactggcattagtgacctggatcctgtccggtggcaaaactcacattggcgctccgtcaaggttggctgggatgaatccactgctggagacaggcaacctagagtgtctctttgggaaattgagccattaactacatttcctatgtatccatctccattcccccttaggcttaaacggccatggcctccaggactgccttcattccatggcatgaaggatgacgattttggcccgaattcacctctgttgtggctccgagatcctgatagagggcttccgtctcttaattttcaggggattgggattaatccttggatgcagccaagatttgatcccaccatgttgaatatgcaaacagacatgtaccaagctgcggctgttcaggacatgaggagtttagatccttccaaacagcattctgcttccttacttccatttcagcaaccacagaacttcccaaacaggactgctgctttaatgcaggcccagatgttgcagcagtcacaacctcagcagatttttggaaatactcaagagaatcaacattccccacaatctcaggctcatcttcagcaacatctacaacatcaacactcgttcaatagtcagcatcatcatcaccaccagcaacaacaacagcgacagcaacatcaagtggtagataatcaacagatttctagtgcagtctctacaatgtctcagtttgtttcagctcctcaacctcaatcaccacctatgcaagttatctcttccatgtgccaacagcaaaacttttctgattcaaacgggaacactgtgactactattgtttctcccctgcacagtatcttgggttcttttccccaggatgaaacatctcacctcctgaaccttcctagaacaagctcttggattcctgttcaaaattcaagtgggtggccctcgaagcgtgttgcagtggatcctctcctttcttccggagcctctcaatgtgttctacctcaggtggagcagctagggcagccacagagtaccatgtctcaaaatgctatttctttaccaccttttcctggtagggagtgctcaatagaccaagaagggagcaatgatccacaaaaccatctcttatttggtgttaatatagagccctcgtcccttctcatgcctaatggaatgtcaagccttaagggggtctgtggaaacaatggctcctcaaccttgccatatcaatcttctaattatctgaatactaccacacggactgattcttcattgaatcatggaatgacccccaacataggcgactcgggtttcctgcagtgtctggaagaggcaggacaaggaaacccactgaacaaaacctttgtgaaggtttataagtcagggtcctttggaaggtcattggatatcactaaattcagcagctaccatgagctgcgtggtgaactcgctcgaatgtttggccttgaaggcgagttggaggaccctgtgagatcaggctggcagcttgtatttgtagaccgagagaacgatgttcttctccttggtgatggcccctggccggaattcgtaaatagcgtatggtgcataaagatactttctcctcaggaagtgcagcagatgggcaacaatggccttgagctgttgaactcgtttccaattcaaaggctctctaatggcatctgtgatgactatgtgagccgtcaagacccaagaaatttaggcactgggataacaaccgtggggtctttagactactaa

SEQ ID NO: 35079 - DNA, 354 bp, Glycine max
  Peptide Sequence Number=SeqID_126764
atggctcttgcaatggttatgcacagcttttgtccgcatgacaattgtgttcctctttctccaatagccattgcaagagccatgttgaaagacctaaaatccttttgcttgatgaggaaattagtgcacttgatgctgagtcagagcgcatatacaattcaagaggctctagataaagttagtgtggacataacaactatttttttatcaacaaatgttagtttgttagaatctcaccgtcttacaacagttacagtcagagatgctgatatcgtagcaagggtccagggtgtttggaaagctacgaaggataggatcccatctaaaatgaatatggtccgcaggaagatgtga

SEQ ID NO: 35080 - DNA, 774 bp, Glycine max
  Peptide Sequence Number=SeqID_126765
atggccatgacatgtgaaagctcaattgtttcccctcttttcctgtcacgaatatgtcaggctaagacagacccaacaagagcctttctgttggagaataaattctcaacaattacagtaaccgcctcgccaagacaagttgtatccgctgcacggttgtgcaatccaaatttggccacaaaggtggtagtcccatggagaagaagtagaaaagggaagaagacaacaggaaagaaagagcaccacttgtggaaaagtagagattctgctcagtctggccaaaaggcacttgctcttgttaggactattatggaggtgcagatgaatgtggagaagctggtttataaactccctaatgagaaagaggctgtttatggggcattagacaaatggacagcttgggaaacagagttcccagtgattgcagtgtctaaggctttaaaaatcttaaggaaaaggggtcactgggttcgtgcaattcaagtagctaagtggatgataagcaaaggccaaggagcaacgatgggaacatatgacacccttcttctggcatttgatatggacaagagggtatttgcagacatggaggagttgcgggtaaaacctgatgaagatacggtcaggagagtggcaagagcctttagagaactaggtgaagaagagaagtggaaactggttataaaacgatatgggcttaaatggaagtacattcactttaatggtgaacggggatattccttacactgggtcaacctaatgagcctgacaaattga

SEQ ID NO: 35081 - DNA, 2283 bp, Glycine max
  Peptide Sequence Number=SeqID_126766
atggcaattaagagcatcattcccgcaacttatttcctactctttctccacctactccttcccttagcttcatgcatcaaaacaaagcaggtttatgtagttgagttgtttggagatcacactagtgatgacaaaacactgcatgaagttgagaatagccatcactcttatttgctttcggtgaaagaaactgaggaggaagcccgagcttcccttctttatagttacaagcacagtatcaatggctttgcagcattgcttaccccaaaagaagctagtaagctctcagtggtctttgtgcataagaaccagccaaagatctactctttgcacaccacaagatcatggaatttcgtggggttagatgggcctttaaatccttgggaagaagaatccgatcacacagatggaaacttgctagccagagcacaatatgggaaagacatcatagtaggaatgattgatagtggtgtgtggccagactcaaagagcttcagtgatgaagggatggagccagttccaacaaaatggaaaggagtgtgccaaaatggaactgctttcgattcgtctcaatgtaatagaaagatcattggagcacgttactacttgcatggttaccaaagtgcatttggccctcttaacgaaaaagaagactacaaatcagcacgtgacaaagatggtcacggaagccacacagcttcaatagttgcagggcgtgtagttccaaatgcctcagccattggaggcttcgccaagggcacagccttaggaggagcccctttggcccgtctcgccatatacaaagcatgttggccaataaagggaaagtcaaaacacgaagggaacatatgcacaaacattgacatgcttaaagcaatagatgatgccattggtgatggagttgatgttctaagcatttccatagggttcagtgcaccaatttcatatgaagaggatgtgattgctaggggtgcgttgcatgctgtgaggaagaacattgtggttgtgtgtagtgctggcaactctggccctttgcctcagactttgtcaaaccctgctccatggatcatcactgttgctgctagcactgtggaccgttcttttcatgctccaattaagctcagcaatggaacaattattgagggtcgatctattactccactccacatgggaaacagcttctacccattggttctagctagagatgttgaacatccaggcttgcctagtaacaattctgggttttgcctagacaatacccttcaacccaacaaggcaagggggaagatagttctctgcatgagagggcaaggagaaagactgaaaaaaggcttagaagttcaaagggcagccactggggtgtcctatgagaattccttaaaacttattcaatatgttcattctactccaaatccaatggcacaaattctaccaggaacaacagtgttagaaaccaaaccagcaccctccatggcctccttctctagcaggggtccaaatatagttgaccccaatattctgaagcctgacattacagccccaggagtagacatattggcagcatggaccgctgaagatggccccacaagaatgacatttaacgacaaacgagtggttaaatacaacatcttctctggaacttcaatgtcatgccctcatgttgctgctgcagctgttcttctcaaagccatacaccctacatggagcactgctgctataagatctgccctgatgactacagccatgacaacagacaacacaggtcatccattgactgatgaaactggaaatccggcgacgcctttcgcaatggggtctggccacttcaaccccaaaagagcagcagatcctggactggtttatgatgcctcctacatgggctaccttctttacacttgtaaccttggagtaactcaaaactttaacattacatataactgtccaaagtcatttcttgaaccctttgagctcaactatccatccatacaaatccatagactctattacactaagactataaagaggacagtcaccaatgttggtaggggcaggagtgtttacaagtttagtgccgtgtcaccaaaggaatactccatcacagccactccaaacattctgaaatttaatcatgttgggcagaaaattaacttcgccatcacagtgacagcaaattggagtcagataccaaccaagcatggcccagataagtactattttggatggtatgcatggactcaccaacatcacattgtaagaagcccggtggcagtgtcttttccataa

SEQ ID NO: 35082 - DNA, 837 bp, Glycine max
  Peptide Sequence Number=SeqID_126767
atgacaacacagtctctctacaatcagccacgtaagcatccatgcatgtctacgtggaaccaaaacctcaacccacgttctccatcttcggcttatatatatgactcacacgcttcagagaagataactgagtcaatcttgcaacgattaacaatggcttcaaccgacaagtcaccggacccaacgccggcgaagggtccggatccaactccggggaagccgatgagtgttggtcagcacgtgatcgacaagagtgcaatgatggtgcagtcgctggaccccattaagcagatgagtcagcacgtgtgctccttcgctatctacagccatgacatgtctcgccagatagagacacatcactactgctccagactccaccagaacttcatacaatgtgctgtctatgattccgatgaatccaaagctcgtctcctcggggtggagtacatcgttcctgctgatgtctttgaagcctttcctccggaggagcagaaactttggcattctcatgcttatgaggttgacagagaattacatgtgttctcaagagggaaagtatttgtgaaaaatggaaatgcaggggataggcttcctatgggtgcacctgccctgatgatgtctccacaagcagcgagtcctggtttggtgagggcagaactggtgcttgagagggatgccaagtacaatttttcctcaaagagcctgaaaagctcaagattggagattcctgagccagagatgatcaaccccttggctgattattggaagcaacatggcaaaggatttgtcattgacatcgaggagactgagatgaagttgaggccaccttttccttga

SEQ ID NO: 35083 - DNA, 1722 bp, Glycine max
  Peptide Sequence Number=SeqID_126768
atggaaaacccaacttcagattctctctctgccactcttggcaactcaatccaagctctgggtcgtggctttgatgtcacatcggatattaggcttctatactgcaagggtgctcctggctcaaggcttgttcacgttgatgaggatcacaccaagaaccttcttctttcgcatgacctcgttattcccaatgtctctatggatgttgattggtcacctgggaaggatggtatagagacgacccctgtgtatagtttccacgagatggcgaaatatttcaatgagaggtcaggcataacaggacatattccactgggaagcttcaattccatgttcaattttactgggtgctggatggctgatgcagcagccaccaaatcccttgccatggttggatatttcattcctctggttgaagttaaactaaacaaactaaatttggtcttgactgatgaagtaaagcacgctgttccttactcttgggatccaacatccttggctagttttattgagaattatggtacccatattgttacatctgcaactgttggtggaagagacgtagtgtacatcaggcagcaccaatcatcttctttgtctgcttcagacattgagacctatgtaaaggacattggagatgataggtttcacaacgttaaacacttttcgggtcctggtcctttaaagtataaggagaaggatgttactgtcatatttaggaggagaggaggggatgatcttgagcaaagtcatactaaatgggtggaaactgtaaaattggcacctgatgtcattaacatgaactttacacccattgtttctcttcttgaaggagtgcctggcataaaacatttggctcgtgctattgatctatatctgcagtgctcaatgaaccagaaaactgagggcaagtcttggcgcaatgacaaaccacctatcgaagacctacagtatttcttggatttccaaataactcaagtttgggcaccagagcaaaataatctacaaagaaaggaacctgtctgtcagtctcttcagttcagcttgatgggacctaagctttttgtcagtccagatcaggtaacagttggacgcaagcctgtcactggacttaggcttagcctagagggcagcaaacagaatcgacttgctattcatttgcagcatttagtctccctcccgaagaaccttcaacctcactgggacacacacatggccataggtgctcccaagtggcatggtcccgaggagcaagacagccgttggtttgaaccaatcaagtggaagaacttctcccatgtaagcactgcaccaattgagtacaccgaaactagcattggggacctgtccggtgttcacattgtcacaggtgcccagcttggtgtttgggactttggtgccaaaaatgtgttacacctcaagctccttttctctaaggtaccgggatgtacaatacggcggtccgtgtgggatcacaatccctccgctcctgttgctcagagaccagatggtgcttcatcatcattgatgaagaaaacctccgaagataaaaaggaagatagttcaatccacattggaaaactggcaaaaattgtggacatgacagaaatgtccaaaggcccccaagatattcctggtcattggttggttaccggggctaagcttggagttgaaaaaggaaaaattgtgctgcggataaaatactctttgcttaactattga

SEQ ID NO: 35084 - DNA, 264 bp, Glycine max
  Peptide Sequence Number=SeqID_126769
atggagattcctaagaatcgaaagtggatgtatcaaaggttggatggacatgtttcaaatgcaaggagaacaaacaaggtgtccctgcaagaaatgcaatgtaaagttttcaagtttgtggatgatgtgatgagggatctttataaggaagggttcatgccaatttattattggtggacaaaccacggtgaaaagttaccacaatttcctccaatagtgttgcaaggttcatactacgaaagtggtaggcaaggaaataattga

SEQ ID NO: 35085 - DNA, 423 bp, Glycine max
  Peptide Sequence Number=SeqID_126770
acaataaagggaagcaccttggcggattatctagctcaacaacccatcaatgattatcagcctatgcatccaaaattcgctgatgaggatatcatgaccttgtttgaggaggaggtcaaagatgaggacaaagataagtggattgtgtggtttgatgcgatcgactttagggtcaagttactcaaggtatacggggactccgcattggtgattcatcagttgaaagaaaatagagtcaatgaccgtggagaagaaaaagaaggattaggtggtattggtgggtcaccggatgtgtcgtggcgacgttgtcctgcagcagtggttgtggaggatgagtcctttctctgctttgatggttctgccttgtatttggctttggatattttagcacttggttcctttgtgcttgctttagatacttag

SEQ ID NO: 35086 - DNA, 204 bp, Glycine max
  Peptide Sequence Number=SeqID_126771
atgactcgctcagtgaggcagatccgctcagcgagtggcatccacgaagtaaggcatacagctcgcttagtgggttgggaaaccctagatgaggatcaatcagagatgtgctcgctcaacgcgcaaccagcccgcccagcgaggtcattgtctcttctcacacttagcacgcccagtctcgctgagcaagccttcgaaagttga

SEQ ID NO: 35087 - DNA, 957 bp, Glycine max
  Peptide Sequence Number=SeqID_126772
atgcctacaacatccacacataggcaacaggaagttgcccctgttgctgaggatgatcttgtgcttactaaagatgtacatgcacatgctgaagaagctattgatgatgctgagggatttccaggtgggccgcgtgacctatcagtgttgactgactatggtgaccatgttgcagtcatcgtatggaatgatgaggaacgtcctgaattgaagttatcctcccatggaaggaaggttctgaaatttgggaggcctgctccagaaattgaagggctagtcgctatcacaggattaagtcctttgatcgcatgttcagtagacactggcgatcgaggacttatatccacttttgtcgagaggtggcataaggaaactagcagttttcatcttcctgttggagagctgaccatcaccctagatgatgtgtctctagagaggaagctagagctgagacaacataatgtcatggggcatacgtatgcctatcgtggctatgagatatttatcagagtagatacgtttttcgagactttagtcagagtggagctatgcatagagagctttcgccctagtgcatatgtcatctacgatggggtcccattgtcgtcagacaccgaccagagagggtggtgcggcaatttggatatgttcagaccttcctccattaactacgggttccatgatgacacatatgtggagccacatatccctgaggtcctagtggcaccagcagcagcaccggcatatgccccttctgatgtggagcagcccagacatgtagtggcttgccaaacaattgcagaaaggttggaacgtttggttaacctaaggatagtcactgcaggcacaaaaatacacgaggtcatggaagacaacataaggatcgctaggggtgtcacaccagatggcaatgtttatgtcaggtcgcgacaaaggcgacgcacggatcagccatag

SEQ ID NO: 35088 - DNA, 222 bp, Glycine max
  Peptide Sequence Number=SeqID_126773
atgaagataatatgcagtaatttccaaggcaaggacaatgcacctccacctccacctcaatggattgaggctaaggtcagcgttcaacatcttccttcttgggtccttcactccgccgcaaccttcttgttagctctttggcaagtgtaccaaatcgctcgtagtaataatttatcggtaagccaaatgtcgtaccacagagattttgttgcacttatgtga

SEQ ID NO: 35089 - DNA, 2604 bp, Glycine max
  Peptide Sequence Number=SeqID_126774
atggaggggatgaacttcagttctttatacaatcctcaacttgcctctagctctaagaaaagttacagtaagcaagagtataatcattcaggggagcatcatcatctcaatgaagaaggttatatgtctccctctttcaatctgcggaatatttcaaagctcattcttcccccactgggtgtttcaagccagaatccagttaactcaaaaggatggatcatatcaccaatggattccagatacaggtgttgggagagttttatggttcttctggtagcttattctgcatgggtgtatccctttgaagttgctttcatgcacaagtcttctaatatgaaaatctacattgcggacagtgttgttgatcttttcttcggtattgatattgttttgacattcttcgtggcttacattgatcgaaccactcatctactagttcgagacaagaagaagattgtagtgagatacttgtctacatggttcgtgatggatttggcatcaactataccatacgaggcaattggatatttgttcactggcaaacggaaattgggtctcccatacttcctcttgggtctgtttagattttggagaatcagacgggtcaagcaatacttcacaaggcttgagaaagacatcaggttcagctatttctgggtccgatgtgctaggcttctttctgtaacacttttttcaattcattgtgctggttgtctctattacatgctagctgatcgttacccccaccaaggaaagacatggattggagctgtgaacccaaacttccgagagacaagccttcggatcagatacatttcggccatgtactggtccatcactaccatgaccactgtaggttatggtgacctccacgccgtcaacaccctagaaatgatcttcattattttctacatgctctttaaccttggcctaacagcttacttgattggtaacatgacaaatcttgttgttgaaggaactcgccgtaccatggagtttttcagattcttgacaacttggaatccatctaggtttcttggaatgctgccagagttatatgttattgtgactaatgtcccatgtaacttcatgtcattatctgtgcagagaaatagcattgaagcagcatcaaatttcgtgagccgaaatcggttgcctccaaggttaaaagagcagatcttggcttatatgtgcttaagatttaaggcagagaacttgaatcagcatcagcttattgaacagcttccgaaatcgatttgcaaaagcatctgccagcatttgttttttgcaactgtagagaaagtctatcttttcaaagacgtctcaaaagaaattcttttgtccctggttgcaaaaatgaaggcagaatacataccaccaagagaggatgttatcatgcaaaatgaagcaccagatgatatttacattatagtctctggcgaagtggagatcatccatactgaaatggagagagaaagaattttggggactctacatactggggacatgtttggagaggttggtgcacttattagtagacctcagagctttacctacagaaccaagactctaacacagctcctgagactcaaaaccaatactcttatggaagcaatgcagattaaaagagaagacagacaaatactcaaaaattttcttcagcatatcaagcagcttaaggatctgagtatcaaagatttgatggtggagaatgtggaagaagaggaccctaacatggctgtgaacttgttaactgtggctagcactggcaatgctgcttttcttgaggagcttctaagagcaggtttggatcctgacattggagactccaaagggaaaactccattgcacatagcagcatcaaaagggcatgaagagtgtgttaaagtcttactcaagcatgcatgcaacatgcatataaaagacatgaatggtaacactgcaatatgggatgctatagcatcaaaacattactccatattccggatcctcttccagctttctgctgtctctgatcctaacacagcgggcgatctcctgtgtacagcagcaaaaagaaatgaactaacagtgttgaccgatcttctaaagcaaggactaaacgttgactccaaagatcaccatgatacaactgcaatccaaattgccatggcagaaaatcatgtggacatggttcatttgcttgtcatgaatggtgcagatgtctctgatgtgcataaccatgaattttgttcatccaccttagatgaaatgctgcagaagcgtgaaattgggcatctaattaatgtaactgaggtcatgcgcagtggagttgtattaaaggggaaacatcaagaacaggagctcaatggaggaagatctaatggactaaagtttccaagggtaagcatatatagaggtcaccctgtagttagaagagaaaaaggttcggtggaagctgggaagctaataaggttgcctgattcattagaggaactcaaaactattgcaggtgaaaaatttgggtttgatgcaaaagatgcaatggtgacaaatgaagaaggagcagaaatagattccattgatgtgatcagagataatgacaaacttttttttgttgaataa

SEQ ID NO: 35090 - DNA, 663 bp, Glycine max
  Peptide Sequence Number=SeqID_126775
atgcgtgcagtcactcttgatggaaaatcgattgatgaatatttgcgcaagatcaaaggatacgtagatgaactggctggtgtaggtgttcttgttcgtcatgaggagtatattgatacgctccttgaagaattaccgtctgattatgcaccgataatctttgtcattgagagtaagaagcacacttcgtcaattgcagaaatcgaagctcttctctatgtaattctggtggctctcaaggctcgtatggttgtggcgatggtcgtggttaatctcaatgctaagtccactgttcctggtcccagccaacccaatgccaaactcacaaactcctcctctcatggtaatggtgcatctggctccacctggataccagattttggagccaattttcatgttactggctccttagtttttgtttctcctaatgatactgccataacctttcagcttaataaattgttacatgttccttcaatctcgaaaaacctgttaagtgtgagtcaatttgctaaagacaactctattttctttgagtttcaccctcatttatgtcttgtgaatctcaggagaccaataaaattctcctacaaggagtggttggttcttatggactctattcttttcacaacctcaagcttcaaggcaatccttctctactaa

SEQ ID NO: 35091 - DNA, 2316 bp, Glycine max
  Peptide Sequence Number=SeqID_126776
atgaggcatggtgaagccaattcgggccagggtcccaaggtcaatttgttgcagcatgccaatgctcttgagaatttctcctcccaagccaaatttttgagctccacttttctgttttctgtcccacctaagaagccacaccacgaacaaccaaaccccgggtttgtatttcgacgaagtgaaactattcaaggttcacagagagtacaggtcgagaaggctttggctgctcattcaagtctacaaaattctagtaggaactatgtccaaccaggaaaaactcaggttactcctcagcttcatgaagataggagaacaacttccttccatggaggctatgagaatggcaaccatagatgtcctgatgttgctgcaactccaattgttaacaatcataattctcggggtttggatggttcggtaaacaatcatactaattacacaggccaaatcaacaagtcttccaactgcatggctgtagatattgatgatgatgattctctctttaagaacattgatgttgaccaaattgttgaggactattgcactcccaaaccatcaatatccaagcttcctcctataacaccaactgccgataaagataattttgctagacagggggatgatgttttgccaccggaactgtgtttagattgcgtgcatgggtacatgttagggttttgccctgaagcagctagccatttgcaggatatgaaggataatctaattgcaatctttaatgagctgcttgacaatggtgaaaacctcaattctacacagatagcaaagcttcgccatgataggtcacagctcaataagcaaattcagcagcttgaaaaatatattcattctggtaatcttaatgaggaaaggcaaaagtcacatttttctgcatccacggcaccacctacatcttttgtgtatgaaacacctcagcaaactgtcctctgtaatggatctaagagatatgatactgaggcttatatgggtaatgggacatatgggtcgtcgttccagtctcttccacctttttctgtagataattgtagcatgccatcaggttccgtggggagggaagtgttcatcccaaagattattgaagttaattacattgaaggttctggagacaaacgctggagcagctacgatttttcttggacaaaagagttagaggttaataataaaaaagtatttggaaatcactcatttcgccccaatcaaagagagatcattaatgcctcaatgagtggatgcgatgtttttgttctgatgcccactggtggtggaaagagtctgacatatcaggcaaatataccggctgcttacttaagtgccaatatggaatggactgaacagcaggacatcctccgagaacttaattctgattattgtaaatacaagttattatatgttacacctgaaaaggttgccagaagtgataatcttctgcgacacttggacaatttacattttcgtgaattgcttgcaaggatcgtaattgatgaggctcactgtgtgagccaatgggggcatgattttagaccagattatcagggacttggtatattgaaacagaaattcccaaatactcctgttttagcattaacagctacagcaacagctagtgtaaaagaagatgtcgtacaagcacttggtcttgttaactgcatcatttttcggcaaagttttaatcgcccaaacttaaggtattctgttatccccaagaccaaaaagtgtttagaggacattgacaaattcattagggagaatcattttgatgaatgtggcattgtctattgtctttcacgaatggactgtgaaaaggtagctgaaaaattacagggtagctttgctattcttagccggtcccaagcccggataaaaggagagggttgtgttaggctttcgacagccaacgttaaactttgtcgaatctctatgacatggatcaattacgtaataattacagtgtcaaaagagcaagggccgctgcatcgccgcccggatgtagtgaaaagtaagcaagggttcccacattttcgtgaacgggtgtgggtaaagaagctagttcatgacaggaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaattagatcaagaaatggggtagggattattgtggacaaggagtggaagaaggatgtcgtggat

SEQ ID NO: 35092 - DNA, 337 bp, Glycine max
  Peptide Sequence Number=SeqID_126777
cacttcttccggaaagttcccggaagacgttttccggaagtcttccggaagaagtgttcttccggaagacgtttggttacttccggaagaacacttcttccggaaactttccggaaaaggttcttccggaacttccggaagaacccctaacgggttccacgctgaatcaatactggatagtaaaagcaatggagagttagggagactaacctcgaaggctgttcgcggagaagacggagaagaagaagaagcttggctcgtggtgtccggaagaagacgaaagcttggctcgcggtgtcacggaggatcaacaggaatggaagaagaaaagaagtag

SEQ ID NO: 35093 - DNA, 552 bp, Glycine max
  Peptide Sequence Number=SeqID_126778
gaaaaatatcaacatcgtcgaaatgaaatcttacaacattcgacagaggaagacacatctacacaggatttccctaacactgctacttctgttaatgataatgaaatatatttgaatgttgttggaggtccaaattacaaggggaacgtgtacgggctaggtactttaagcaaaaagtttagttgctcaaaatcaactccatctacttttattgctcttgtggaagaccaaatagaggaaatgcgtgagacaattaataaattgaatgctgagcttttggcaaaggcaaataaggagaagacacttgaggaaaagatattgcagctgatggagaatcatgaccaccaaagtcaggagatgcgacaacagatgcaagaacaaaatgagcaaattcgtcaacaaaatgagcaaatgcagcgcatattacaacacttgcatattcagtctatcatgccaactcctagtctatcggctaccatagcagatggaactgagcaccatgttaatgatgctcaggttgatcgtcctcatgacatgggaaatgatcgttga

SEQ ID NO: 35094 - DNA, 468 bp, Glycine max
  Peptide Sequence Number=SeqID_126779
atgatagatggtttgatgttgagtggaaaattgggtatcggaaaaacactagtttttgggaggatgcttggtgtgggggaggagagtttaaatcatgtatttgcccgaatgtttttaaattcagaacaaaaacatgaagtcgtgggagacttgggagcttgggaaaatgagatatggaaatggaagttttcttggaggagaccatggtttgattgggaaagggacagggtcattgagtttgagaggttgttggagggtgtagagtgtcacgacccactcttgggacatgaccggcgcacaaactataacttctttagtctgctgcattatactagagttacaaccaaaatatccatcagacacaatggggacctaccaaaaaaagataatcaagttcctgggtgtgtcagcaaatcccaggaaatcggttactccactactgggtatctgagaaaagaagtaaaataa

SEQ ID NO: 35095 - DNA, 150 bp, Glycine max
  Peptide Sequence Number=SeqID_126780
atgggggcacctaatcatctgacatcggagcaaccgccaaatgaaggtaacagcctccagtctctaaggagcaaaacaaacagaaaactacacggctatagtgttgtagatacgcaccatcaggcagaaaccggcaggcagagaatgtaa

SEQ ID NO: 35096 - DNA, 435 bp, Glycine max
  Peptide Sequence Number=SeqID_126781
atgtatgttttggtggtgtcggcaagagaccaggtttgggtgacgaagggggaacccgaggagggggcggacctgaaatgggccaaggttgtagcctacaccatagtcaaaggttgtgaagcttggacctcctgccgaatttccggtgccaaagtaaaaacaaaacaactcaataagaaggttggtggaagaccaacgattcgattggcaagggattcaaattcagagagatactcaatgacaatgcccttttgtgttagcttgaatagggtgccgagccggtccttccatataaaaagaagcaatcgtaagatggtcacatttcgatgtgtcgtggtaagcgaaaaattggttgatcttgaagatccaaccaaagggatcggaaccgtcaaaccgcggtacttccaacttcatacgaagagaggaaggggatga

SEQ ID NO: 35097 - DNA, 219 bp, Glycine max
  Peptide Sequence Number=SeqID_126782
atggtttctaggcttgcagctggtgtctcgctaagcgaggcttgtgcgcttagcgagaatcatgcaataagcgaggcactcaacccgcttagcaagttgggagaatctgagaagcatctgcgcgctcagcgcgtcatcagctcgctcaatgagacgtttgtctcttcctgcgctaagtgtgcccagctcgctcagcggatattcactaactcgcgctaa

SEQ ID NO: 35098 - DNA, 361 bp, Glycine max
  Peptide Sequence Number=SeqID_126783
gtgatttggttgatttggacatggagattgaagctacttgcagaagaaacaacacagaaagttttccagaaacaagggaatccaaaactgcagtgcctgaagccgacataatggatgaagagcaacctagaagagtaacccttaaagactactcaagttctattgtgccgcagtttttcactagcattgtgcggccagaggttcaagcgcataatattacctatcctcattcactaattcagctgatacagggtaacctattccatggtttgcccaatgaagacccgtatgcacatctagccacttacattgaaatttgtaatacagtcagaattgttggtgtgctggaagatgctgttag

SEQ ID NO: 35099 - DNA, 486 bp, Glycine max
  Peptide Sequence Number=SeqID_126784
atggatgctctacaacataggaactgggctggagctggagaaggagtaggagcagaggatgcaggagcaggagaagcagctgaagatggaccgtcagatcctcgagcctgtgccttgcgggtccctggaaatttgatcatgggatcgtccaggttccagcagttcttctttatgtatgccaaattaatggcagggatgagggactcaaaggtcaaagaatatgagactactcctcgggccacgcagagtgaagaaatgagggttggaaagccgagactcgaggaggtcatacaggttcgagtaaaactccttgaccagggccacatcaatgtgctcgtccatgaactgggtcaaggccttatgtcagttctgcctgatcagctcacggcggaattcgtcatattttgtgatgaaaagattaacattcctcttcggaaggatgttccgggagtgaatattctgagtaacgttcccaggcctctttag

SEQ ID NO: 35100 - DNA, 1305 bp, Glycine max
  Peptide Sequence Number=SeqID_126785
atggaactatcagatttgcaaaacaagaagcagagcagcagcagcagcagcacaggtgctactcatcaacaacaacaacaacaacaacaatcctcttctacccatcttgttgtgccttccccttccaattcttccgcatccctcatcgacgcctccttagccatcgccaccagatctgatgattcgaccaagaagacccaacaaccctccaccaacaccaagcgatccaccaaggacaggcacaccaaagtcgacggccgcggccgcagaattcgaatgcccgccacctgcgccgctagggttttccagttgacaagagaattgggccacaagtccgacggcgaaactatcgaatggctcctccagcaggccgagcccgccatcatcgccgccaccggaaccggaaccatccccgccaatttctccaccctcaacgtctccttacgcagcagcggctccacgctctcggcgccgccctccaaatcagccccgcacacctttcatggcgccctcgcactcgctcaccacccttacgacgaagcctttcaacaccccgctcttcttggcttccaccctcaccatcaccagcagcagcttctctccgccgatcaaatcgcagaagcgcttcccagcgctggcggcggtgactccggcggcaactaccttagaaagcgctaccgagaagatctcttcaaagacgataacatcaacaatacccaatctcagaacgatagcggtgatgctgatggtgatgctgatggtgatgggtcttcgcctaagttacccaaggaagctgggtctgggcttcttcggcccaccaatttgcttcccgcaacagcgatgtgggctagtggaccccctggaagcacaatttggatgcttcccgtaaccgccgcggcggcttcttcttcttcttcatcttcttctgcttcgtctgcggcaagttcggagagtcagatgtgggcgtttcctcagagtgtgagtggtttcatgccgaggttcaaccttccggttccgggtgcgcttgaattccaaggcgcacgtgcgggttctcttcaattgggcccctccatgttaatgccgccgccgccgctgccgccgcaacagcaacagcagccctctcagcatctgggccttgccatgtccgactccaacttgggcatgttggcagcccttaatgcttacgctagggctggtttgaatattaattcagaccatcatcatcatcatcatcatcatcatcatcatcaacatcaatctcaacctagtgagagtggagaagatgctcctaatagctcccaatga

SEQ ID NO: 35101 - DNA, 1323 bp, Glycine max
  Peptide Sequence Number=SeqID_126786
atggaggcccgaaacacatatgtttcacatgagatgcagagagtgtacgattactcttcaagacaattgttgggagttagaccacaagaaggtgaacttcaaggcagtgtggtcaaattaagttggctggctcaccatttttcacaaataaatattcatgacggtaacgtagaacaactacaaaggtttactcgtgcatggatcctcagattcataggaggtgttctatttgttgacaaaagcagcagtaaagtttccctaaggtacctccaatttttacgtgactttgaacagtgcagcacgtggctgcaacgtggaaaccaacatattggcaatgatgatctgatagtttttcgtcgcaaattagatatcatgaaacgacatgagtttctgtgggagccttacacaacaattgttatgtcgacgttgcctccaatttgtttggttgatagtgtacctattcccaagtgtccttcgcaaccactgaatatccatggcctaatgctgaaaggaaaacaagatgaaaattggtttcagctgttggcctcaatgatcagtcaatggaacaatcgagctgggtttagggtcgacatttatcctcgacaggaggacctattgagttttaactccgattacatggtctggtataggcgaaaaacaaagatgtttgtcgacccaaagaatgcaaacacagctacattgtatatggtgtcaccacaagggaggaacacatggacagttgatgatctcgtgccttatgtggagaagataacgattttatccgaagagcaagagaggatcactgagtctgtggcacaacagtttcacatgcttcagtcaagtgttgaaactcggggttttgatagacgaatggaggttgttgaagcggaagatttttcccaacaaatggagcagcgtggccatggaatgtattacacggcaccaacattttctcaatatccttcgcagatgtatcagtatcctttcgaaggtcatgacactgatatgtctgcaagcgaacattcatttggtggtgttgcggaaacacatcctcatttttcatggccgactatgaccccttcgcagcaacatgatgccccgatggcaacacctaacgcaccattagctccgcaatggaatgtacccggagcaatacatgatatgggtgacttattaggtgttgatttgcatcacaagttttctgctgaggctgatcaagaagggcggagacagcgcgcaagaagaaatgctgatcgtcaagcccgaaggtgggatcgaccatgtggcacatcctcacgccatcacggacatcataatgaatga

SEQ ID NO: 35102 - DNA, 132 bp, Glycine max
  Peptide Sequence Number=SeqID_126787
atgttaacattacaacttatatttttcttatcatacttttatggggatagctcaagcgacgcaccagaatcattagtaaagaaaattacattggcctttgtctccgctatggagtgtagaggggcatgctag

SEQ ID NO: 35103 - DNA, 405 bp, Glycine max
  Peptide Sequence Number=SeqID_126788
atgtgtctttttgggttattctcgtcttcaaaagggttacaaatgctactctccaatcacaagacgatattatatgtctgtagatgtaacctttttgaagacacacctttcttctcatcctttgttgatcattcttcttctctccaggaagtactgccaattccttgtcctttaggtaactccgaccaaaatgtcaatgaagtcccatcttctctaccaaattcaattgaagttgtctctccacctctgcttacatatcatcacagggcacgaccagctgattctacaattcccgaagtctcccctcgtgattctcatccttctccaactagtcctccaaccatggatcctgcttcctcacctgtctctcatcactctgagtcagcctggcccattgccatctga

SEQ ID NO: 35104 - DNA, 996 bp, Glycine max
  Peptide Sequence Number=SeqID_126789
atggcaaatccaattctctcctttctcttgttggccctcctctgcatcctcgccttggctcacgccgattcccatttcgaaggctttgaagccgaagacgatgacgacctcgaagactcttccatcgatcccgcctctctccgatcaccgcccctctccgaccctactcccctcaccaccgatcccaccccccaacctcctgcttcagatctccccaaatcccctcccgccaccaccttcgatttctgggacgacgaagaattcgaaggcgtccccgtcgaacaccccgcccccgagcctccctccgatcccaaatcccccgaaaactccaccaccactcaaacccctccaaccctcacccctccgcgctccttcaccgtagagatcgtctgcggaagctttcttattatgttcgcaatcaactacttcactgggaagcgcgagaacgagaacatcgcgctatcgtgggcggcgcagttcgcggcgaaggattcgatcttcgagaagaatttcagcctcttggggatcggcgacgggggcgaggaggcgccactgctgctgaaggaagggcagacgacgttcaagttctacgcgagcgggagaaggtactgccagggtttgctggccactctggagttgaagagcagacacgatctcatcgccaggatctacaatatgatcgttccctgcagggacgagatcgccttcgaggtctacatgaacgacgacgccatggatcatgtcgttttcgccatggccaagaagaaggccgccaaggccatgcataaggatgtcagggatttgcagaggttcgctacccttctctcccctcccactgccactgcctctgcccgtaagtgggtcgctgatgacctcgctgtcatttctgagtccaaagaggtcgctaatgatttcatcactgatgccgtcattgatcaggaccaagattctctgggactgacatggggccaaatgatacccctagggccccaataa

SEQ ID NO: 35105 - DNA, 522 bp, Glycine max
  Peptide Sequence Number=SeqID_126790
atggatgattttagtgagcctagggatcaagagttgtttcatcacaacaatgaccaaagcgatggcgagggtgttgttgtaccaacgtcaactccatcacctttgttgcaatatcaccaacctaggtgtccagtggagttgaaccttgaacacctaccacaatacattgatcaacattatttcgttcagcagcaacaagatcgtgtacaaccaccaatcggtgcactcgatgttggcattattcgagcagagatgtacttcaagaccgcaaaacttgttgctattagaggccgacaaactaaggcaatgatcaattttggctcacagtattccatcattgttaacaaattcgacagacacaatcacacatttattgtaacagagacccaagccccacttcaaacacctaaaccacctggaaggtttagggtatgttataatcccaaaattgtgattatggtgaatatgaggcttaacacatttaccgtcactactctaaatctatcaatgttgatcccatga

SEQ ID NO: 35106 - DNA, 942 bp, Glycine max
  Peptide Sequence Number=SeqID_126791
atggaaggttcagttaatattggtattagaaaaaaaggtttattagatggtgatgaggtggcgtcgtggtcaggctttgaaaagtggagccattcagatatagttgccatgaggggaggctcaacccaccttaatgattttcagaaactagggaagggtctgggctatctacatttcacaaaggagaaacaaacaaggccaccgatttggcttcgtacgattcatcaaagtacaaaacaagatgttcctgttggagtagatagaatggaggaggaagatgggctatggaagaaggattgtttatgcaaaacatgggaaagggtagactccatggactcacactcatccatggttggcgaaagggaagggccaacaacatctcagtttgaggaagataaaaggaaaaacgctttgtccgatggtcatagttttggaccagcaactcaaaaaatagcatgtcctgttggtgagtatggtgagacccatggtgtggtggtcaacaagaagaaaggaaaggcaatagaaacattaactcaaacatggtgtagcaggtgtcactctctacccaaagcatacaatttgggttatggaacaaggaagttagttggtaatggatcctttgaattgggcctttattaccatgtggaaaacaacatgggccaaccaccttttggagaatgttttgcttacaaagaagagcaggtgcaactagaaaatacttcacaggggaggatatatgattttggacccgaacctataacagacttacaactacaagccaaggtcgatgatatttctcatgagcatggttcaaccttacaaagcagtaataagacaacatcaggggaacataaacacaacaaaggaagcgcattgttacaagtttcatggaattggatagaagggatattgaggcaatggaaggaccaagcaggaagctga

SEQ ID NO: 35107 - DNA, 876 bp, Glycine max
  Peptide Sequence Number=SeqID_126792
atggacttgaaggaaaattttacttatgccatgcacaattttagggtcatcaagaatgatggccaatacaaagtttgtgatcacgcatataaattggcgtttactggagctatcgttgctaggcagtgtgaattggatgacatcattggtgtggttgatgaggttgtcttttgccatgtttcatcaaggagtagtagggttgtttttaaacttagggacttgagtgaccaattgttgtcttgcactctatgggacgattattgccttcaattcttggaatacttagatgagcatgagagtgaaagccccattattgtgttgttgaccaatgcaagaattaaggaaggccagggatcctatccaccatcagttagcaattctttgaaggcttcgaagttagctattaatgaactggtagtccagatccaagaattcaatcagaggctttcaaaattgggcattgaggtccagtcggttttggcacgttgtggccaaggaagctctcaactttcaggttctacccaattatcatcaaaggaaacatttatttcaaagtatagagttgaggtaatggtcaatcacaaagacgaaagcacaagattcctgatctgggaccgtgaatgcattgaattgattggacaatcagctgatgaagtcaattgtctcaaaatagcagatggtgatctggatttaaatgcatcactcgaagcacttgataagttgttgggtaatgtgcttgcctttaaaatcaagcaatccatttctataaaatcatatcatgatccacttattggactccccttaacaccaacaaagcgacaaccatctcatgaatgtgatgatgaagcaagaagctcccagatttcacctgcctaa

SEQ ID NO: 35108 - DNA, 987 bp, Glycine max
  Peptide Sequence Number=SeqID_126793
atggacgaagatcaatgggtgtatgacaatataatgtatgaagaagttgatatggatgatcaaaatgaacaagaatgtggtgtgaatgaacaacatgttgattgctcggatgcgttcaaaacttctcagatgatgttttgcagtgggcttgatcagttgctcatgaaaatggatctgttgcagagtggtcagtatgggtgtaggaagaaagattttgttagaagagatactgagagtaggaaatgtgggtgtcccttcaagctttgtgggaaatcagtgattggagggcaaggttggatggtgaagttgatgtgtaagactcataatcatgaattggccaagtcattagttggacatgcatacgctgggcgattaactaaggatgaaaagacaattattgctgatatgaccaagtttcacatcgacaagaatgtcaaggccaaatgtaaatccctaattggtcaaaaaaatgcttgggagtatgtcatggatgcctggggaagtctggttgattgtcctttcgaacaacagttccatgaatgccttaagaagtttgaaattgcttgttcaccttggccaattaactctaaagttcgggaaattgcataccctgatcaaaactctatgtgtcctcctccagcaaaggtcaacactaaaggtgcaccgaagaaaccgatgaacagaaaccaaagatcaacaaagtatgatttgtcttactgggatgcatcatcttctgaccagccgaatccaagaaggatcatgtcgatgttggatcaatttcagccatttatacatgattttattgacaacattgtggatgtcaaagttgacggtaactgtggatatcagtcaattgccatttttttaagtatgggtgaagattcttggtcattggtctgcaaccatttgcttaaagaacttgccaaatggtcggatgactatatcaagctctttggtgacacagatgggttcgaggaaggtccctaa

SEQ ID NO: 35109 - DNA, 1141 bp, Glycine max
  Peptide Sequence Number=SeqID_126794
atggttagaaccagggggttaggtcgtgccctaggtagggttataggcagagccctagggagagaggatcatcatgattcagatgatgttccccagcgacgaaggcctacagcatccgctcgtaggcaatgggaagctgcccctattgttgaggatgttcttgatatgactgaggacgtacttgcacatggtgtagaagctgttgatggtgctgagggatttgctgttgataatgctaagggatttccaggtgggtcgcgtgacccatcagtgctaactgagtatggtgaccatgttggagtgagcatatggaatggagaggaacgtcctgaattgaagttatcctcccatggaaggaaggttgataaatttgggaggcctgctccagaaattgaagggctagtcactgccacaggactaagtcctttgatcgcatgttcagtagacactggcgatcagggagttatatccgcttttatggagaggtggcacaaggaaactagcagtttccatcttcctgttggagagctgaccatcacgctggatgatgtggcatctttgcttcatcttccaatcataggcaccttccatagctttgagcctctgcatgtcgacgaagcggtgttgatgttggtggagttgcttgaagtctcaggagaggaagctagagctgagaaaaatgtcatgggacatacgtacacctatcgtggctacgagatatttatcagaggagatagtggaagctatgcgtggggagctgccgccctagtgcatatgtatgatcatttgaataatgcttgtaagagcgacggccgacagcttgctggttacatcactctattgcagatatatgagcatttttcctctattgctgactgcgtcactgatctagactatgatgagatgtcaccacatgcctgccggtggcttactacgaaggcttattcgaagggattcccagcattgacgtactggacacgtatagatggactgacgattcctgatcttcgatggggtcccgttgtggtcacacatcgaccagagaaggtggtgcgacaatttggatacgttcagaccattcctccgcagcctatgggtgtcagcttgtcatttgacgatcttgacgacacgtgtcggacaa

SEQ ID NO: 35110 - DNA, 332 bp, Glycine max
  Peptide Sequence Number=SeqID_126795
atgaaatctgtgcaatttcaggtgaaaaagaggctaagtcatgaagttctaaaagtgacagttgagcttagctcatcagttgggccaaacgcgcatccaccgcttagtgcagcttcagcgggcttagcgcgacaaaagaatctggcagagcatcaatatcaaggctgcgcgctaagcgcgagatcacgcgaaggtggcgctaagcgcaacattgcagggcaacaatccagagagtcaccatcatacatagaagtcagagcacaccatagtgcctatttcgggaaaagagctctggaggcagcaagaggagcagtttttgcagagatacctag

SEQ ID NO: 35111 - DNA, 300 bp, Glycine max
  Peptide Sequence Number=SeqID_126796
atggctgcaaagaggatcttaaggtatgtgaagggcacaactgattatcgagtgttgctaccttttggacaaaatgaatcaaatcaaaatctgcttggttatactaactcagattggaggagggacaaggatgacaggaagagcattgcgacctatgtgttcatggacaaagttaacaaaggaaagatcaagctcatctactacaaattagaagataaccttgttgatttactaacaaaaccattgaagaaagccaagtttaaagaactaagaagtaaactgatgattaaagctgattga

SEQ ID NO: 35112 - DNA, 1014 bp, Glycine max
  Peptide Sequence Number=SeqID_126797
atgggaggaaaaaccttacaggaaacacctacatgggctgtggccgttgtttgcttcgttttgctctccatatctatcttgatcgagcacatcctgcatctcattggaaagtggttgaagaagaagcacaagagagctctatgcgaggcactcgaaaagatcaaatcagagcttatgctattggggttcatatcgttgctcctaacggtaggacaaggtctaatatcgaggatatgtatatcagaaaaggttgcggggacatttcacccctgtccaaaaaaatactataagaagaaggaagagtcagagcaccgaaccaataatggtcggagattactagcggcttttctcgattccgataaccaaaatcaccgtcgtattttggcggcgggaggtggtgacaactgtcccccgggtaaagtcccgtttgtctcatccgagggtattcatcaactccatatatttatcttcgtgctggctgtctttcatgtcctttactgcatactcactctagctctgggtagagcaaagatgagaaggtggaaacgatgggaagaggaaaccaagacagcacagtaccaattttcacacgatcctgaacgatttagatttgcgagagaaacatcatttgggagaagacacctgagtttctgggcccaaaatcctgtcctcctctggattgtttgtttcttcaggcagtttgtacggtcagttcctaaagtggattacttgacactgaggcatggatttatgatggcacatttggggcctcatagtcacccgaaattcgactttcggcaatatatcaaaagatctttggaagaggacttcaaagtggtcgttgaaatcagtactccaatctggttcatcacagtgctttttctcctggttcacacggatgattgttctattagttggagccaagttgcaagtgataataacaaagatgggtcaaagaattcaacaacgaggagaggttgtaaagggagtgccactggtgcaacctggggatga

SEQ ID NO: 35113 - DNA, 720 bp, Glycine max
  Peptide Sequence Number=SeqID_126798
atgggtcaaagaattcaacaacgaggagaagttgtaaagggagtgccactggtgcaacctggggatgacctcttctggtttaacaaacctcgacttattctctacctcattaatttcgtgctctttcagaatgcttttcagcttgctttcttttcatgggctgcgcttcaatttatgatgaaatcctgtttccattcccaaaaacagggcgtggtgatcagaatctcaatggggatcttcgttcaattcctttgcagctacgtgacccttcctctctatgctctcgtgacacagatgggttcaacaatgaagccaaccatttttaacaaaagagtagccacagctctaagaaagtggcaccacacagcgaagaagaacgtaaaacagaaccgtggattgcgattgcagactccttcatcaaccaggcccacgaccccgaaccaccctaagtctcaggttaatttcctacgccgctaccatagtgaaatggccccttatccctcgtctccaataaggttcgattttgaggcaaatctttcttatgaggtcaatgctactagttcttctattcaccaccatgaaatggaaatgggtcaccaggcctatgatcatgctgaaaaggttgatgagcccagctctacccttgtgggtttaagtctgcctcaacgcgagattgatatcgaacatggcaaggaattttcttttgataataaagaatga

SEQ ID NO: 35114 - DNA, 1305 bp, Glycine max
  Peptide Sequence Number=SeqID_126799
atggcgtctgctagccttggaagtggtggggtcggcagttcgaggtctgttaatggtggcttcaggggttcttccagttccgtcgattggcttggcagagagatgcttgagatgaggttgagagaccacgaagacgatagagatagtgagcctgacatcattgatggtgtgggtgctgagacaggtcacgtcataagaaccagcattggtggccgaaatggtcagtctaagcagaatgttagttatattgcagagcatgtagtggggacaggctcttttggtgttgtttttcaggcaaaatgtagagaaacaggagaaattgtggccatcaagaaagttctccaggacaaacgatacaagaatagagagttacaaattatgcaaatgctggatcatccaaatattgttgccctaaggcattgtttcttttcaacgactgacaaagaagaagtttacttgaatcttgtacttgaatatgttcctgaaactgtgaatcgcattgcgaggagctatagcaggattaaccagcgaatgcctttaatatatgtaaagctttatacctaccagatttgcagggcccttgcttatatacataactgcattggtatatgtcatcgtgacatcaaacctcagaacctacttgtgaacccgcacactcatcagctgaaactatgtgattttgggagtgcaaaagtgttggtgaaaggagaacctaatgtttcttacatctgttcaagatactaccgtgctccggaacttatatttggggccaccgaatatacaactgccatagatatatggtcaactggttgtgtaatggctgaattacttcttggacagcccttgtttcctggagagagtggagttgatcagctagttgaaatcatcaaggttttgggaactccaaccagggaggagataaagtgcatgaacccaaattatactgaatttaagtttccacagataaaacctcatccgtggcacaagattgttccttatataagtgagacatttcacagggaaaaaaaggtctttcagaaacgtttacccccagaagcagtggaccttgtctgtaggttctttcagtactcccccaatttgagatgcactgcattggaagcttgcattcatccattttttgatgaattgagggacccaaacacccgccttcctaatgctcgaccacttcctccactgtttaattttaaacctcaggaactttctggtgtaccccctgatgtcatcaatcggcttataccagagcatgcgcgtaaacagaacttatttatggctttgcacacctag

SEQ ID NO: 35115 - DNA, 495 bp, Glycine max
  Peptide Sequence Number=SeqID_126800
atggctgagaaattcattagtcacacagtttctcatttctccttttttcgaaagatcgtgaaggaaggaatgatactgagtcaatttcgtgccctcagtcagtacactcaccacctgcgcgctgccctcactcagctcaccctcttcgtcactcacccttccatgccggcccgccctgtcatcgaacatatttggccgccattcaattactaccgtcatcatccaagatttgttgtgtatacttactatgttccaacaactctattggtgttttcttcagatcattgcaatccaaatattctagcgaagccaaagtcagagattcttggattcatttcttcatcaagcaatatattgcttgccttcaaatcctctaatgttctgttagacatatctttatgcagtgctgttgggtcacataccataattaatggcaaagaagttgtcaattttttatgcagtgctgctgggacaattggtaggactcaatcttaa

SEQ ID NO: 35116 - DNA, 999 bp, Glycine max
  Peptide Sequence Number=SeqID_126801
atggatggtgtcgggtatttagcaggtccaccaaagttaggcctcatcgcggggtcagcaactctggtgactctgaagggtcagttgtgcgaatggtcagttgccgacaaaggtaaccctaacaaggctatagaggtatcctcttatgtgaggtcgagtgtcgaggcctcttgtagtgacaacgcaagtattattgccaaaataacgattggcgatttcaaagaagtgtccgtcaattactctcctaaggacaataagcctatccatctttgttgctatcgaatggacgcttatgagaggtcggattgggtgttcttagagaatgagtcgtctatcaacatgccaactactagggattttttctatgtttacgattgcattttccgcaatcttaacatagagctcccttttgatgacttcactatgagcatcctctatatattgaacatggctatttcgcagttgcatttgaacggtcaaaagaagaagatttcaagcactttagaggaaattgatgaaaaatatggaagaaaaagcattgaagaaggattggacagcttgctcgacgtgcaatccaggttggactttggcagagacattctgcaaggtgtcgatgcttcatttgcattggcaattaatgaagttgaagaaggagttggaggggatgaacaaggaaacaaatcaagcccttcatgcaaatatagaagggaaaaggatttgatggttgccttaaaatgtgaggtggatgcctttaaggaatcactgattaaagctcaagaggagattaaacaagggaaagagcaataccagttcctaatgcgtggttctcgggagaaggtgatcatggagcacaatgtcagctttaacaaagctttgaggcaagttgatcataagttcatgatccctcatgatgctgagtttgacatcctcatggatattcatgaagggacattgatgtccattcaaaacattccaagaaatactcctcgaaccagctaa

SEQ ID NO: 35117 - DNA, 2181 bp, Glycine max
  Peptide Sequence Number=SeqID_126802
atggcttccgctgcgccaggtgcaaccaatgatgctttatacaaggaattgtggcatgcctgtgctggaccccttgtcactcttccgcgtgaaggggagagagtttattacttccctcaaggtcatatggaacagatgttgccacggttcaccttacaattttatctggaaaatatttgttctttcttgacttgccttgctttttggtgggagatgtctttgtttatgcttgaggcatccatgaatcagggattggagcagcaaatgccttcctttaatctgccttctaaaattttatgtaaagtggtcaatgttcatcttcgagctgaacctgaaacagatgaagtatatgcacaaataactttgcttcctgaagcagatcaaagtgaggtgacaagccctgatgatcccctgcctgaatctccaaggtgtacagtccattcattttgcaagacactcactgcttctgacactagcactcatggaggtttctctgttcttcgaagacatgcagatgattgtttgccaccactggttacttgccaggcccccacccccaatctttggactgttttatcatgtgaacctgttaaagagtgtgatcattggatatttctacagattgaatatgccaaagtaatatgcagggcaacccaggcgccacttactgaccactgggtggagtgtctttgtcagttccaaaaaattagtggctggggtgaaaatggagagctgcgagttggagttaggaggctcatgagacagcaaagcaacatgccatcttctgttatatccagtcacagtatgcatctgggtgttctggctactgcatctcacgccattgccacaggaacattgttttctgtattttacaagcccagaactagccggtctgagtttattgtgagtgtcaacaaataccttgaagctcgaagtcataaactttctgttgggatgagattcaaaatgagatttgagggtgatgaagttcctgaaagaaggttcagtggaacgattgtgggtgttggagataacaaatcgtcagtctgggctgattctgagtggcgatcattaaaggttcaatgggatgaaccatcgtctattttgcgtcctgatagagtttctccatgggaattggagccacttgtgtctacccctcctacaaacccccagccatcccaaagaaacaagagatcgcggcctcccattctaccttcaacaatgcctgattcttctctgcaaggtggctcggacatacataatttctccataaaattctgttattcatgctgcttttactcaaattttctttttctctgtgcatcaggtgtatggaaatcaccagttgaatctgcaccattctcttattgtgaccatcaacatgggcgagatgtctatccatcaaccaatttcaattccactgcaactggttttcttggttttggtgggaactgctatgcttccaacaagtcaatatattggtccagtaggatggaaaactccacagaatctttttctcctgtagcacttaaagaatttggagagaagagacaagggactgcaaatggctgtagactctttaggattcagttacatgacaattctaattctaatgaagaaagtctaccaatggtcactttgtcaggaaggatgggtgatgatggcccccttccatctttggatgctgagtctgaccagcattctgaaccatcaaatgttaatcgatctgatatcccttcggtaagctgtgatgctgaaaaatcatgcctgcggtctccccaggagtcacagagcaggcaaataagaagttgcacaaaggtccacatgcaaggtatggctgttggaagggctgtggatttaacacggtttgatggatatgaggatctgctaaggaaattggaagagatgtttgacatcactggtgagctctgcggatcgacaaaaaaatggcaggttgtgtacactgataatgaagatgatatgatgatggttggggatgatccatggcttgaattttgtagcattgtgaggaaaattttcatctacactgcagaggaggtgaggaagctttcacccaaaataggacttccaatcagtgaagaagttaaacccagcaaaatggactctgaagcagtagccaatcctgaggatcagtcatctattgtggggcctggttgctaa

SEQ ID NO: 35118 - DNA, 159 bp, Glycine max
  Peptide Sequence Number=SeqID_126803
atgaatgaaagcaaagaactcctgataaggattggaatgccaactttaaaaggaaatccagaggcagaactcctgattctgatgctgacagggaatgaaacagggatgacaatagcagaagccatgaagaaggttctgatgtggattgggataggatga

SEQ ID NO: 35119 - DNA, 447 bp, Glycine max
  Peptide Sequence Number=SeqID_126804
atggcagcaggaaggcacggaggagaagaaggagcagaagaagaaaagaaagaagccaaaaagggtgaagagaaggatgaagagaaaggtttgatggaagacgaaaagtgtatgtgtcgagtggagaagaggaaggcaatgaagaaaatgaagtgcctcaacgacccggaggatgagagaatgcagagagagaaagcttggatggagatgattatgattatccaaaaacagcagcagcagcagcaagaagaagaagaagaatacgaatatttggcaaggaaacgagatcatcttaaagaaggaacaattcagagcgttatccaagtcttggcttatggagctatgttgcagactaatggtcatgaccttcaaagggagggagggaggattatacccataaacgtttttgtgtcatgtttggatctacttatgtcaataaacctctga

SEQ ID NO: 35120 - DNA, 300 bp, Glycine max
  Peptide Sequence Number=SeqID_126805
atggaggatgccaatacctgtggaggagaagaagggaaccaaatttcaaagcgcggaagaagaagcttgctatctgatacacagaagacgaaggaagaatacgaacctttttggaaggagaagaacgaaagcgcggaagaagaagcttgcggggaggttgctgggtgcacgggagaagaaggaaagcgcggaagaaaacggtatttttggaagttcattcaattgctgggtgcaccatcaattttgctgggtgcacctagcaacaccctttcggttctcacttggttcaaaacttcatga

SEQ ID NO: 35121 - DNA, 618 bp, Glycine max
  Peptide Sequence Number=SeqID_126806
atgcaattaaacatcttcatagatggtctacgaacacagtcaaagcaactccttgacgcattcgtagggggaaaaatcaagttgaagacaccgatggaggcaatggagctgatagagaacatggcggctagtgatcgcgccatccttcgtgatcgagcatacacgccaacaaagaggagccttctggaactcacagtccaagatgcaacactgggccaaaacaagctattggcccgacagatagaggccctcacagaaaccctcagcaagctccctcaacaactacaagcagtaagtccttctcactcttcaatcatgcgaatagggggatgccacatctacgatggagcagatgagccaaggcaatgcatagcccaagaagattcttccagggaggtgaactacatgggatctcagaatcgccacggattccaatgctacaaccaaggaggaccgtcgggattcaaccaagggaggaatttcacacagggctcaagctggaagaatcatccgaggaaccagttcaacaaggagaaaagaagtcaacctatccataattccaaccaagaggttgatctttatgagaagaccagcaagcttgaggagacactaaattaa

SEQ ID NO: 35122 - DNA, 1161 bp, Glycine max
  Peptide Sequence Number=SeqID_126807
atggaaattgatctgaatgatgcagtgacgagtgaggctgaaaagagtgcgtcttgcaatggggagtgtgagaaaggtgctgctttgtcatctccaacatgttcatcttctggctcctcctccacacgtgtgtcttcttcttatattgagctttggcatgcttgtgctggcccccttacttccctcccgaagaaagggaatgtggtggtgtatttcccacaagggcacttagaacaagctgcatccttctctcccttttcaccaatggagatgccaacctatgatcttcagccacagatcttttgtagagttgtcaatattcagctacttgccaataaggagaatgatgaggtttatacacaggttactttgcttccccaggctgagttggcagggatgtatatggagggaaaagagcttgagaaattgggagcagatgaagagggaaatgaaacaacacctacaaagtcaacccctcacatgttttgcaaaactcttaccgcctcagataccagcactcatggggggttctctgtccctcgcagagctgctgaagactgttttcctcctttggattataagaagcaaagaccttctcaagagcttgttgccaaagacttgcatggtgtggagtggaaatttcgacatatttacagagaagtccctgtggtaattttgtcaggtcagccaaggcggcatctgctcactactggctggagtatttttgttagccaaaagaatcttgtttctggagatgcagttctctttcttaggggtgaaaatggagaattgagattgggaatccggagagctgctcgaccaagaaatggtcttcccgaatcaattgttggtagccagagttattatcccaatttcctttcttctgtggctaatgctatatcagcgaaaagcatgtttcatgttttctacagtccaagagcaagtcatgcggattttgctgtgccctaccaaaaatatatcaaaagcatcaagaatccagtgaccatcgggacaagattcaaaatgaaatttgaaatggatgaatctcccgaaagaaggtgcactagtggcatagtgactggaatgagtgatttggatccctataaatggcctaagtcaaaatggaggtgcttgatgctgcagttcattaagaaatgttag

SEQ ID NO: 35123 - DNA, 1677 bp, Glycine max
  Peptide Sequence Number=SeqID_126808
atggggtcggaccaagcgctttcctttaaaaagaggttctatcatctcaaagtcaagaatctagagctagccagcttgcgagaactagggcagcagatggatcaattggcaccaaccatagaagagtttgaagggatcttaggatgcccattagggggaaggaagccatacctctttttcgaattctatcattctttgacaagaatagtaagagtggtcaagatcttggaacaagagctagatcgagtgaagcaaaataggaatggagtggtagggataccaaggaagcgcttggaggagaaggcagaagcttgggcaaatcaaggggagtggacctcgttcattgacatattagcacttttggtgtttgggactatactatttctgaatgtagacgggctagtgcgagaagagcattgcgagaattatctgttgtacgcctgctctttatgcatggttggtatcccacatttttttatcatgaagttggctcccacggtgaaagaaggaggggcaggagtgttatgctcatgtgaaggattcccaaatgtccccttgatagggacgaggggttgtattaattataatctcgtgctggccataagacagtttggctaccctatgagaggtgcaccgtcggaggaagtcatcatgcctttcatcgcgcgaggcttcaatgaagctaatgcgaggatacttcagaaaatccgtaaagcatggaatagagtgggaagaaaagataaggagcttagaggaagtaacaatggcgtcatcggcggctctcacaagtggttgaaatctagaacgcaagggataacgtggctcccaaagctaaaaagtctaagtgggaaagaagctgaaattcctgagaaaagtgaagaattgaaaactttgaaagcagagctcgaaaagacaagagtggtgaaagagaagctaaaaacgatagtcactaaaggaaaaagtgtatcagctctgcagattgaaagggaagcgaaagagagggtgatagagttgttgcatggggaagctatgaaatggatgaatagattcgctctcactctgaatgagagtcaagagcttccaaggttgttaaccagagccaaggcagtggctgacactcattgtcatcatcaaaaagtagccatagtaaccaaaaagaatgaacgcgctttacgatacccttaccgaacccgtgccaaggctaaaatcatgagtgagatagaggaagttcaagaacagataaaggctgacatggaggccatgaaagaccaaatgagcaccatgatggaggccataatgagcatgaggaaaacaatggaggtcaacatgactatagttgccactacaagggaaggattgggaagtacaggcggtctccattttgcgcaagtcctgagcaagcatcctttcccgccgtatgacttgcctcccaactatacaccacccaatgctatacagttgtctgttaggtcggctttggattcattttattggggtggttccgtcaacattgcccaagaaattgaagtttctggtggaaggacagctggttatagtgtcaggggaagaagatatactagtgagttgtccatcctctacgccctatgtggaagatgcggaggaatcattggaaacatcttttcaaacgctaaaaattgtgaacaatgcttatgttga

SEQ ID NO: 35124 - DNA, 279 bp, Glycine max
  Peptide Sequence Number=SeqID_126809
atgactgaagacattgtcatcttcgaaaaggggcagatgaccataatttgtctctgcgtgccatcagacttgcatgcgaggacattgagccttatgaatgataaagtgaggactttgaatcctatgaaagataaagtgaggactttgagccctatgaaagataaagtgaggacttcgagtcctatgaaagataaagtaaggactttgagtcctatgaaagatcaagtgaggactttgagtcctaataaaggtgaggactttgagccctatgaaagataa

SEQ ID NO: 35125 - DNA, 98 bp, Glycine max
  misc_feature (70)..(70): n is a, c, g, or t
  Peptide Sequence Number=SeqID_126810
atgggacacctgagtgatcaaggggttcccatgaaccctaagagaataaaggtgttgagggacggagccnaagagtatgaagaacctcgggatttgag

SEQ ID NO: 35126 - DNA, 457 bp, Glycine max
  Peptide Sequence Number=SeqID_126811
atgggatcaagtcaaacaccttcgcttaaaaagaggttctatcaagtcaaggtcaagagcctagggatcaccagtctaaaagagttacgacagttgatgggtcagctccagcggcaagcttttcgcaaagcttatggtaaaatctgggacctagccatggtaaatgtctctacagaggccattgcctccctcgcccagtattacgatcagccgttgaggtgcttcacctttggggacttccagctatcacccatggtggaagaatttgaagagatcctaggatgccctctagggggaagaagaccatacctattctcagagttctatccctcattaactagaatttccaagatagtccaaatctcgacgcaggaattataccacaggaagcaagtcgaaaatggggtggttggaataccaagaaaatatttggaggcaaaagcaaaaatcttggcag

SEQ ID NO: 35127 - DNA, 147 bp, Glycine max
  Peptide Sequence Number=SeqID_126812
atggcttgcacccacattccagtggaagcaaagatgacttacacacgattctcctcaaatttcagccagcctgcatcaattagaccttgcaccttatgcttcagggccctacaatgcttaatggaatgccccggggctcctccatga

SEQ ID NO: 35128 - DNA, 827 bp, Glycine max
  Peptide Sequence Number=SeqID_126813
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggaatcggacgaccaacatcatcccgataccatcgactcatttgccttggttgatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35129 - DNA, 1023 bp, Glycine max
  Peptide Sequence Number=SeqID_126814
gtattagaaataccaagatgtgcacgtgtgcaatttttggtaccccaaaatgctttgagtatgcatgaatggccccgaggaagcttgcctcaaagaggtccaggaaggacaaggcggccgaaggaactagttccgctccggagtacgacagtcaccgctttaggagcgctgtacaccagcagcgcttcgaagccatcaagggatggaggaaatagggcgccggcggtgggcaccactggttactcccatggccaagttgatccagaaatagtccttgagttttatgccaatgcttggccaacagaggaaggcgtgcgtgacatgagatcctgggttaggggtcagtggatcccgttcgatgccgacgctatcagccagctcctgggatatccgatggtattggaagagggccaggaatgcgagtatggccagaggaggaaccggtctgatgggttcgatgaggaggccatcgcccagctgctatgtataccggggcaggatttcgcccggactgctgcagggaggcgagtgcgaatcatgcgcaccaatatgaccaccctgacccagatatggatgacgttgctcctcagcaacatcctgcccaccgatcataattccgacctccccatgcccaagtgccagctggtgtacgccatcctgacacgaatgagcatccatgtggctcagttgatcgctgatgccatatatatttttgcaggtatggcgcccactaggcaccctttggacccagataagtccaacagggccctgggattccccgcactgatcacaagactctgccagtcgttcggagtccccgttgcacctaccaaggtgattcggccgcccatcacccgggcttttattgagaagtactgtacccagagacagggtcagggtgacgctccacaggccgcaggcgcgccaccactacctcatcaggctggccaggctggggcatttgacatagagcagtatttacggcatttggttcgccagcaggcggccaaccaccgagcacat

SEQ ID NO: 35130 - DNA, 348 bp, Glycine max
  Peptide Sequence Number=SeqID_126815
atggctagagcaggtggtggtggtgacgagtatcatcagttggacggagctcaacgactgttactggatgcgatgaatgcacagatgcaacatttgttgagccgtaccaatgaggaggtctatggacgactagaagttttggagaaccaagccaatcagaatgctagacgaaatatagatgggaataaaggtaacaatggcggtaatgacggaccaaggcagaaccgggttgagggagtaaagctcaatgttcctcccttcaaaggcagaagtgatccagatgcctacctggactgggaaatgaagattgagcatgtatttgcatgcaatgtctacactgatgagtag

SEQ ID NO: 35131 - DNA, 116 bp, Glycine max
  Peptide Sequence Number=SeqID_126816
atgtgccggcttgccccgagatctgaattcaatttacggcagatccccatgtggggcaagttgaaacatggatgccaaggtggccaatgcatcggccatttggttctcttcccaag

SEQ ID NO: 35132 - DNA, 489 bp, Glycine max
  Peptide Sequence Number=SeqID_126817
atgtttggctgtttcttgtccctgccccattttgctgtttttgctttgcctgcccagacctttcttgttgcccttgcatcctttggtatcggtgaaatgcagggggaaattaatatcaaccaactttttactggctatacaaatggtcgtagggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtatgctctatttgcttatttctttcctgggctgttattttcaaggatttcttctaa

SEQ ID NO: 35133 - DNA, 111 bp, Glycine max
  Peptide Sequence Number=SeqID_126818
atgcagctggcacgaccaggtttccccgactggaaagcgggcaagataacaatctattctggaaacagctatgaccatgattacgccaagctcgaaattaaccctcactaa

SEQ ID NO: 35134 - DNA, 74 bp, Glycine max
  Peptide Sequence Number=SeqID_126819
ccaaaaatgatgcttcaagtgtttctaatacacctttgggtgcaagaggatcttctggtgctagcaacccttag

SEQ ID NO: 35135 - DNA, 71 bp, Glycine max
  Peptide Sequence Number=SeqID_126820
aatttcacgaaggtttcaaccgttcttcgacgttcttcattcgttcttcatcgttcttcgatcttcaacgg

SEQ ID NO: 35136 - DNA, 201 bp, Glycine max
  Peptide Sequence Number=SeqID_126821
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactggaccaggagattggatctagccataaagaagaatag

SEQ ID NO: 35137 - DNA, 327 bp, Glycine max
  Peptide Sequence Number=SeqID_126822
atgaaggctgacatggaggccatgaaagaccaaatggccgccatgatggaggccatgttgagcataaagaaaataatggaaagcaatgcagctacagttgccactacgagtatcgccactgaggtagacccgactcacccatcaagcctcaatcaattcagaacaagcatgccttccaactatacaccacccaatgttgtgcacacttccgataagaatgtcaaaactccactcccatactcattgagagccaacaacctcaatctgatcatgtgcatgtctctcaacccatgggggagacacatgaattaccccaccacaatctag

SEQ ID NO: 35138 - DNA, 612 bp, Glycine max
  Peptide Sequence Number=SeqID_126823
atgggatcaagtcgaataccttcacttaaaaggaggttctatcaagtcaaggtcaagagcctaggaatcactagtttaaaagagctagggcagttgatgggtcagctccagcggaaagcttttcgtaaagcttacggtaaaatctgggacatagccatggtagaagtctccatagaggccattgcctccctcgcccagtattatgatcagccgttgaggtgctttacctttggggacttccaactgtcacccatggtggaagaatttgaagagatcctaggatgtcctcaagggggaaggaaaccctacctcttctcagggttctatcccttattagctagaatttccaagatagtccaaatctcggcgcaggaattagaccacaggaagcaagtcgaaaatggggtggttggaataccgagaaaatatttggaggcaaaagcccgaatcttggcaggcaaaggtgaatgggccccgttcatagacattctcacactattgatcttcggaggagtcctctttccgaatgtggatgggctggtggacctagcagcgatcgacgctttcttcgcctatcatgaccacaaggaagcaccggttgtcactagctag

SEQ ID NO: 35139 - DNA, 141 bp, Glycine max
  Peptide Sequence Number=SeqID_126824
atggcttcctatggtgaagcaaagggctccattgatgaagaagatccaaggcctacaagctccacatggagctacatcacattggaagtcaccgacagaattcttgagttgcatggaggtcttgcggaaggcggatggtag

SEQ ID NO: 35140 - DNA, 357 bp, Glycine max
  Peptide Sequence Number=SeqID_126825
atgcaggtactatgcataccggggcaagatttcacccgtgccgctgcaaatggacgagtgtggatcatgcgcaccaacatgaccactcttacacagatatggatgacgttgctacttagcaacattccgtccagcgaccgcaataccgatctccccctacagaaggatcgtgcccacaaggcacccagtggacccggagaagtccaacagggtcctggggttttcagctctggttacgggcctctggatcacgcccgtaagacacccagtgaacccggagaagtccaacagggtcctggggtttccagctctgattacgagcctctatcagttttacggagtgcctgtcacccctag

SEQ ID NO: 35141 - DNA, 285 bp, Glycine max
  Peptide Sequence Number=SeqID_126826
atgactacactcctcgccaacagagggctgcacgcccttaccttaagaggactgtgtgtcctcactttcagaggactgcatgtcctcaccttcagagggctacacgtcctcgccatcagaggactgcgtgtcctcaccttcagagggctacacgccctcgccattagaggactgcacgtcctcgccttgagagggctactcgcccttgccttgggtactagttaccctcaccttcagaggactacatgtcctcaccttcgtagggctacacgccctcacctttag

SEQ ID NO: 35142 - DNA, 246 bp, Glycine max
  Peptide Sequence Number=SeqID_126827
atggactcgggaaggttccaagttagtgtaccaggtaacaactaccccagtgtagttgtgggtgatactgagggccctccaaagggttttgtaggggtataccaccaactgcttgcccttcagtggcatatccgagccaaggctcgaagtcggctagattgtgatggggaatttcatgtgtctcccccacggtttaagagacatgtgcatgatcagtttggggttgctggctctcaatgggtatag

SEQ ID NO: 35143 - DNA, 280 bp, Glycine max
  Peptide Sequence Number=SeqID_126828
gttacaggttataccatctgtggtgaggctcatgaaacaggccaatgtattcccactgaagaaaatactcaggaaattcattatatgggaaattaatagcgacaagggtatactcaaggaggattttcaggctttcagcagggtccctataatcaacaaggacagtggaggacacaccctggcaactagttcaacaaagacaagaatgggccttcaaacaggccaatccaacaaggacctaacatattccaaagaactactaagctggaggagaccttga

SEQ ID NO: 35144 - DNA, 317 bp, Glycine max
  Peptide Sequence Number=SeqID_126829
gtgctccagtggcttctgtttctatcagctgtcccctccctgttcagctactgacggggtggtgcgtaacggcaaaagcaccgccggacatcagcgctggcaagtgtagcggtcccgctgcgcgtaacccaccacaccccgccgcgcttaatgcgccgctacagggcgcgtccccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaa

SEQ ID NO: 35145 - DNA, 333 bp, Glycine max
  Peptide Sequence Number=SeqID_126830
atgggttctccacctgcctccactcctcctcctcctcctcctcctcctccttctcctcattctcctcctcctccttcggatgcatcgacttcaccatctgccatgaagtggacacgcaaagcctcacgtctacgatcgttgtccactagaccacctggtgctgagagaccagtggtgcatgttgatcttgctatcggtgtgggcaacggtccccacaagaagaaattaagaacatatttggggattgtggtgcgtgataaggtggacgtcacctacgagaactggaaggaggtccctactgctcagaaggacctaatttgggaggatattcat

SEQ ID NO: 35146 - DNA, 474 bp, Glycine max
  Peptide Sequence Number=SeqID_126831
atgaagcacttcactgacaccctcatcagtgccaacatagtaagccagtatacactcccgctagcgcccaatacgcaaaccgcctctccccgcgcgttggccgattcattaatgcagctggcacgacaggtttcccgactggaaagcgggcaggaacaaaagctggtaccgggccccccctcgaggtcgacggtatcgataagcttgataggccctggccggggagggcacccagttcgaggaccgtcgcggcgaggtcgccaaggcctacggcgccgtgaccaagaaggtcgtgcgtcagcgcatcctcaccgagcaggtccgcatcgacggccgtggcctgacggacatccgcaagctgaccgccgaggtcgaggtcctgccgcgcgtgcacggatcgaattcctgcagcccgggggatccactagttctagagcggccgccaccgcggtggagctccaattcgccctatag

SEQ ID NO: 35147 - DNA, 912 bp, Glycine max
  Peptide Sequence Number=SeqID_126832
aacacgctttacggcgcctttaccaaacccgtgctagagctagagtaatgggtgaagtagaggaggtgcaagagcagatgaaggccgacatggaggccatgaaagagcaaatggccacaatgatggaggccatgataagcatgaagaagataatggaagccaatgcggttgcagttgccgctaccagcgttgttgctaaggtgaacccgatgcccccatctggcctcaaccaaatgaatcatccaacctcggctatggtaggcaaagatttgggaagtataggcgacccctattatgtgcaaattcaaaacaagtatgccttcccaccatatggcttgcctcccaactatacaccacccaatgtggcgtacactctcggtgaggatgtcaataactccgctcccatactcattgagagccgacaacctcatcatgcacatgtctctcaacccatgggggacacacatgaaatgccctaccacaatctagccgacttcgagccttgcctcggatatgccactgaagggcaagcagttggtggtataccctgcaaacactttggaagggccctcagtatcacccacaaccacaaccctcacattccacagcgggccattgaaggaggtaaagattatgcctttcctaacctagaagagttgttcctagtacccaatatcatcacccctcccaagttcaaggtgctggactttgacaagtacaaggggactacttgccccaagaaccatccaaagattgttagtacaattctgatatggctccggataggatgcaactgcaaaaagtgtgcaaaaagggggcacaaatctttcaaagaatacgcccaaaaggtggagggatctggcggcccaggtggtacccccaatgatggaaagggagacgatgatcgtgatg

SEQ ID NO: 35148 - DNA, 253 bp, Glycine max
  Peptide Sequence Number=SeqID_126833
ggttcgtgaggaatggcttaagtcgatgtccattgaccttgaagctcttgcttgtagtgagcttcaaaacaaggaaagggaaactcaaggctcagtgaatccaggttatcaaaggaattcaattcactgcccagcattagacccgataaggagaatcaagcctaggctattgtgcagtccgaatggggcccagagagcatcatcaagccatggtactaatgactttcctggtttggctcacaattctcacaag

SEQ ID NO: 35149 - DNA, 261 bp, Glycine max
  Peptide Sequence Number=SeqID_126834
atgtccaaatttttctcctttgtggctgagtatgaggtcaaatcaatggaaaaagaaaaatttcagcagctctctttcctccctccacgttgctttttctcctcttctcctccaccattgttgcctcccttgaagctccaaattcctcttcatttctaccccaaattacaaggaaaagctattttcggagtcttggagcctatctctacttcgtggggctttaaatttcagaaaactggtagagaggatgaggagagttaa

SEQ ID NO: 35150 - DNA, 719 bp, Glycine max
  Peptide Sequence Number=SeqID_126835
attggctctccgagttgaaaattatcaacgaggagaacttcgaagctccggaagaggatgaagaagtccgagctctaaaaacagaactaggaaaagcaagacttgccaaagaaaaattcaagttagttgctacagacgttcggaaagagtgtgccgagttacgagaagaaaatgcggctactgcaagagcccttgaacaagaaactaagagggctcgcaaggaagagcatggccgagacaaattccgtggagctttgtggggcaacaacagtgagctcaagcttcgaagggaagagagagaccaatcacgagcacatagcatggtcttaaaagaggagttagctgtttgctcaaggtccaagagaagcttgtctcggcgtttatgcgagacagagaccaacatgttagccatcgtcagcaagtaccaagaagaattaaatctagccacggcccacgagcacaaagtggaggacgagtatgcccgagtgtacacggaaaaggaggctaaaggaagggtgatcaactcgttacatcaagaggcaacaatgtggatggaccgatttgctcttactatgaatgggagtcaagaacttccccgattactagccaaggccaaagcaatggcagatacctactccgcccccgaagagatccacggacttctcagctattgtcagcatatgatagatttaatggcccatataattagaaaccgctag

SEQ ID NO: 35151 - DNA, 266 bp, Glycine max
  Peptide Sequence Number=SeqID_126836
gccagattcttgcttacggagttgttggaagtgttctgctgaggaggccagattgcgagacagcaccgaacacgagagatagacctgctgatgaggatgctgctgatgttcctgagaggcgtaggcctactgcctcagcccgtaggctacgcgacgtcgctgacatgactgacgatgtccttgagcaggctatggaggcacctgagatgcgtcggacgcatagggtgctgatagtagtgaggggtcagatggtgatgatgtgctga

SEQ ID NO: 35152 - DNA, 888 bp, Glycine max
  Peptide Sequence Number=SeqID_126837
atgggacctctccaaatgcaagccttccgcaaggcgtacggaaagattttagatttgtccatagcagagatatccacggaagtcgttgtatcactcacccaatactatgaccagcctttgagatgcttcacgtttggagacttccaattagtaccgattgttgaagaatttgaggagattctaagatgtcctcttgggggaaggaaacccgtatcttttctccgggtttcttccctcctgagcaagattgcagttgtggtcagggattcgacaagagaattggatcgtgtaaagcaaactcaaaacggcgtagtgggcctaccacagaagtacttagaaggcaagggaagggatatggcgaatcaagaggagtgggtcccatttatgggcgtattagcagtgctaatctttggggttgtcctctttccaaacatggacggtttggtggacctagcctcaattaatgctttccttgcatatcaccatagcaaagaaagcccggtggtagctatcttggcagacttatttgacacatttgaccgaaggtgcgagaagagtagcgcacagatcatttgttgtttacccgctctttgtgtatggttggtttcacacctgttccaacaagacataaggcatccatgtccgctccgaagccatcgctcgtgtgtcgaaaaaagaagagtagattggcaccaacacttggccaggatagaagacagaacaatcaactggtttcctcgatggaaggaaggaaaggagggagttctcttctcatgtgggggctacctaaacatcctgttgataggaacgaggggttgcattaactacaatcccgcactttctataagacagttagggtaccccatgaggggagcaccgacggaatag

SEQ ID NO: 35153 - DNA, 342 bp, Glycine max
  Peptide Sequence Number=SeqID_126838
ggcccatcaaattggatggcaagaacacgatttacaacaacatttcgtgttgacaagaacatcattgaagttccattgacttaccacagacaatggaggccatattaccaaacttatgttttattagactacaatggaagcaagcattttgttaggctgcgcaaatatggcacacgatacttttttgctgatgggatgaaagaatttagaagagcccacgacattaatgacagtgtcattatccgattttttgcagcctcaaaagatacttcttttgacgttgatgtcatgggacctatccatagacagacacgtcgaaggttcttccagcagcagctttaa

SEQ ID NO: 35154 - DNA, 63 bp, Glycine max
  Peptide Sequence Number=SeqID_126839
tgtagagagtgagagagagaatgggaacttagtaactcatgaaagactttggagtgtgaacaa

SEQ ID NO: 35155 - DNA, 474 bp, Glycine max
  Peptide Sequence Number=SeqID_126840
atgactcaagagctggtagctcgcggagacaccttacggttatccgcacctcgtcattcagtgaccccaagtgtgattgacgagcagagaccaatatggtcatctgcgccctttccggagatgtcatcattttccgatggagacttttcaagtctcacaaattacccagaactacgtaggtctgaattcctcattggaggatacgcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggtggcgggcccgatgacaagcagagaccaagtttggtcattctgcacccttgtatcatccagaggcggcgggcccggtga

SEQ ID NO: 35156 - DNA, 543 bp, Glycine max
  Peptide Sequence Number=SeqID_126841
atgacccaagagctggtagcccgcggagacaccttacggttatccgcacctcgtcattcagtgaccccaagtgtgattgacgagcagaggccaatgtggtcatctgcgccctttccagaaatgtcagcatcttccgaccacagtcgtgtccgatgggcggcgcagagacaaaattgggtcattctgcacccttgtgtcattccaagagggcggcggggcccgatgacacgcggagataccttacagttatccgcaccctttggtcatccagaggcggcaggcccgatgacacgcggagataccttacggttatctgcacccttttgtcatccagaggcggcgggcccgatgacacgcagagacaaaatttggtcattctgcacccttgtgtcattcagaggcggcgggcccgatgacacgcggagataccttacggttatccgcacccttttgtcatccagaggcggcgggcccgatgacacgcagagacaaaatttggtcattctgcacccttgtgtcatccagaggcggcgggcccgatga

SEQ ID NO: 35157 - DNA, 276 bp, Glycine max
  Peptide Sequence Number=SeqID_126842
cacttggttcgccagcaggcggccaaccactgggggcaggtgcagatacacgagtgtctctaccagctcagcctcagtcagcagggccagggcttctctccttttgcgtgccctactctagatcagtttaggactgatgtcgcatggtctggagattggcccgaggcccaggcggaggaggcgcctgcaggagctcccggcaatgcagaggaggcccgcatggatgaggagatgacagacttgctcagcttcttgggaggaagcggagccacgtga

SEQ ID NO: 35158 - DNA, 240 bp, Glycine max
  Peptide Sequence Number=SeqID_126843
atggccaacaatataatcaacaacagggacagtggagaactcaccctgcgcactcctcacgctaagcgccatcttcttcacgcgctaagcgagctgctgttcgcgctaagcgcattaacccctgatcattggctgtatggtcccgctaagcgctctggtctcgctaagcatgttgatgcgctaagcgctattcttctctgtctgatcaatttcgagaatggggctaagcgagtgctctcg

SEQ ID NO: 35159 - DNA, 192 bp, Glycine max
  Peptide Sequence Number=SeqID_126844
atggagccagagcagcctattcaagattcatcagcaactccagcactggatcttaatgaagatcagccacaggatgagcaggacccattagaacagaatgagcatgtgattggaagtatgactaaaaatgttagtcagtttgtcagattgattgtgaaggaatgcattgaccgtatcccggtgagagtgtga

SEQ ID NO: 35160 - DNA, 221 bp, Glycine max
  Peptide Sequence Number=SeqID_126845
atgttcctccagaaggcggttgcttctggaggaagcaacctgcctcgcctaggcgagctgggtggcaagctcctcccctattttcctataaatagagggaggagtgaagaaaatccaagcctaggggcttccgtaacgtttccgtgggtgatttcgcgaagattttcaaccgttcttcgtcgttcatcgttcgctcttcgtcgttcttcggtcttcaaccg

SEQ ID NO: 35161 - DNA, 495 bp, Glycine max
  Peptide Sequence Number=SeqID_126846
atgtcggctttaaaagatcagatggcttctatgatggaagccatgctaaaaattcaaaaatcaatagaagacaatgctagggaagcggaaccggtgctacagcccgcaatgaactcgggctgggacagaagcgcgacggacttcactccccgtaccgctccagatgatttgagccaagcccctaccttcgaggggcaactccctcctcatgccgactatcatctggaggaagatgatgaaggagatgcccatttaggccctctacttcccccaagggaatcgaccccccatgagttaccccagccaaacataatccgccatgccccgtctcaatctgcacccgttaaggaacccattcccatttcaaaagacaagggaaagatcgatcttcttgaagagaggttgagagcggtggaaggcctcggcaactatcctttctcggatttagtcgatatgtgtctggtacctgacatcatcattcctcccaagtttaag

SEQ ID NO: 35162 - DNA, 492 bp, Glycine max
  Peptide Sequence Number=SeqID_126847
atggataatgaagagggcgtgcaggaacagatgaaggccgatctatcggccttaaaagaccaaatggcttccatctcggaggtcatgttaaaactccagaaaaccatagaggataaagccaccgcaaccgcctccagtacagttagggaagcggagccggtgctgcaacccgccttgaatccgggcctagacagaaacacggccgtgttcggtcgaaggtatagtccgcaagcttatccttatggcctgcctccggacttcaccccccgtgccaccccggaagatttaagccaagcccctactttcgaggggcaactcccaccttatgaagactatcccgggcaagacgacggggaaggagatacccatcttggccccctgctccaccttaaagatccatccccgcatgaactaccccagccgaacatagtccgccatatcccggcctcacccacacccgtaaaaagaatctgttccctttgcggaagataa

SEQ ID NO: 35163 - DNA, 210 bp, Glycine max
  Peptide Sequence Number=SeqID_126848
atgggttttcctttgctggcagtcacttaccttgccgaaaatttatctggtctgaaggccaaggttcaaaaaagtctaaggttgtgtctcaatgggggctttgatcgtgggagcccgatcttgatatccggggcaaaacaaattggggtgtcaaggtgtcgatctcgggccaaacttccatattattccacaaggcatgcacaacaatga

SEQ ID NO: 35164 - DNA, 759 bp, Glycine max
  Peptide Sequence Number=SeqID_126849
aggactacacgtcgtcaccttcaaaggactacacatcctcgccttcagagggctacacgtccttgcctgcagagcgcaagaggctacgccctcaccttcagaggactacacatcctccccttcagacggctacacgtgcttgccttcagagggctacacgccctcgccttcagaggactacacgtcctccccttcagaggactacacgtcctcaccttcagagggcatacatgtcctcgctttcataggactacatgtcctccccttcagtggagtacacgtcctcaccttcaaggactacacatcctcgccttcatccgaggactacacgtgcctcaccttcatagaggactacaccctcgccttcagagggctacacatcctccccttcagaggactacacgtcctcatcagagggctacacgcctccccttcagaggactacacgtcctcgccatcagagggctacacgtcctcgccttcagagggttacacgccctcaccttcagaagactacaagtcctcgccttcaaagggctacacaccctcgcctttagaggtgtacacgcactcgcgttcagaggactacatgtcctcaccttcagaggactacagagaactacatgtcctctccttcagtggagtacacgtcctcacctttcgaggactacacatcctcgccttcagaggactacacatcctcgccttcagagggctacacaccgtcaccttcagaggactacacgtcctcacctctaa

SEQ ID NO: 35165 - DNA, 451 bp, Glycine max
  Peptide Sequence Number=SeqID_126850
gctaagtgcgccctgtgcgctaagcttagggtcattctggctaagcgcgagtctgctgcgcttagcccacgaatggcttccaagaagagaaagtctcttgcttcttcctctacccaagcaagatttgacagatctaggtttcattctcaagaagcttgggagaggtacactgatataattgtgcctaggaaactgcttctagagagcaatgtggaattttatgctaacctctacgacccggaagacaagtcactcaagcaggtgagggtcagaggtcatttgatcaaatttgatgaagatactttgaacaccttcctgaagccccctgtaattttggaagagggggagaatctctatgcttattctaggtttgcactcctgaggcctgatcctcaagagttggctgctaagctctgtatcccagggaggggattcgagctaaatgctgatg

SEQ ID NO: 35166 - DNA, 225 bp, Glycine max
  Peptide Sequence Number=SeqID_126851
atggctctggaatggtggtctcagatgaagcatcctgtacctgttggggtacctaggctgataagaatggcagtggaatggagaaggaagagagagaggagatgccacttcaaggagaagatgagtctagaagaagctcaccaccataggaggccatggataagagcttggaggaagaaggagatgaatgaagggagaggaagagaagagcacaaaattttgtga

SEQ ID NO: 35167 - DNA, 520 bp, Glycine max
  Peptide Sequence Number=SeqID_126852
atggataacaagatacttaccaccattattgataaatttaagggtggcccggtggggctgtctacattggctacagccgtatctgaaagtagcgaaacgatagaggaagtatacgagccattcttaattcaggaaggctttattatgcgtacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 35168 - DNA, 321 bp, Glycine max
  Peptide Sequence Number=SeqID_126853
acttatcaaggtaatccttgtggcgtctacccggacttatcttccttcactggaagtggcgtctacccagacttatcttccttcaccggaagtggcgtttaccttaacttatcttccttcaccggaagtggcgtttaccttgacttatcttccttcactggaagtggcgtctacccagacttatcttccttcaccggaagtggcgtctaccctgacttatcttccttcaccggaagtggcgtctaccctgacttatcttccttcaccggaagtggcgtcatccaaaccttcgtagcctgtatcaaacgttccgccccataa

SEQ ID NO: 35169 - DNA, 174 bp, Glycine max
  Peptide Sequence Number=SeqID_126854
atgttgcaagaaccaccacccacaccagagttgaagcccttacaagcaaccctcaaatatgcttacttggaggacaaggaaaaatttccagtgatcatctctgcctcctttgctgctgagcaagaggagaagttgttgctagttctcaagaagcacaagaaagccattggatga

SEQ ID NO: 35170 - DNA, 532 bp, Glycine max
  Peptide Sequence Number=SeqID_126855
actcagagttcggtaccatgcagagactaacatcgtcatctgcaccctttgtcaaccaggggcaagcgagcctgttgacacgcagagactaacgtcatcttttgcagctttgtcatccagagacggtgagtccggtgacatgcggagatacccaagtggggcaagcaagcccgttgacatgcagacactaacatcgtcttctgcacctttgtcatccagagacggcgagtccggtgacatgcggacatacccaagtggttatccgtacaaaatgatttctgttaatcctgacccgagaagtcaggtggcaggcggagatacccaagtggttatccgtacaaaaagatttttgttaatcctgacccgagaagtcaggtggcaggcggagatacccaagtgcgagcccgttgacatgcagagactaacgtcgtcttctgcacctttgtcatccagagacggcgagtccgatgacatgcggagatacccaagtggttttccgtacaaaccaacttctgttaatctcgacccgtga

SEQ ID NO: 35171 - DNA, 315 bp, Glycine max
  Peptide Sequence Number=SeqID_126856
atggataatgaagagggcgtgcaagaacagatgaaggccgacctatcggccttaaaagatcaaatggcttctatcacggatgccatgctaaaactccagaaaactatagaggataatgccacggcgaccgcctccaatgcagttagggaagcggaaccggtgctacagcccgcaataaacttgggccgagatagaaacacaacggtgtttggtcggaggacatgccgaaaaaccaaaaaaaatgttgatgcacaatccgtaagtttccgtgacacatcggaaatcaaatggaagcatcgttgcataattaagtga

SEQ ID NO: 35172 - DNA, 536 bp, Glycine max
  Peptide Sequence Number=SeqID_126857
tggcgctgttgacggagctacttgaggtcaccccagacgaggctacagttgagacacgtcaggcagctcgggcgtacctacttcatttggttggttgcactcttttcgctaacaagagtgcaacccatgtccatgttgtgcacctgcaggcattcagagacctggcacaggcagggacattctcttggggagcggtcgctttggtccactcgtacgatcagcttaacgaggcatcgcaggcccctacacggcagatggctggttacatttcactacttcgggtgactatcgctgcttcactttccatcagtccacagatgaccgggattaagggagccccttacagagcacgtattgatgccctgacagtcactgacgtctgttggatgccgtatgcggagcatcggggagttcggggctatgacttgatctcctcgtacatggggcaagtcagatggggtccgatcatcgtctaccttcgactagagagggtggttcggaaaatggggtacattcaaacagttcctccgccaccg

SEQ ID NO: 35173 - DNA, 231 bp, Glycine max
  Peptide Sequence Number=SeqID_126858
atgggttcccagctacaaggtcataatgaagataacaattgtacctcaaagccttacgctggggcaatgagggacatcgtgcatgagcgtcaagtgaacataggggcagatcaaaaattgattaaacgtcaaacggctccattgtcgtcactccaaaatggacaagtgactaaatcaaacagaacatacactctgagggagttcccggagaggtttgcaaagataggataa

SEQ ID NO: 35174 - DNA, 842 bp, Glycine max
  Peptide Sequence Number=SeqID_126859
ggcttcccggtatcaacagggacaccaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtgcagtggctcatgcctgtaatgccagcactttgggagtcccagctacccgggaggctgaggcaggagaatggcgtgaacctgggagcggaggttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcgagatttcctggaagatgccaggaagatacttaa

SEQ ID NO: 35175 - DNA, 858 bp, Glycine max
  Peptide Sequence Number=SeqID_126860
atggccttggcgctggcaccggtcaggcggctgacttcggagatgcgcatcggctcagtcccgcaccagcccgccatcgaccaccagattctggccggtcaccgcacgcgaccacgggctggcgaagaacagcgcggcatcggcgaactcggtcggcgttgtgacgctgcgcagcggcgtgttggcggcgatgtagtcgaacaccgcttcgggcgtggcggcgctggcatcggtggtgcgcagcaggccaccggacagcatgttcacggtgatgccatgcgggccgaggtcgccggccagggtgcgggtcagcgacagcagtgcggccttggcggcggtgtagtcgtggtagggcacgaccgggttctggaacaggttggtgccgatgttgatcacccggccgaagcgacgggcctgcatgccgggcagggccgcctgcacggtgttcagcgcgccgcgcacgctgccctcgaactgtgcctggaaggcgggccaaccgatggtggcggcactgtcgcgggcatcaccattgaacgagaacgctgcgagtgcgttgttgaccaccgtggtgacgccctggccgaagtgggccagggcgtgctgcagcatcgcatcgacctggcggcgatcagtgacgtcggccggcagtgcgatcgcctgtccgcccagctcggcggccagcgcccgagcggtgccttcgctgtggtggtagttgacgatgacgcgcgcaccctgtgcagcgaacgcgcgggcgatgtgctggccaagtccgcgtccgccaccggtgaccagcaccagctgttcgctgatctgcatgagggagctgccatccattgcatgaaagggcatgctgcgtag

SEQ ID NO: 35176 - DNA, 300 bp, Glycine max
  Peptide Sequence Number=SeqID_126861
atggtggtcacagctcgaccggagagggtggtaagacagtttggttacattcagagcatccctccgccgccttggtttttccgcatatctcacccattcatgataccgatccaggtaggtgaccagcctagagatgcactagccgcagaccctgaggagtacatacagccgtccagcccccaggttccagtgacatttgacccgcctcgacatgcagtggactgcctgacgattgccagagggggagccagtgctgatggaagtgtcagggcacgtcagagacgccgcagagagtattga

SEQ ID NO: 35177 - DNA, 609 bp, Glycine max
  Peptide Sequence Number=SeqID_126862
atgacgacaccccctccatctcccacacagtccgagattccttctgatgggacgtctaggaaaactagacaagccactcggctaagaaggttgacagcaagaacattggagcaagcaagggcaacagtcagtgtgaatccagcgactggtagaggatccggacctcacaaggatcagtttcacagttaccttggagttgtggcacgagacaagattccaattgttcacgctagctggaatgatgtacctgaaacactgaagaacatgatatgggatgacatattggcaaaattcgacatccccgagggtgataatgccaaaaagaaggtgatgtcaactgtggcaacgcgttggaggcaatttaagtcggcgttgacaactaaatatgtgtatggtaacactgacggccaagcaaaagatgatcctttggttaaatatggcattaatgaaaaagattgggccgagtttgaaaaaatgaggcaaacccctacctggcagttgacaaatgctcattttttgatttcaaggggatacggaaaaaggcacaagaaattcaaaagtacaatgactctccgcacctgttgtctaggggaggctatgagctgctag

SEQ ID NO: 35178 - DNA, 614 bp, Glycine max
  Peptide Sequence Number=SeqID_126863
cgatcaacgctttccttgcctatcatgaccataaggaaagcccggtcgtcgctatgctagccgacctatatgacacctttgaccgaagatgtgagaagagcaaccaactcttagcaaacaaagaaggagcgtctgtcaactggttccctcaatggaaggaaggaagagttggagttcttatttcatgcggaggatttcaaaatgtccccttgatggggacgaggggttgcatcagctacaatcccgttcttgctataagacaatttggctaccctatgagaggggcgccactagaggatgagctcgcgcctgtcatttcacaaggcttcaataagaccaacgtggagacacttcagaaggtccgcaaggcatgggaggtgttgcaaaagaaggacaaagaactcaggggcagtaacaatgggcccatcggtggctaccgtaaaactgctaaaagagaggaagttgaggcaccggaggaagacgaagaggtgcaggcccttagggcagaacttgagcaagcccgaacagtcaaagaaagggctcgtagggaagaacatggccggaacaagtttcgaggggctctgtggggcagtaacagcgagcttaaactctga

SEQ ID NO: 35179 - DNA, 873 bp, Glycine max
  Peptide Sequence Number=SeqID_126864
atggcccacaaattttgttttgaagcacttgatcaaagtttaagagacattatcacaaataaatcaaactcaaatcaaatatttggaggcaaagttatagtattcggtggagattttcgccaaatactaccagtcatcccaagaggaacctgctcaaacattgtaaatgcagcaataaattcatcctatctatgggatttgtgtgaaatattgaccttgacaaaaaacatgcgcttacacagcaatctagaatcaattgatgaacaagaaactgccacatttgctaaatggattctagacattgcagatggaattataggtgatgaaaatgatggttatgatacaattcaagttcctgctcatctactcattactcgatatgatgatccaatcagtgctatagtcaaatcaacattcccagacttagatcagcaccataataatcctgaattctttaaatccaaggcaatactagcttcaacaaatgaaacagtagaacaaatcaatcattatgtactatccttcattccagctgaaattatctcaggcaaaaacattggtctcgctgtttatattccaagaatgtcaatgtccccttcacaatcaccctggctgtttaaactattgagaagacaatttccgattatgctatcttatgcaatgacaattaacaagtcacagggacaatcactatccatggttggactttattttccaaaacctgtattcactcatggccaattatatgttgcattgtcaagggtcaactcagcaaaaggattaaaaatcttgattcatgatgatgagcaaaaaagcatgaattccactaccaatgtagtattcaaagaagtgttcagaaacattaaaagataa

SEQ ID NO: 35180 - DNA, 669 bp, Glycine max
  Peptide Sequence Number=SeqID_126865
atggtaggtgctgtgatcggattcttctggtataatacctatccggcacaggtttttatgggagataccgggagcttgatgctgggaggagtaattgctgtattggctattattttaagaaaggaattaatgattcctgttttatgcggaatattcctggttgaaaacatatctgtaatgctgcaggatgattatcataggagtaatgttggctatagtatgtctgattacattaaaaatgagataaaactctataaaagaggtggagagagtggctgtggtgctgcttatttagctaaaaagaagggtctggaggtatttctttcagacaaaggaactattaaagataactataaagcgtttcttactgaaaacaatattgagtttgaagaaggaaatcatgacgaggaaaggattttaaatgcagactggattgtaaaaagcccaggaattcctaaaaaagcggatattatttataaaatccatctgaaaggaatccgcctttcttccgagatagaattcgcttcagaattcaccaatgctaaaatcattgcgatcacaggaagcaacggaaaaaccaccaccacttcattgatctattatatcctgaaaaatgacggactgaaagtaggtctaggaggaaacatcggctacagttttgcaaagcag

SEQ ID NO: 35181 - DNA, 417 bp, Glycine max
  Peptide Sequence Number=SeqID_126866
atgggtgaagtagaggaggtgcaagagcagatgaaggctgacatgaaggccttgaaagagcaaatggccacaatgatggaggccatgatgagcttaaaggagataatggaggtcaatgtggctgcaatagccgctaccagcaccattgctgaggtggacctgacctcccccatatggcttcaaccaaataaatcatccaacctcagatatggtaggtccagaaggcaaagagttgggaggtacaggcggccctcatttagtgcgaaaaacaagcatgtatttccaccatatggcttgcttcccaactatgcaccacccaatgtggcatacactcccagtgaggatgttgataactccgtttcccatactcttttaaagccaaacaacctcaatctgatcatgcacatgtctctttga

SEQ ID NO: 35182 - DNA, 147 bp, Glycine max
  Peptide Sequence Number=SeqID_126867
atgaagatgctcttgataccacatgatatgaatggcaacagaatggagaaggaagagagagaggagatgccacttcaaggacaagatgagtctagaagaagctcaccaccatatgaggccattgataagagcttggaggaagaatga

SEQ ID NO: 35183 - DNA, 722 bp, Glycine max
  Peptide Sequence Number=SeqID_126868
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcacgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 35184 - DNA, 549 bp, Glycine max
  Peptide Sequence Number=SeqID_126869
atgagggagcgcgatagaagaaagtctctcgctttcttcttgagggatctaggcacgcaagtctcagtgatacaaagagtccacaaggcgtggagaagtccgttgaggaaaaacaagaagcttagaggcatccgaaatggcgtcatcggtggttatcatggatggctaagagttcacacgcgagggttagattggctctccaaattgaaagttatcaatgaggagaacttcgaagctctggaggaagatgaagaagtccaagctctaaaattagagctagggaaggcgacactcgccaaggagaagttcaaatcagccgctacacacatccggaaagagtgcaccgagttacaagaggaaaatgcggccactgcaagagcccttgaacaagaaaccaaaagggcccgcaaggaggaacatggccgaaataattctgaggattcaatgttgggtagcaacaatgagctcaacacttggaagcacggagcaaagcatgctagctatcatagggcaatacaaggaagagttgaaccagtttgtggcccatga

SEQ ID NO: 35185 - DNA, 303 bp, Glycine max
  Peptide Sequence Number=SeqID_126870
atgaaaagagaaaaacatgcctcctatagtagtcataactcttgcaaaagcctaagtgaacaacttcgtgactattacgaaggaaggcataggtcacatcttagacctcactcccatagaagagtaaaggaaagaaagcctcacgaggctaacattaaactcgcatacttccatgggaaggacaatgtagaggctaacttagattgggaaataagggtagagcaacaacttaaaaagaagacacattacttctcaatgtcccaccacaaaaaccatgattatgaggggccaagacatttatag

SEQ ID NO: 35186 - DNA, 222 bp, Glycine max
  Peptide Sequence Number=SeqID_126871
atggtagctaaacccaaaggaatagaggagcaatggggaataagtgggaaaaatgggaacataggctcaaaggggctatcaaaggaattaattcaaggtaggctcatttggctagaggcttgtaagaataaaatgcctaaatcatctcccaacatgcatctgaagcaagaagtatcaataagagtcaagccaaggctattgtgcaagcaatcaatggggtaa

SEQ ID NO: 35187 - DNA, 573 bp, Glycine max
  Peptide Sequence Number=SeqID_126872
atgacccaagagctgttagcccgcgaagacaccttacggttatccgcacctcgtcattcagtcaccccaagtctgattgacgagcagaggccaatatggtcatctgcaccctttccggagatgtcagcattttccgatggagacttttcaagtctcacaagttatctagaactacaggcggcgggcccgatgatacgcggagataccttacggttatccgcacccttgtgtcatccagaggcggcgggcccgatgatacgcggagataccttacggttatctgcacccttttgtcatccagaggcggcgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgacaagcagagacaaaatttggtcattctgcacccttgtgtcatccagaggcggcgggcccgatga

SEQ ID NO: 35188 - DNA, 213 bp, Glycine max
  Peptide Sequence Number=SeqID_126873
atggaactccaacgtcttaatcaaaatgaagaaatcgacaaaaagaaaagaagcatagcatttaaagcctactcatcaacgcaagaagaaaatgaagaagaagaatcagaaaatgaagaagacttctcactctttgtgaagaagtttaaaaaatttgtcaagaagagaagaatcgagaggagtcaaaacttcaacaatggaaaaaagatctaa

SEQ ID NO: 35189 - DNA, 201 bp, Glycine max
  Peptide Sequence Number=SeqID_126874
atgagatggataagtcctccacaacaacaacagcttgtccctccttttcagaatactgctggtccaagcaagccatatgttcctcctccaatacaacaacaacagcagcagcagtcacaacaaaaacaacaagcaattgaggttcctcctcaaccttccttagaagagttagtgaggcagatgaccatccagaatatgtaa

SEQ ID NO: 35190 - DNA, 684 bp, Glycine max
  Peptide Sequence Number=SeqID_126875
atgtctcctttccttgtgagagatttcggcacgcaaaatttcaaagctatacaaaggatccataaagcgtgggaaaccctgttaagaaaagataaagaacttaggggcattcataatggcattattggtggttatcatgaatggctgaaagttcatacacgaggtttagattggctccccaagttaaaggttgtcagcgaagagagtttcgaagcgccggaagaggacgaagaagtccaagctctcaaaaacgagttaggaaaggcgagacttgccaaggagaagttcaagttagccgctacagacatccggaaagagtgtgccgggttacgtgaagagaatgcaactaccgcaagagcccttgaacaagagaccaagagggctcgcaaggaagagtatggtcgtaacaaatttcgcagagctttgtggggtagcaacagtgaactcaagctgcaaagggaagaaagagaccagtcgcgagcacatggcatggtcttgaaagaggagttagttgcctgttcaaggtccaaaagaaacttgtctcagcgtttgtgcgagacagagaccaacatgctagctatcatcgccaagtaccaagaagagcttagtctagccatggcccacgagcatagggtcgcggacgagtatgcccaagtatacgcggacaaagaggctagaggaagg

SEQ ID NO: 35191 - DNA, 423 bp, Glycine max
  Peptide Sequence Number=SeqID_126876
atgaagcacttcactgacaccctcatcagtgccaacataggtggtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35192 - DNA, 192 bp, Glycine max
  Peptide Sequence Number=SeqID_126877
atggaggttgaggaaacctatcaggggttatggctaccattgaattatcgagtagatatgagagcaagtttagcatatgacatcgaaatttggggtgaatcctacaggctttttgctgcaaaattcttttttggctttgtggttgatttagggatggcctttgtggataattgggtggtggggaaggagaag

SEQ ID NO: 35193 - DNA, 561 bp, Glycine max
  Peptide Sequence Number=SeqID_126878
atgaccatgattacgccaagctcgaaattaaccctcactaaagggaacaaaagctggtaccgggccccccctcgaggcaatgctccagcctttatagatgagctaaggggctctggaggtggtggcgatgtgtctgttgcccattgctggccgtccccaggcccctgtggtgcctcgccctacgcctgcctgggggcgcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35194 - DNA, 377 bp, Glycine max
  Peptide Sequence Number=SeqID_126879
ggttgcgcgatgatcatggcgatgatggccgcctgcggcttgtggggcgtaagctgggtgatgggaaaacgtctggacagcggctggggcgtattgctgccctgcgcggccatgccggtatttgcactgtgggagccgagtttcagccagtggcgcttagtgatgatcgtcgcgctgctgctcaccgtggtgatgctgtttcaccatcgtctgcgtcattatctgctgctgccttcctgcctggcgctggctggcggtctggcggctatctcagtgaattttcacgtcatttaacggcgagcagaaacgacaatatcacgcaaaggcgtgatagcagcggtaacaatcaatggggatgtactgcagaagaagtgtga

SEQ ID NO: 35195 - DNA, 675 bp, Glycine max
  Peptide Sequence Number=SeqID_126880
atggttctctccgtcgtcagcgcgctggcgctggctgcaccggtatacgcaggtaaactcgcgattgtgattgatgacttcggttatcgtccgcactatgaaaatcaggtgctggcgatgccgccagccatctctgtcgccgtccttccgaatgcgcctcacgcccgtgagatggcgaccaaagcccacaacagcggacatcaggtcctcatccatctgccgatggcaccgctcagtaaacagccgctggaaaaagatacgcttcgtccagatatgagcagcgatgagatcgagcgcatcatccgtgacgcttacaacaacgtgccgtatgccgttggcctgaacaaccatatgggtagcgcgatgacctccagcctgtacggcatgctaaaagtgatgcaggcgctggaacgctacaacctctacttcctcgacagcatgaccatcggcaacagccaggcgatgcgtgccgctcagggaacgggggtgaaggtgatcaagcgcaaggtgttcctggatgatactcagaacgaggccgacattcgcgcgcagttcaatcgcgccgtgcagctcgcccgacgcaatggttcagccattgccatcggccacccgcatccttctacggtgcgcgttttacaacagatgttgccgaccttgccaccagatatcacactg

SEQ ID NO: 35196 - DNA, 486 bp, Glycine max
  Peptide Sequence Number=SeqID_126881
atgaagcacttcactgacaccctcatcagtgccaacataaatgtgaatggatctacacaaagctcaactcctaaacgctcacaacaggaacaactgcaacactggcaaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35197 - DNA, 827 bp, Glycine max
  Peptide Sequence Number=SeqID_126882
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggctatgccaatgccaataacgttcaagttcagacagcttacaaatgtgcatgcattctaagagatatgatctcgccctacctgctacgacgcatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35198 - DNA, 399 bp, Glycine max
  Peptide Sequence Number=SeqID_126883
atgagtcatcattcatctagtggtaatggtaagggtactagtcataaagatcctctatctagaatcttagatgagttgagttccctcaagttatggaaagaaaaaatagaaagaaaagaaaaaggaaaagagagggtagaaataaatcaagatgagagggaacaaataagggaagaagaaagaggaaaaatactaaaagagttaagaaaagaaaaacatgcctcctattgtagtcttgacttttgcaagagcctaagtgaagaacttcgtgactattatgaaggaaggcataggtcacatcttagacctcactcccatagcagagaaaaggaaagaaagcctcaagaggctaacattaacctcccatacttccatgggaaggacaatgtagagccttag

SEQ ID NO: 35199 - DNA, 291 bp, Glycine max
  misc_feature (249)..(249): n is a, c, g, or t
  Peptide Sequence Number=SeqID_126884
atgatacataactgtcgcaacgtgcccttcgcgagtgagcgagggcggggctcacgggtgcgctttccaaaggaggaaagatgcgcggagtcaccaccaacgtttatttgtgaaaaacatcgggaaaaccgaaggaaaccggtcgaaatgaaaattctaagttcgggagttgtatttacacttgaggaaggggaggagcttgccaaccagctcgcccaggcgagcaaggttgcttcctccagaagcaancggcttctggaggaagaaactggaaggcccaagtgggcctga

SEQ ID NO: 35200 - DNA, 302 bp, Glycine max
  Peptide Sequence Number=SeqID_126885
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgccttgggaggccaagacaagagaatcgattgagccacttggaaggctgaggtcaggggatcccttgagcccaagagtttga

SEQ ID NO: 35201 - DNA, 773 bp, Glycine max
  Peptide Sequence Number=SeqID_126886
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcagtcactggagagtttgaatcgcttatacaccttacatttattatgcgccgcatcatgagatatgttcgatcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35202 - DNA, 300 bp, Glycine max
  Peptide Sequence Number=SeqID_126887
atgaagatgcaagcaagcaatacacatgcagcagaaagtacacaagtgctcaaggctaggagggtgcagaggtttgggtgcaaagaagtcattctcttgtcctgggttatggagaatttgtccctaacagttaaccacttaatccaaccctatttcaatttactaagcgaaaatcaacttaggggaaaactgccaggaagccacattataaacaaaacctcgaagagagttgagcttcgtcctcaaaaggaaacaacaccagaatatttagccttccatagattcaaacaaaaaacgtaa

SEQ ID NO: 35203 - DNA, 174 bp, Glycine max
  Peptide Sequence Number=SeqID_126888
ttctgcacaccttcacctttaggatttgagagaagatattcaaggagagagaaaaaggaatcgcaccaagacagtacaagtggaggcttcaatcccttctctgtctctctgacgattgggaactctatcggagtagttagagaaaaaaatagagtaatctcaaggtactgctag

SEQ ID NO: 35204 - DNA, 420 bp, Glycine max
  Peptide Sequence Number=SeqID_126889
atgatcggccctctcgatgagtcgatctcttgctttctcataagggtggacccttgggtacttgtacctatcaccttgagaggactacatgtcctcgccatcagaggactgcatgtcctcaacttgagaggactacatgtcctcgccatcagaggacctcatgtcctcgccttgagagggctgcccgccctcacctccagaggactacatgtcctcgccttgagagggctacacaccctcaccttggagggctacacgccctcaccttgggtactagttaccctcaccgttgagaggactacacgtcctcgccttgagaggactacatgtcctcaccatcagagggctgcacgcccttacctccagaggactacaggtcctcgccttgagagggctacacgccctcaccttgggtactag

SEQ ID NO: 35205 - DNA, 486 bp, Glycine max
  Peptide Sequence Number=SeqID_126890
atggccctgacagcagcgataaaaagccagattgcgcaatggtataaggcgctgcagcagcaggttcctgactttatcccgcgcgcgccgcagcgccagatgatcgccgaagtggcgaagagtctggccggtgacgagggtcgccatctggccattgaggcgcccaccggcgtcggcaaaaccctgtcctacctgattcccggcattgcggatcagatcttcagcaaagatctgccgctattaaagaaaatcattcctgacctcaccttcaccgcggcttttggtcgcggacgctatgtctgtccgcgcaacctgaccgcactggcagccacggacgatcagcagggtgatctgttgctgtatctcgacgaacaggcggtgatcggttcgaaagaggagcagaaattctgcgcgcggctggagaaagacctcagcagctataagtgggatggcctgcgcgatcacagcgacgtggcgattgattga

SEQ ID NO: 35206 - DNA, 345 bp, Glycine max
  Peptide Sequence Number=SeqID_126891
atggcacaacctccaccccgtgagaggactcgaagggaaatggttacacctgatttcacctacgaaagcttgtgcatccaataccatgatgaggatgtcccatatgttcttaaaactggactgatccatttgcttccaaagtttcatggccttgcaggacttagtaacatggagagacgtatgatagatgctgctagtggtggagcccttggagacatgactcctgctgaagccagaaatttaattgagaagatggcttcaaactcccagcaatttagtgccagaagtgatgctattgtcattagaggagtgcatgaagtagccacgaattcatctcatcagtga

SEQ ID NO: 35207 - DNA, 420 bp, Glycine max
  Peptide Sequence Number=SeqID_126892
atggatttgaaggaaggttgtacttatgtgatgcacaattttaaagtcaccaagaatgatggacagtacagagtttgtgatcatccatataaattgacatttattggagttacggttgtcagacagtatggcttagatggccttcctttaaaaaagtatagatttgtagatttttcggatatcattgttggccaattacagtttgacctattagtagacatcattggtgttgttgacgaggttgtctttcatcatatttcacccagaagtaagagagttgtttttaagcttatgaatttgaggctttcagaattgggcattgagatccggtcagttttgacacgtcgttcccagtggagttcacagccttcaggttctgttcagttatcatcaagggagacattcatttccaagtcatag

SEQ ID NO: 35208 - DNA, 441 bp, Glycine max
  Peptide Sequence Number=SeqID_126893
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctggtcctgcctttcggtttaccggtgtcattccgctgtatggccgcgtttgtctcatcacgctgacactcagttcgg

SEQ ID NO: 35209 - DNA, 252 bp, Glycine max
  Peptide Sequence Number=SeqID_126894
atgggggtatgtgggcaagccatgacgaaacgtccttgggaagtaaaagaagaacgcgctgtttactacctaagcaagcaagttcgacgacctgcgataaaaggaagcgctttggcagattatttggctcagcagcctcttaacgactaccagcccatgctccggaattcccggatgtcaggatcatggcctttcgaggaaagacgaagccggggcaacttatcaacgggccatggtagctttgttccatga

SEQ ID NO: 35210 - DNA, 228 bp, Glycine max
  Peptide Sequence Number=SeqID_126895
atggccgtcgtgagccacctttacttgccgttgaacccccacaccaagaagaacactttaatcggagtggaattctcagaatcctcctcgaagattcgatggagaaaatccctcaatcctccatttcatagtttctctaagagacttgcgttggaccgacaagtgcgaatgagagagagacctctaagtgacgcaaagaagaactggcaaagagctcacgataggtga

SEQ ID NO: 35211 - DNA, 893 bp, Glycine max
  Peptide Sequence Number=SeqID_126896
atggctccaagaaagctttccatgaagagatctaggaaggacgccgcggccgaagggactagtgccgctcccgagttcgatagccatcatttcaggagcgctgagcaccagcagcgtttcgaagccatcaagggatggtctttccaccgagagaggcgcgtccagctcagggatgacgagtacacagatttccaggaggagatagctcgccggcgttggacgtcgctggtcactcccatggccaagtttgatccagatatagttctcgagttttacgccaatgcttggcctacaaaggagggcgtacgggacctccggtcatgggtaaagggccagtggattcctttcgatacagacgtcctcagtcagttcctgggatacccgctagtattggaggagggccaggagtgcgaatacggtcaggattttgcccggaccgctgccgggagacgggtgcggatcatgcgcaccaacatgactaccttgacccagacatggatgacgttgctgctcagcaacatcctacccagggatcataattccgacctccctctgccgaagtgtcagctggtgtatgcaatcctgacacggatgagcgtccatgtggctcagttgatcgttgatgccatttatttatttgcaggtatgccacctaccaggcaccctctagacccagataagtctaactgggccctgggttttccagcattgatcacgggtctctgccagtcattcagggttcctgtcacacctagtaaggtgattcgatcgccgatcacccgggctttcacagagaagtattgcacgcctagacaggcgcagggtggtgacccgcaggccctagaggcaccgtcgccacctcatcaggctgatcaagctgggtcatttgacac

SEQ ID NO: 35212 - DNA, 573 bp, Glycine max
  Peptide Sequence Number=SeqID_126897
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcacgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattggggctccgaataaaacagcgctaggcaatgaattcatggggctccgaagaaaagtggagaatggagaattggcgaacagcgctaggcaatcaattcgcggggctaaagactcgttggtggaggatgcatga

SEQ ID NO: 35213 - DNA, 828 bp, Glycine max
  Peptide Sequence Number=SeqID_126898
ggcaactccagcggcaagcttttcacaaagcttacagtaaaatctgggacttagccatggtagaagtctctgcagaggccattgcctccctcgcccagtattatgatcagccgttgaggtgcttcacctttggggacttccagctatcacctatggtagaagaatttgaagagatcctaggatgccctctagggggaaggaaaccatacctcttctcagggttctatccctcattagctagaatttccaagatagtccaaatctcggtgcaggaattagaccacaggaagcaagtcgaaaatggggtggttggaataccgagaaaatggttggaggcaaaagcaataatcttggcaggtggaggcgaatgggccccgttcataaacatcctcgcactgttgatctttggaggagtcctctttccaaatgtagatgggttggtagacctagcagcgatcgacgcttttctcgcctatcatgaccgcaaggaaagtccggttgtcgctatactagccgatctatatgacaccttcgatcgaagatgtgagaagagcagattcccaaatgttcccttcatggggacaaggggttgcatcagttacaatctcgttcttgctataaggcaacttggctaccctatgagaggggcaccactagaggaagagctcgcgcctgtcatttcacgaggtttcaataagaccaacatggagacacttcacaaggtctgcaaggcatgggaggtggtgcaaaagaaggacaaagaactcaggggcagtaacaatgggcccattggtggctaccgtaaatggttgaaagcccacgtgcaag

SEQ ID NO: 35214 - DNA, 705 bp, Glycine max
  Peptide Sequence Number=SeqID_126899
atgacattgctacttagcaatattctgcccagcgaccgcaatgccaatctccccctgcaaaagtatcagttggtctgtgtcgtcccgacatgggtaagtatgcatatggttcaactgatttcctctgtccaatcttgtggttgcgggatgaccggccccgccttgcagaggatacacgtcctcgaaaaaccatcgagggctgcggccttacctccagaggctacatgtggcctcttcagccttgagaggtgcctaccgccccctggacaggttaccctcacggtgcatcgccctcaagaccccagaggacccgaagaagtccaacagggtcgccttggaggtacacgctctaacttacgggtagttaccttcatcagttctacggagtacctgtacctccagcaagggcatcagccccctactaatcgagctttcatcaagaagtactgcgcccccaggcaggcgtcaaagggcgaaacaccacaacagcattggatgccggtagcgggcaatgacacctgccccacctctagaggggggcatgccctcaccttcagaggattgcacgtccttgccatcataggactacactccctcgccttcgaaaggcgacacgtcctgaacttcagagggctacacgccctcgactttagaggactacgcgtcctcactttcagtgggctccatatccacaccttaagataa

SEQ ID NO: 35215 - DNA, 267 bp, Glycine max
  Peptide Sequence Number=SeqID_126900
atggaagtgagagacaaggttgaactccttccatatagggacctagatgagctagtccaactttgtataagaatggagcaacagcttaaaataaagccttcttcaaaatcttatggctttcactcttatccaaggaaggaccaagcccaaggaattttgggggctacaccttcaaaacccaaggatgataaggtggaagtgaagatgaagcaaggggtgaagagtctagtgaggaagtctacccccatgaagaaggtgacctcctaa

SEQ ID NO: 35216 - DNA, 126 bp, Glycine max
  Peptide Sequence Number=SeqID_126901
atggaggaaaacgtggaggaagcttggacgggccccccctcgaggctcgatttcggtatcgataagcttgatcgatctgacgaccggctgcctgttcatgatgtaatcgattacactaaggattaa

SEQ ID NO: 35217 - DNA, 638 bp, Glycine max
  Peptide Sequence Number=SeqID_126902
gttgcacactctttgctaacaagagtgtcacacatgtacatgtggtattcttggatgcattttgtgaccttaaccaagctggaagctactcatggggagctgctgcattggtgcatatgtatgagaatttgaatgatgcgtcaaagagaaatatcaagcaacttgcaggatatatcacacttttacagtgttggatctacgagcattttcctactattgctccttgtattgctgctaaagattatcatgagaggaagtcacgtgcttgccattggaagtttgggaaggcattaccagtgtcaacatatcgtaagcggttggatagattgacatctgatgttcttggggatcctcctagacatccacccgtggtgcacaatgatacatttattgaaccagatccttctcaacaggtggtcgttgcactggctatgccaaaaccacctgcagatgaacttgctgatgtagacatgcctcgacatgcactggcttgccatgaaatagtagaaaggttggaaggcttgatcaacctgagggtagtcactaaaggaactgaagcatacactgtaaccgaggagtgcctaaggatcgccaggggtgtgactgcgcaagggaatgtatatgttcgatcaagatga

SEQ ID NO: 35218 - DNA, 275 bp, Glycine max
  Peptide Sequence Number=SeqID_126903
ctcagcagttgggctaagtgcacatccaccgctaagcgcagcttcagcgcgcttagtgcgacagaagaatctagcaaagcatcaatatcaaggttgtgcgctaagcgcaagatcagtgcgctaagcgcagcagttgtcttcagccaggctcagcgcatgactggcgttaagctcaaatccacttacggcacagaattccacagtagccacaatgcccatttcgggaaaagagctctggaggcagcaagaggagcagctttagtagagatacctag

SEQ ID NO: 35219 - DNA, 465 bp, Glycine max
  Peptide Sequence Number=SeqID_126904
atgaaacaggccaatgtattcccattgaagaaaacactcaagaaattcattatatgggaaatcaacagtgacaagggtatactcaaggaggattttcaggcttccagtagggtccttataatcaacaaggatagtggaggtcgcaccctggtaacaatgtcaaatcataaaagcaccgagtcagcactaaagaaccttgaggtccaggtgggacaactggccaagcagatagctgacaagtcatccaacaattttgtggcaaatacagaaaagaatcccaaggaggaatgcaaagctgtgatgacaaggagtaaaagatttgtggaggccgaggatgaggagagtgttgtgcataagaagaaagctgctaaaaagaaaggcactgagggcaagaaaaatgatgtgagaggtgaaagcaatcaagaaaaagagaaacaaataatggtcaagaaaaaaagaatttaa

SEQ ID NO: 35220 - DNA, 327 bp, Glycine max
  Peptide Sequence Number=SeqID_126905
atgacggtgaaaacctctgacacatgcagctcccggagacggtcacagcttgtctgtaagcggatgccgggagcagacaagcccgtcagggcgcgtcagcgggtgttggcgggtgtcgggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 35221 - DNA, 153 bp, Glycine max
  Peptide Sequence Number=SeqID_126906
atggcttctatggatacctctgctatggtcaactctaagatctttcccgtatttgctccgtgccccctatttaagggacctataaggggagaactaactaggcatttagtgataaccccccaaggtagtcgtatctctcttgatggtttctag

SEQ ID NO: 35222 - DNA, 687 bp, Glycine max
  Peptide Sequence Number=SeqID_126907
atgcataccggggcaagatttcacccgtgccgctgcaaagagacgagtgcggatcatgcgcaccaacatgaccactcttacacagatatagatgacgttgctattgttagcaacattctgcccagcgaccaagaagtccaacagggcgcctggggtcagactctggttacgggcctctgtcagtcctacagtgccgtccccccatcgaggtcatgccatcgtgacataggtaaggatcgcgcccacaagacacccagtggacccgaagaagtccaacaggggcctggggtttccagctctggttacgggcctctgtcagtcctacagggtgcccattcccccagcaaggaatcgcacccacaaagacacccagtggacccggagaagtccaacagggccctggggtttccagctctggttacgggcctctgtagtcctacagggtgcccgttcccaccggcaaggtcacgtcatcattacatagggatcgtggccgcaagacaccttgtggacccgaagaagtccaacagggtcttggaattgccaagctctaattacgtgcctttgtcagttctacggagtgcctgtcgcccccagcaaggtcatcaggccccctactcatcgagctttcatcaagaagtactgcgtcgccaggcaggcgcagggcgaaacaccacagcagcctag

SEQ ID NO: 35223 - DNA, 438 bp, Glycine max
  Peptide Sequence Number=SeqID_126908
atggttgttagtgaccatgcaatcttgagtgatagagcacacatcccaaccaaaagaagcctactagagctttcatcacaggacgcattgttggcacaaaacaagctgctgcctaagaaacttgaggcattgacagaaacattgagttgtgctatatgtggtggagctcacgaatttggctactgtatttccactaaagatacaacacatgaaggacaatggagaactcaccctagtaatcagttcaataaagaccagggtggaccatctaataggccacaacaacaagggcctagtctctatgataagacaacaaagctagaagagactcttgctcaatttatgcaattatccatgtccaatcaaaagagcaccaagccagccatcatgaatctagaagtccaggtgggacaattggcaaaacaactagcagactga

SEQ ID NO: 35224 - DNA, 873 bp, Glycine max
  Peptide Sequence Number=SeqID_126909
atgtgcaagtgccgttcacatggaacctttcccctcttcggccttcaaagttctcatttgaatatttgctactaccaccaagatctgcaccgacgaccgctccgcccgggctcgcgccctgggttttgcagcgaccgccgcgccctcctactcatcggggcttggtccttgccccgacggccgggtcgagggcgttgcgcccccgatgcctctaatcattggctttacccgatagaactcgccccgcgggctccagctatcctgagggaaactttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattgggggatcctctag

SEQ ID NO: 35225 - DNA, 570 bp, Glycine max
  Peptide Sequence Number=SeqID_126910
atgaccggaaggcttcttgccggttcattggctttcgaaagccgcatccttcattatctaattgtccgcatcttgcttctgagatcttcaaaccttgcacaagtttctgaagaagatctcattgttatgtgggcctttcataaaggtctaaaaattgattgggcacattttgtcagatatcgcatgcataaggcattgcgattgaatgctccattgccatatcctcatctagtcacccttttccttcaacagtttaacatccctcttgattatgaaccctatgttccaatcaagagatccttccttataggcgcttcagtcattgcatcctttggttatcaaaaagagcatgatgaaggacatgatggagaagattcatctcttcttttaaagattttggacaggtttgatggtcttcaaacctttgttggtgaaaagtttgacactttggaattacaagtggatatgcgcttcaatgagatggagtcaagaatcaccaaggttgaagaagatatgtcttacattcgttcaagctttgatctaccaccatcgccgccaccatcatcttag

SEQ ID NO: 35226 - DNA, 297 bp, Glycine max
  Peptide Sequence Number=SeqID_126911
atgagggcgtacaacgtgcaagcacaactagagagggaggcttcacgcagctactatgcataccggggcaagatttcaccgtgccctgcaaagagacaagtgtggatcatgcgcaccaacatgaccacttttacacagatatggatgacgttgctacttagcaacgttctgcccaacgaccgtaatgtcgatctccccctgcggaaggatcgcggctacaagacacccagtggacctggagaaatccacagccctggggtttccagctctggttacggcctctatcagtcctacagg

SEQ ID NO: 35227 - DNA, 51 bp, Glycine max
  Peptide Sequence Number=SeqID_126912
ttctctaaaggcgaagactttgagtcctctgaagacgaggactttgtgaat

SEQ ID NO: 35228 - DNA, 429 bp, Glycine max
  Peptide Sequence Number=SeqID_126913
atgtcctcacttcagagggctacacgccctcacttgggaactagttaccctcaccgtgagaggactacacgtcctcgccatcagagggctgcacgccctcaccttgagaggactacacttaccctcaccgttgagaggactacacgtcctcgccttgagaggactacatgtcctcaccttcagagggctacatgtcctcgccttgagaggactacatgtcctcaccttcagagggctacaagtcctcgccatcagaggacttcatgtcctcaccatcagagggctgcatgccctcacctccagaggactacctgtcctcaccttgagagggctacatgtcctcgccatcagagggctacatgtcctcgccatcaaaggagttcatgtcctcgccatcagagggctacacgccctcaccttgggtactag

SEQ ID NO: 35229 - DNA, 297 bp, Glycine max
  Peptide Sequence Number=SeqID_126914
atggggatcgcacccaagagacacccagtggacccggaaaagtccaacagggccctggggtttccagctctggttacgggcctctgtcagtcctacagggtgctcgtacccccccaacaaggtcacatcatcatagctctaattacgggtctctgtcaattctacggagtacctgtcacctccagcaagggcatcagaccccctactaatcgagctttcatcaagaagtactgcgtcccaggcaggcgcagggcgaaacaccacagcagcattgggatggccgatagcgggcaatag

SEQ ID NO: 35230 - DNA, 416 bp, Glycine max
  Peptide Sequence Number=SeqID_126915
atgaacatgatggaaggcacgctcgttcagatccgcgctaacgcggtggtgatggcaacgggcggcgcgggacgcgtgtaccgctacaacaccaacggcggcatcgttaccggtgacggaatgggcatggcgctcagccacggcgtgccgctacgtgatatggagtttgtgcagtatcacccaaccggtctgccagggtccggcattttgatgacggaaggctgccgcggtgaaggcggtattctggtcaacaaaaacggctaccgctatctgcaggattacggtatgggtccggaaacgcccctcggtgagccgaagaacaaatacatggaagctcggcccgcgcgacaaagttctcccaggccttctggcacgagtggcgtaaaggcaacaccatctccacgccgcgcggcgat

SEQ ID NO: 35231 - DNA, 342 bp, Glycine max
  Peptide Sequence Number=SeqID_126916
atgtctgcgagagatatctccctggaagtcaggatacttgtcttccctgagctggacacgcctctccctatggaaagaccatcccttgatggcctcgaagcactgctggtgcttgacacaccgaaaacgctgcatcttctaagatattgtctccacggtggtggtattgttcttcgtcgtcgtgatggggttctctgcggtggtagtgttgttctttgcctctatgatggggatttccgtggtggtggtgctgttcttcgttgccgtgatggggctctcctcagtggtttttgtgttagtgtagcagaagtgcagaacagcaaaagccaagatcgaataaag

SEQ ID NO: 35232 - DNA, 821 bp, Glycine max
  Peptide Sequence Number=SeqID_126917
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattcatcttgaagggaaaacccttcaatggcatactgcattcatgaaatttgttcattcctttcctcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35233 - DNA, 204 bp, Glycine max
  Peptide Sequence Number=SeqID_126918
gggcaggatcaccttgggctaccttctggagtagagacaaaacatgaacgacagaaaccaatcgaggacgaacgcaagcggggatggggtcacgaccgaccgatcgttgcttttctctgtgcgaaacgagcagagaatgtcgctgcaaggcagccccgtatcctttgtattttgcagctttcttttactatttgtttgttttaa

SEQ ID NO: 35234 - DNA, 762 bp, Glycine max
  Peptide Sequence Number=SeqID_126919
atggataatgaagagggagtgcaagaacagatgaaggccgacctatcgacctttaaagatcaaatggcttctatcacggaggccatgctaaagcttcagaaaactatagaggataatgccacggcgaccgcctccaatacagctagggaagcggaaccggtgctacagcccacaataaacttaggccgagatagaaacacgacggtgttcggtcggaggtatagtcctcaagcttacccttatggcttgcctctagacttcactccccgtaccgctccggacgatttgaaccaagcccctaccttcgaggggcaactccctccttatgccgattatcccctgcaagaagacgatgaagaagatgcccgtctaggccctctactgcccctcaaggatccggccccccatgaattgccccaaccaaacatagtccgccatgtcccgtctccacccgcacccgttaaagaatccgttccctttgcaaaagataagggaaagattgatttacttgaagagaggctgagggcggtagaaggcctcggcaactacccattctcagatttggcggatctgtgtctgggacgacatgtccaaaaggacatcttcggatgtattgccgaaagatggggcatattctacggacgaaaagttgttgatgcatttctttcaagacagcttagccggagcagcagtgccatggtataccaatctggaagcttcttaggtctggtcatggaaagacttggcaactgccttcattag

SEQ ID NO: 35235 - DNA, 335 bp, Glycine max
  Peptide Sequence Number=SeqID_126920
gtgctccagtggcttctgtttctatcagctgtccctcctgttcagctactgacggggtggtgcgtaacggcaaaaagcaccgccggacatcagcgctggcaagtgtagcggtctcgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 35236 - DNA, 381 bp, Glycine max
  Peptide Sequence Number=SeqID_126921
atgaagtttgatggttcgcgtactatgcatgaacatgtcattgagatgacaaacattgcaacaagacttaagaccttgggaatgactgtgaataagaactttcttgttcagtttattctaaactcattaccacctgagtctgacccgttccaaatgattcaggaaaaaacgaggcttaagaatcaaggaagtcacttagtccattatgtaagtcaccaagggaatcaaggagctgaaaagaaatttatgaagaagcatgataaaggcaaaagctcattaaagatcaatgacgacactttgcaaatccagaatgaggtatcaaaaagagcaataattgccaattttatgggaaatctagacatttccagaacgattgcctaa

SEQ ID NO: 35237 - DNA, 899 bp, Glycine max
  Peptide Sequence Number=SeqID_126922
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcacccgccggacatcagcgctggcaagtgtagcgggcgcgtcccattcgccattcagggctgcgcaactgttgggaagggcgatcggtgcgggcctcttcgctattacgccagctggcgaaagggggatgtgctgcaaggcgattaagttgggtaacgccagggttttcccagaattcgattcgtctcgaaaacaccctccttttaaaccgtcaacatttaacctatcttctcggacaccctcacctaccctatcttctctgacaccctcactaatgagtgattgggtcctccacacatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35238 - DNA, 186 bp, Glycine max
  Peptide Sequence Number=SeqID_126923
atgggacaccttagtgatcaaggggttcccacggaccctaagagaataaaggtcattcctgattggcccactccaccaagtgtcgagggaaggagcccagagtatgaagaacctcgggatttgaggtcaaatcctttccaacgtggaggggatgatgcaatcctaccccccaagggtattggatag

SEQ ID NO: 35239 - DNA, 365 bp, Glycine max
  Peptide Sequence Number=SeqID_126924
atggtgggagcaggtttgaaaaaggatcttagagtgtctagggttgtgccaggagggtctcttaatgccttcctttttcttctcatcggagttatttcacaaagacttgccatggatggcccagctgcgtcaagggaaaagaaaagaaaaactgacttgactccttcatgcatgctccactcggctcgggggggatatagctcagttggtagagctccgctcttgcaattgggtcgttgcgattacggacgggctgtcaagaacgtagaggagggtttcctcacttgggctcctggggaagaggatcaagctggccctcgcgaacagcttgatgcactatctcccttcaaccctttgagcgaaat

SEQ ID NO: 35240 - DNA, 761 bp, Glycine max
  Peptide Sequence Number=SeqID_126925
atgtccagaaagagtgtgccgggttacgagaagaaaatgcagctaccgcaagagcccttgaacgggaaaccaagagggctcgcaaggaagagtatggctgagacaaatttcgtggagctttatggggcaacaacagtgagctcaagcttcgaagggaagagagagaccaatcactcccgcattttatctctagcatgcatttctttctttctttacccactcctcacgtttggttttttagggaaaaacaccataactaaacgcgccacaaggcatccctatcgcaccagatccaaatctagaacgatgggtgatcaagagaagacacaggaacagatgaaagccgacatgtcggctctgaaagaacagatggcttccatgatggaggccatgttaggaatgaggcagctcatggagaaaaacgtggccaccgctgccgctgtcagttcggctgctgaagcagacccaactctcttggcaactgcgcaccatcctccctcaaacatagtaggacggggaagggacacactagggcacgatggcaaccctcatctgggatacaaccgagcggcttacccttatggattgccgcccaactactcaccacccgtcctgcaagacgatgcgggccatattgcttctcccatccttgaaagagaaccttctcaacagcccgacgaggtccacaaagaccctcaagactatgctcgaagggatgtcgagttctttcccccgatccccgaagggccggcacccagcac

SEQ ID NO: 35241 - DNA, 634 bp, Glycine max
  Peptide Sequence Number=SeqID_126926
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccaaactctgcgttgcagtacctaaaatctgtctatacggattatggaactaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35242 - DNA, 183 bp, Glycine max
  Peptide Sequence Number=SeqID_126927
atggcgttttcgttcatgaattgcgttttcgttcatgtgtcctccaccttcgagtttggagctatgcgtagtgattgcttagtgcaattctccattctcaacctttttcggagccccatgaattgcgttttcgtcatgtgtcctccaccttcgagtttggagctatgcgtagtgattgcttag

SEQ ID NO: 35243 - DNA, 159 bp, Glycine max
  Peptide Sequence Number=SeqID_126928
ggcgcgtcccattcgccattcaggctgcgcaactgttgggaagggcgatcggtgcgggcctcttcgctattacgccagctggcgaaagggggatgtgctgcaaggcgattaagttgggcatcaagcttatcgataccgtcgacctcgagggggggcccg

SEQ ID NO: 35244 - DNA, 1666 bp, Glycine max
  Peptide Sequence Number=SeqID_126929
atgaccgatacgccggacgcgccgcagagcgatgatgtgctgatgcgctgtgaaggcgcgcgcggtactagtcgggtgatctgcttctcaccggatcacagcaaaactctgcccgaactgccgctgcacaacttgcaggatatcgtgcgtacctggcaggagcagaccgctgaactcggtcagcactatccgtgggtgcaggtatttgaaaacaaaggcgcagccatgggctgctcgaatccgcatccgcacggtcaggtgtgggccaacagttttctgccgaatgaagcgcaaaaagaggatgacaaccagcgccgctactttgctgataaaggtacgccgctgctggtggattacgtaacgcgcgagttgcaggacggcagccgtaccgtggttgaaaccgatcactggctggcggtagtgccgtggtgggcggcctggccgtttgaaaccctgctgctgcctaaaacgcacgtgaaacgtattaccgatcttaacgaggcgcagcgcaccgatctggcgctggcgctcaagcagctcaccagccgttacgacaatctgttccagtgctcgttcccctattcgatgggctggcacggcgcgccgttcaacggcgaagccaacgatcactggcagctgcacgcgcacttctatcccccgctgctgcgctccgcgacggttttcgctgacaccttcggctacgcgccgagccacagcattcaggcaccgggccgggtgaacctgatcggcgagcataccgattacaacgacggcttcgtgctgccctgcgccattgactatcagaccgtgattgcctgcgcccgccgcgacgatcgccaggtgcgcgtggtggcagtggattacgacaatcagcaggatagcttctcgctggatgcgccgattgagccgctcagcgaaccgatgtgggccaattacgtgcgcggcgtggtgaaacatctgcagcagcgcgatgccagctttggcggcgtggatatggtgatcagcggcaacgtgccccagggtgccggtctcagctcgtccgcctcgctggaagtggcggtgggcaccgtgttccagcagctgtatcagctgaagctcgacggcgcagcgattgccgttaacgggcaggaagcggagaaccagtttgttggctgcaactgcggcatcatggatcagctgatttcagcgctcggccagcaggatcacgccatgctgctggactgccgcacgctgggcacgcgcgccgtatccatgccggaggatgtcgcggtggtgatcatcaactcgaacttccgccgtaatctggtgggcagcgaatacaatacccgccgcgagcagtgcgaaaccggtgcgcgcttctttaacaaaaaggcgctgcgcgacgtgacgctggaggagtttgcggcggcagaacagcagctcgatccgctggtggccaaacgcgtgcgtcacgtgatcaccgaaaatgcgcgtacgctggaagcggcggacgcgctgagcagcggcgatctgcaacgcatgggtgagctgatggccgcctcgcacgcctcaatgcgcgacgattttgagattaccgtcgcgcccatcgaccagctggtggagatcgtcaaagcggagatcggcccgcgcggcggcgtgcgtatgaccggcggcggcttcggtggct

SEQ ID NO: 35245 - DNA, 363 bp, Glycine max
  Peptide Sequence Number=SeqID_126930
atggtttcaagatatgctttaaatcagattgctgctgaattagagtgtgttgactatgctggcaagaatccctcaagttgtggttacatggtgagaaccatgcttggtcttccttgtgcttgtgaactatccaaatatgttagtggttgcatcccactggattcaatccatatgttctggaggagactaagtttttcagaccaagggttatttgagcccgagaattcgatgtgtcctcctccagcaaaggttaacacaaagggggcaccgaagaaagttatgagcaggatcccaaggtcaacaaagcacgatccatcttactgggagtatgtagatgcctttgaatctatgacaacaaaatag

SEQ ID NO: 35246 - DNA, 294 bp, Glycine max
  Peptide Sequence Number=SeqID_126931
atgtgggctttccttaccggttgtcagatcgactgggctcacttggttcggtaccgaatgcataaggcattacgggccgatgcacctctcccttaccctcaattggccactctgtttctctgtcattttcaaattccgcttgatgatgaaccttttgttcaagtcaagcgttcctttgctattggtgctggtgcggtcacttcttttggataccgtaaggatcggaatggtcaatggctgaagaaagatgcacttccttcacaagatgagcgtacttcttctcctcctccttag

SEQ ID NO: 35247 - DNA, 540 bp, Glycine max
  Peptide Sequence Number=SeqID_126932
atggggatcgcacccacaagacacccagtggacccggaaaagtccaacagggccctggggtttccaactctagttacgggcctctatcagtcctacagggtgcccgtaccccccccggcaaggtcacgtcatcatagggatcgcgactgcagacacccagtgacccgaagaagtccaacagggtcttggaaatgtcaagctctaattacgggtctctgtcagttctacggagtacctgtcactccagcaagggcatcaggccccctactaatcgagctttcatcaagaagtactgcgccccagacaggcgcagggcgaaacaccacagcagcattgggatggtcggcagcgggaaacagacgcaccgccatcacctctagagttcacctctactcatccacaaaaaggtttgagtattgcctacacaacatggccgaccagcaggcgaccaagtccaaagccaaaggtaagcaaagtactaggtccgtgacctacaagccatcatgcgtccagctcaagacgttaaagaagcgctactag

SEQ ID NO: 35248 - DNA, 732 bp, Glycine max
  Peptide Sequence Number=SeqID_126933
atggggacaaatcaaaacggaaaaagattttatcaagtcaaggttaagggtctagatgtcaccaacctcaaggaattgggactattgatgggacctctccaaaggcaagccttccgcaaagtgtacggaaagattctagatttgaccgcagcggaggtatttacggaagctattgtatccctcgcccaatactatgaccagccgttgagatgcttcacgtttggggacttccaaatagtaccgactgttgaagagtttgaggagatattaggatgccctcttgggggaagaaaaccgtaccttttctcagggtttcttccctccttgagtaagattgcagctgtggtcggagattcggcaaaagagttggatcgcatgaagcaaactcggaacggcgtagtgggccagccgcggaaatacttggatggcaaggcaagggatatggcaagccaagagaagtgggtcccgtttgcggatatactagctttgctgatcttttggggttgtcctctttccgaacgtggacgagtcgattgggaccaacacttggctgggataggaggcagcacaattaattggtttcctcgatggaaggaaggaaaggagggagttctcttctcatgtggggactaccctaatgttccattgatagggatgaggggttgtattaactataatcccgcacttgccacaagacagctagggtaccccatgaggggaggaaccatctag

SEQ ID NO: 35249 - DNA, 723 bp, Glycine max
  Peptide Sequence Number=SeqID_126934
atgaaacgctggcatattcttttgatcatcggactgaccggtgtcgcatcgcttttacttgcgacgtttgagcagctcataccggggcagcaagcttcattggctatgcgcctgctgatcctcgtccagccggcaatcctgaccgttacagcggtggcaaccggtcaggctcttgccgcgaaactcgggcttggcgccccgttgatcgatagctggttgcagggtgacaatacgcgcgcagtgctgcgaagacagttgccgcctgcgcttgcggcgggcattgccgtcgccgtgttgatgatcatctattcgtcggtgatcctgcccctggtcacggatgcggcaaccctggcaaaaatgaccagatttgacatcccgctggcgacccggattttatatggcggcatcacggaagagctgctgacccggtggggcctgatgtcgtttttcgcatgggccctctggcgcgtgacaggaagcggggaaatccgatcatctcttgtatgggctgccatcataatcgccgcagctctcttcgccgccggccatctgccgcttctgttcacgatcgccgctcagccgcaaccggcgctcgtccttgcggtgctgctcggcaactttattcccggcctcatcttcgggtggctattctggcgtcggggactggaagcggcgatactgtcccatggctttgcccattgcctgaacgcgctggccgcctga

SEQ ID NO: 35250 - DNA, 195 bp, Glycine max
  Peptide Sequence Number=SeqID_126935
atgaaggacaagagggatgagtgtgaaaaagaggctaagtttggaattgcaaaatgtagcatttgggctaagcttagtagttgggctaaatgtatatccaccgctaagcgcagcttcagcgcatttagcgcaaaggagaatctggcagagcatcagcatcaaagtcacgcgctaagcgcgagatcagtgcgctaa

SEQ ID NO: 35251 - DNA, 336 bp, Glycine max
  Peptide Sequence Number=SeqID_126936
atggtagccataatcccagaaaagattcctcaaccttcattttcccaaggatacaactcgaatgcaacatgggcttatcatggaggagttatagggcattccattgagcattgtatgaccctgaaacataaggtgcaaactttaattgatgcaggctggctaaaatttgaggaggataattgcataacctgcacagttcctttcacttttccttgctacaaggtcatgacaaaagacagcaatagatacctcagagccctacactggggcaatgagaggcaccatgcatcagcctcaagcgaacctaggggcagatcagaagttctcgcccgatag

SEQ ID NO: 35252 - DNA, 264 bp, Glycine max
  Peptide Sequence Number=SeqID_126937
atgtgtgttcaggaagaagaaaggcttgtaatggagatgggtgagagtgcactgctgactactgcttatcgataccgtcgaccaattaagtctcaagcttatcagaaggggaatgcaaaaataccacctcaagctgatattaagaaggtggcaaagtgtttcttttgcaagaagaagggacacatgaaaaagaattgccccgggttccagaaatggcttgagaagaaagggtatgcaaaacctaaggaaaccagtgggaagtga

SEQ ID NO: 35253 - DNA, 363 bp, Glycine max
  Peptide Sequence Number=SeqID_126938
atgaaagaaagcctcaagaggctaacattaacctcatacttccatgggaaggacaatgtagaggctcacttagattgggaaatgagggtagagcaaaaacttaaaagaaagtctactttaaaatcttatggctctcattcttatccaaagaaagaccaaggtctaggcatcttaggggcagcaccttctaagcccaaagatgataattggaagacaatagaaaagcaaccccctaaggctagtatgcaagagaagactagctccatgaagtgctttaaatgtcttggaagaagacacattacttctcaatgccccaccaagaaaaccatgattatgagggccaaaacatttatagtagcctag

SEQ ID NO: 35254 - DNA, 471 bp, Glycine max
  Peptide Sequence Number=SeqID_126939
atggcaagaaatgaaccgattgacgccaatcggctattgaccgtcggggaagtggcgaaacgcagcggcgtggcgatatccgcgctgcacttctacgagagtaaagggctgattcaggcgacgcgcaacgccggcaatcagcggcgttatccgtcggtggtattgcgctatatcgcggtgatcaagatcgcacagcgcgcgggcattccgctggaagagatccgcgccgcgctgagccgtttccccatcggcagcaagctgacctcagaacaatggggagtgctgtcctccgcctggcgcaaaacgctggatgagcgtattcaacggctgacggtgctgcgcgaccatctcgatagctgcatcggctgcggctgcctgtcgctcgccgactgcccgctgcgcaacccgaacgatatattgggccggcaaggggccggcgcgcatattttcgaacacccggatgggcagtga

SEQ ID NO: 35255 - DNA, 386 bp, Glycine max
  Peptide Sequence Number=SeqID_126940
gtgtgccaccaaccaggcaccctttagacccagataagtctaacagcgccctgggttttccggcatttgatcacgggtctctgccagtcgttcgggagcggtatttacgacatttggttcgccaacaggcggccaaccacagggtgcacgtgcagacccatgactgcctctaccaactcagccttagcctgcagagccagggtttccctccttttccatgccctacttcggaccagttcagggaagaggtcgcatggcccggggattggcctgaggcccaggcaggggaggcacccgcagtggctcccggcgatgcagatgaggcccgcatggacgaggagatgacaaatttacttgacttcttgggagggagcggagccacatga

SEQ ID NO: 35256 - DNA, 114 bp, Glycine max
  Peptide Sequence Number=SeqID_126941
atgaaagggaaggaattggaaggaggattggtgccatcccttgaagaatttgagttaagaagaaaggggccaaccgccttaaaagctattggactaagaagcactccaaattga

SEQ ID NO: 35257 - DNA, 489 bp, Glycine max
  Peptide Sequence Number=SeqID_126942
atgaaagtagatccgtctgtcccctacaaggtcatcacatgtgtgccgagaaagggaaaacaaattggaagaactcttggcagaaaagataaggagcttagaggaagcaacaacggtgttatcagcggctatcataaatggttgaaggatcggacgcaagggataacttggctcccgaagctaaagatttcaagtggggaagaagctgaagtccttgaggagagcgaagaagtgcaagccttgaaagcgaaacttgaaaggacgcgagtggtcaaggaaaagttcaagatgacgaccatcagggtcaggaaagagtgtgacgagctgagggacgtcaacatgaccatgatcgaagcattggagcgagaaatgaagagggttcgaaaagaagaatgggccaaaacaagttccgaggggctttatggggcagcaacaacgaactcaagcttcgaaggaccgaaagagacaagtcgagggtggaaagtatga

SEQ ID NO: 35258 - DNA, 141 bp, Glycine max
  Peptide Sequence Number=SeqID_126943
atggctcaatcgacgaacataaagcaagatttctttgatccttttgctccggttgcaaggcaggataccatttggatgttgctagctattgcagcacagaagggaaggaaaatgtaccaacttgatgtcaagttttcttaa

SEQ ID NO: 35259 - DNA, 980 bp, Glycine max
  Peptide Sequence Number=SeqID_126944
atggggacaaatcaaaccggcaagaggttttaccaagtcaaggttaaaggcctagataccaccagcatcaaggaattagggcggttgatggaacctctccaaattgaagctttccacaagatttacggaaagatcttagagttgaccatagcagagatatccatagaagccattgcatcactcacccaatactacgaccagcctttgagatgcttcacgttcggagatttccagttagtaccaaccattgaagaatttgaggaaattctaggatgtcctctcgggggaagaaaaccatatctttcctccgggtgtctcccctctttgagcagaattgcaactgtggtcaaggttttagcaagagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcgcacttgttccaacaagacacaagacatccatgtccgctcctgagccatcgctcgtgtactgaaaaaaggagaatagattgggaccagctcttggccgggataggaggtagaacaatcagttggttcccccgatggaaggaaggaaaagaaggagtccttttctcatgtggaagatacccaaacattccgctggtaggaacgaggggttctattaactacaatcccgcgctcgctataagacaactagggtaccccatgaggggagcaccaacggaagaaagcatgtctcctttccttgtgagagatttcggcgcacaaaattccaagactatacaaagaatccataaggcatgggaaaccccgttaaggaaagatcaagaacttagaggcattcgtaatggcatcattggtgggtaccacgaatggctgaaagttcatatacgaggtttagattggctcgccaa

SEQ ID NO: 35260 - DNA, 744 bp, Glycine max
  Peptide Sequence Number=SeqID_126945
atggatgtgttagctttgctaatttttggggtcgtcctctttccaaacgtggatggtttggtggacctagcagcaatcaacgctttccttgcataccaccatagcaaggaaagtccggtggtagctgtcttggcagatttatttgacacatttgaccaaaggtgcgaaaagagtagcgcacggatcatctgttgcttgcccgctctctgcgtttggttggtttcacacctgttccagcaagacacgaggcatccatgtccgctccagagccatcgctcgtgtactgaaaagagaagaatagattgggaccagtttttgactgggataggaggtagaacaatcaattggttcccccgatggaaggaaggaaaggagggagtccttttctcatgtggaggatacccaaacattccgctgataggaatgaggggttgtattaactacaattccacgctcgctataagacaactagggtaccccatgaagggagcaccgacggaagaaagcatgtctcctttccttgtgagggatctcgaaaagagttttgaagcaccggaagaggacgaagaagtccgagttctcaaaagcgagttaggaaaggagaaacttgccaaggagaagttcaagttggccgctacacacatccggaaggagtgtgccggattacgggaaaagaatgcaactaccgcgaaagcccttgaacaagagaccaagagggctcgcaaggaaaagtatgggcagtaa

SEQ ID NO: 35261 - DNA, 336 bp, Glycine max
  Peptide Sequence Number=SeqID_126946
gaacatgagatggaactccaatgtcttaatcaaaatgaagaaaatgacaaaaagaagagaagtatagcccttaaagtctcatcatcaatgcaagaagaaaacgaagaagaagattcagatgatgaagaaaaatttatcaagaaaagaagaattaacaggcgtcagaacttcaacaatggaagaaaatcacaagaagattctcaagtccttaggtgttacaaatgcatccaaattggtcacatcaaggccaattttccttcaaatgaagaatgtcctgagaaaagtgaaaagaaaaggtatgatgaaagaaggaccaagaaagcctacattgcatag

SEQ ID NO: 35262 - DNA, 319 bp, Glycine max
  Peptide Sequence Number=SeqID_126947
atggaggttgacctacctctaggttggaaattgcttagcctagagcattatgatgggaccaccaacctagatgagcacatagatgtgttcttcacgcaggccaacatctacactatgactgtcataacctacccttcggcgggagggcgaaggccaaatagatgggccaaagcattagtctccaagggagaaaacaagaaaatggcatctccaatcatcttccttctccattccgctatcattcatcttcaagaagcaaaggactccattgatgaagagatccaaggcctacaagctccacatggagctacatcatgtg

SEQ ID NO: 35263 - DNA, 252 bp, Glycine max
  Peptide Sequence Number=SeqID_126948
atgaagtcaggtgacatgtggggataccgtatgggacagcaagtcaggtggcaggcggagataccttataatcattcgtacctttcgtcaaccaaggtttttactctcgtcgtccggagacattcaagcccgacgatgcacgagattcttctctgctgggcggggacgatgaagttcgatagggtgtggaaacgttgttccgctggtcagtatattgaccggctgaatgatgttccgctcgaacgaaattag

SEQ ID NO: 35264 - DNA, 731 bp, Glycine max
  Peptide Sequence Number=SeqID_126949
tctagatgtcactagcctcaaggaattgggacgattgatgggacctctccaaaggcaagccttccgcaaagtgtacgggaagattctagatttgactgcaacggaggtatttatggaagttgtcgtatccctcgcccaatactatgaccagtcgttgagcaaggttgcagctgtggtcggggattcggcaagagagttggatcgcatgaagcaaactcgcaacggcgtagtgggcctaccacggaactacttggaagacaaggcaagggatatggcgagccaagagaagtggggcccgtttgcggatatactagctttgttgatttttggggttgtcctctttccgaacgtggacggtttggtggacttggccgccattgacgctttcctcgcatatcaccatagcaaggagagtccagtggtggctatcttggcagatttgtttgatacctttgaccggagatgtgagaaaaatagtgcacgaattgtctgttgtttacccgctctctctgtgtggatagtttcacacctattccaacaaggcaccagacacccgtgtccgcttcaaagctatcgctcatgcgccgaaaaaggaagagtcgattggggccaacatttggctggaataggaggcaacgcaatcaattggtttcctcgttggaaggaaggcaaggaaggggttctcttctcatgtggggactaccctaatgttccattgatagggactacgg

SEQ ID NO: 35265 - DNA, 456 bp, Glycine max
  Peptide Sequence Number=SeqID_126950
atggcagcgcaactaatccatgatcgagtggagatggagtgcctagagggagcttgggagaccctcgaaggcaatgcgtggtgccgattccggggcacgattcaattcacggctacttcattggtgcatccagaagaacccgcgcgcacgcttcagtgcactgtggagtggatattacccacgcctacaccatatcgtctagtagagccagtccaagtgatcgaggtgacgtcatctaaggaagacccagaggagctacatcctgagcccgctatggatgctcttgactttctagagggtgatgaggacccactccctgagtggactctcccgaggacgtcatgtcggcatctgaggcagactttacggaggagagcggccctggagagatggcgactagtggaggctcttcatcatagtagacagctccttagactagttttatatactttttga

SEQ ID NO: 35266 - DNA, 237 bp, Glycine max
  Peptide Sequence Number=SeqID_126951
atgactgaagcacgtcaaaagggggtacagaaacaaaataggggaggagcttgccacccagctcgcccaggcgagcaaggttgcttcctccagaagcaacaaccttctggaggaagaatctggaaggcccaacttttgaagaagttacgaaaactcacggattgtgaaaaatacctcctttcgatttccgtcaccttacggaattttcacggatcgcgtaagcctgcttccttttga

SEQ ID NO: 35267 - DNA, 396 bp, Glycine max
  Peptide Sequence Number=SeqID_126952
atgccagtttgctggcctcagacatcgacaggcactggtccgtggcggttttgttacagtcaaagtcagagttcatgccggcgcagccggtcagcgccgcgcacagcagtgcgtacgcaaaaagtttttgcatggggggtatcctcagtggcggcctggccgcagcggtccttaagcgcatcctcgctcataacgcgatgtctgctggcagcgggtacgttttttaccggtgcttttatgcgtgcccagacgtctgcgcgcggtgtgcccggtgaaacctggcgaatgacgtcagtaatgtacgccgccagccgctcaatcgtgacgtcagcgagtgcgggtacgtgcccggaattctctgccagcgggcgaattgccgcatccggaaccggtcgg

SEQ ID NO: 35268 - DNA, 580 bp, Glycine max
  Peptide Sequence Number=SeqID_126953
gggatggatggcatgtctcattagctggcactggctttggacacagggggcaggctatttggctagaatattatgcctttctatcccttgattcgacgagagctttcccagagattctcatagatcggatgatcctgagacctattgtacctcagttggggaatcttccagcgactaagctatttgtctggccaggcgcttctctgtgggctcttgggaaacagtctcatctggtggatatcagggaattagcaaaaaacagtaccaaagagggacttagcggcaaagaggcgattagacaaggaaatatggaattttgtttactgcactttctcttaagcagtgcgcggtgtcactgcagcaagcgtatgcagcctcacagttgtcttttattgcccatcgataaaggaatgactcttggtgagccaatgagctcaaatcaagctagagaacttcctgaaccagatagtgtgacggcggaacttattgctatctatcaattcccagagtttagttcagaacctcgtaggccgggaatgccatcaagaagccttttcctctcggtgtcagtgtcagccaa

SEQ ID NO: 35269 - DNA, 399 bp, Glycine max
  Peptide Sequence Number=SeqID_126954
atgaccatgattacgccaagctcgaaattaaccctcactaaagggaacaaaagctggggaataacatcgaattcctgcagcccgggggatccactagttctagagcggccgccaccgcgggggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcggcggcgggtgtggtggttacgcgcagcggacccgctacacttgccagcgctga

SEQ ID NO: 35270 - DNA, 168 bp, Glycine max
  Peptide Sequence Number=SeqID_126955
atgggggttccaatggcaacgaagcccactagggccttccaggatgttcctccagaaggcggttgcttctggaggaagcaacctagctcgcctgggcgagctgagctcgtttgggcgagctgggggaaggagggaagaacaaaaatgttcaaccttcctggtatctga

SEQ ID NO: 35271 - DNA, 848 bp, Glycine max
  Peptide Sequence Number=SeqID_126956
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctaaaggttcctgcacttttggggaaaggtgtcacttcgcacatggaaatgatgaattgcgcaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35272 - DNA, 366 bp, Glycine max
  Peptide Sequence Number=SeqID_126957
atgtcctcgccttcagaggacaacacatcctcgccttcaaaggacagcacgtcctcatctttagagggctacacgatctcgccttcagaggactacacgtcctcgccttcagaggactacacgccctcgccttcacaggattacatgtccttaccttcagaggatagcacgtcctcgccttcagaggactacacgtcctcgtctttagagggctacacgcccttgccttcagaggactgcacgccctcgcctttagaggactacacatcctcgccttcagagggctacacgtcctcgcctgcaaagggttgcactccctcgcctttgagggcgacacgtcctcacttgcagtgtctctacatctga

SEQ ID NO: 35273 - DNA, 117 bp, Glycine max
  Peptide Sequence Number=SeqID_126958
atgggcctagttctgccagactcgcagagacccttcttgggaggttgtgcaaaaaaagccacaggccatccagaaatagaacactgccccccacgttttgtctcgtgggggttatga

SEQ ID NO: 35274 - DNA, 195 bp, Glycine max
  Peptide Sequence Number=SeqID_126959
atggagatgctgaggcaaatgaacataagagagtcaatggataagaatgaagtattgaaggtgcatcaacatattgctcgcttttggtaccaagcaggtgaaaagctttttgagttgcttgatgccattgtggaggaagttggagaagagaatgttgttcaagttgtaaccgataatgggagcaactatgtttag

SEQ ID NO: 35275 - DNA, 662 bp, Glycine max
  Peptide Sequence Number=SeqID_126960
atgggtgatcaagaggagacacaggaacagatgaaagctgacatgtcggctctgaaagaacaaatggcttccatgatggaggccatgttaggaatgaggcagcttatggagaaaaatgtggccgccgctgtcagttcggctgccgaagcagacccaactttcttggctaccacgcgctatcctccctcaaacacagtaggacggggaaggaacacgctggggcacgacggcaaccctcatctgggatacaaccgaacggcttacccttatggattgccgcctaactactcaccacccgtcatgcaagacgatgcgggccatatttcttctcccgtccttgaaggggagccccctcaacagcccgacgaggtccacgaaaaccctcaagactatgcccgaagggatgtcgagttctatcccccgatccccgaagggccggcacccaacacgttgcctcagcccaacctcacgacacaaccaatagttttgtccatggaaggaccgcctcgggcaactgaagaaaggaggaaactcgatctcctcgaggagagattgagggccgtggaaggatttggtgactatccgttcgccgacatgacggatctctgcttagtacccgatgttgttatccccccgaagttcaaagtaccggacttcgacaa

SEQ ID NO: 35276 - DNA, 631 bp, Glycine max
  Peptide Sequence Number=SeqID_126961
gcgcgtccagctcagggaggatgagtacacagattttcaggaggagatagctggccgacattggacgtcgctagtgactcccatggctaagtttgaccctgagtggattccctttgacgcagatgccctcagccagttcctgggtgacccactagtttggaggaaggccaggagtgtgagttcagccagaggaggaacagggccgacggggaggcgaatgcggatcatgtgcaccagcatgaccactttgacccagatgtggatgacactgttgctcagcaatgtcttgcctagcgatcataactctgatctccctctgcctaagtgccagttgatgtatgccatcctgacacggatgagcgtccacgtggcccaggtgattgctgacaccatctatttgtttgcaggtatgccaccccccaggcaccatctggacccggataagtctaacagggccctgcggtttctagtgttgatcacgggcctctgccagtcattcggggttcccgtcacccccagtaaagtgatccgaccgccaatcacccgggccttcatcgagaagtactgcacgcctaggcaggcgcagggtgatgcacatcaggccgcaaacgcaccgccaccacctcggtag

SEQ ID NO: 35277 - DNA, 774 bp, Glycine max
  Peptide Sequence Number=SeqID_126962
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaattttcatttcccatctcatggaaaaccccttttcgctccgcttagccctacctccccctagtaggggtattttagcgataggttctataggaactggacgatcctatttggtcaaatacctagcgacaaactcctatgttcctttcattacagtatttctgaacaacctcctggatcacaagcctaagggttttcttattgatgatagtgacgatattgatgatagtcccgatagtgacgatatcgcccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttcctactag

SEQ ID NO: 35278 - DNA, 558 bp, Glycine max
  Peptide Sequence Number=SeqID_126963
atgggctggattggcgacttcattgaagagcgtcggctgaatgggttaacacagattgaacgtattctggaggccctgtcagaggtagggggcaagggcattatcgtgcctgcagcctggggaatcctcgaaggcgaccgcaacgcggtgagtgcttcgctgcgctggctggatgaggtggcggggcgtaccggaacgacgatttacctggaacccctgaaccgctatcaggatcacatgatcaataccctggcggacgcgcgtcgttatatcgaagagaacgcgctgaaacacgtacagatcatcggcgatttctatcatatgaatatcgaagaagattcactgacagaggcgctgcatcgcaaccgcgatctgcttggtcacgtccatattgccgataatcatcgttatcagccgggaagcggtagcctcgattttgccagcctgttcgatcagctgcgcgcggataattaccagggctatgtggtgtatgagtgccgtgttcgtgccgacgacccggctcaggcgtatcagggactcactcacttatttgcgtga

SEQ ID NO: 35279 - DNA, 114 bp, Glycine max
  Peptide Sequence Number=SeqID_126964
atgactaggtggatgactttaaagaacctggtgctagaggatgctgggacacaatggagaattataagcaattggatttggatccgaaattgggctgaaccggcttggacttga

SEQ ID NO: 35280 - DNA, 543 bp, Glycine max
  Peptide Sequence Number=SeqID_126965
atgtcagttctagaattgtacatagaaaaggatgtggctggtggttcaatgtttcattctgcaaattcccttacatcatgtggaaattatttatctaatgatgacacacaaccgccaacaaatatgagcaatttaaatcttgacgaagatgatgatgattatcttgtgtctaactcatacgttgaagagtcgttagacaaagatgacagtgttgacggtgtacaaggaattcataatccattttggaatgatgctttgcattataataatatcaacttgagtcatcctgatgaggaggacatttatggtttggagatgccatccagttttaatgttggccaagaattatatgttggcatggaatttgatagtaaagatgcggtaaagaatgcggtcaaacaatatgttatgaaggtgcatcaaagtttcaaagtggttgaaagcaaatgggacaagtatgtggtttgttgcgtgaataaatatgcagattgtccttgccctttctacatgagggcaattctatctaaaaaaactgattcatga

SEQ ID NO: 35281 - DNA, 732 bp, Glycine max
  Peptide Sequence Number=SeqID_126966
atgggtcagctccagcggcaagcttttcgcaaggcttacggtaaaatctgggacttagccatggtagaaatctccacagaggccattgcctcccttgcccagtattatgatcagccgttgaggtgcttcacctttggggacttccagctatcacctatggtagaagaatttgaagagatcctaggatgccctctagggggaaggaaaccatacctcttctcaaggttctatccctcattagctagaatttccaagatagtccaaatctcggcgcaggaattagaccacaggaagcaagtcgaaaatggggtggttggaataccaagaaaatatttggaggcaaaagcaagaatctgggtaggtaaaggcgagtgggccccgttcatagatattctcgccatgttgattttcggaggagtcctctttccaaatgtggatgggttggtggacctggcaacgatcgacgcttttctcgcctatcataaccacaaggaaagcccggttgtcgctatgctagccgaccaatatgacaccttcgaccgaagatgtgaaaagagcaatacaaggattgtttgctgtactccagctctttatgtatggggttgcatcagttacaatctcgttcttgctataaggcaacttggctaccctatgagaggggtaccactagaggaagagctcgcgcctgtcatgtcacgaggtttcaataagaccaacatggagacactttag

SEQ ID NO: 35282 - DNA, 342 bp, Glycine max
  Peptide Sequence Number=SeqID_126967
atgtcgtaccggatgtcacgacatcacgcttcagaacatgcagattatatttgggagtatgaacagattaaccaaagattgctctctgaacaaaagagatcaactctacacactagagatcaactctacacacaagagatcaactctacacacaagagatcaactctacacactcaggtccaacacttgatgttagggtaccatcaaggtggctcacaaaacactcaagtcccaaaactcacaaaacaactcttcaatcccggacttggtacaaaactcgtgcagccttcgtgtttatatagcagtgagcgtatctggactgcaacttcttgtgctggatga

SEQ ID NO: 35283 - DNA, 543 bp, Glycine max
  Peptide Sequence Number=SeqID_126968
cgggctatccacaagcattagttctccccctgacctgcctcccaacctcaagatcatcagcggacgacgccttcttccgaaagtcctccctctttgctttgccccagcgaaagagactgaaaaagatccgtatctgattcctcgggtcttgctgcgtcagctaccggtggaagttcaaagcatcgaagatgagtacatggaagcaccaatgaagaaagaagaagcatacataagcggcctctttttctcaccggtgacatcggcgaaagaaagaaggctaccgcgggtagagatcgaccctggggcctccatcaacgtgatgccactgcgggccctagccgatcttggaatgaattcctacgagccggctaagtcagaccaaggttactattccgggaacgagaagtaccagatgggggagacccgctacttcaacgaaatatactacctcactaagatggctgtcagcccgagtgcctctgggttgggtgtcacagcttatacctcgagtggctctttatccgtagcggatctccttcctgg

SEQ ID NO: 35284 - DNA, 159 bp, Glycine max
  Peptide Sequence Number=SeqID_126969
atgacccttcgctcagcgaacatgcacaactcatccttcttccagattcttcctcgcgctcagccgagaagtgttgcactcagcggatggctcgctaagccagcagattggcttagcgagaagggcatgcagttattcatagaggagaatcaaatgtaa

SEQ ID NO: 35285 - DNA, 606 bp, Glycine max
  Peptide Sequence Number=SeqID_126970
atgggactaggatcaattgcagcaaaaacatttgaggatataaagtttccaaaaggtcatattggaattaagagttttgatgccgaactagtcaatcaagagggaaactctataccttcgtatgaaacttacctttatcattggtttgcaataaagtaccataaaaacattactatgtcattgaatcctaaacttcatcgtcctgaggatgcttttttcaaaagaaatgaaggcacatgtaatggtggtattctttcacattattggggattcagagttgaatcacgaggaacatcgtcaaacattcttgatccttttgctatagaacaaggttttcaaggttcaagaagaatggtttccttcagatacaaaattagttgggttgattggaacaaacaccaagtaccagttaaagtttacatacttgattccaccaacagaattagatcaaatggttccaaaataattcatgattgccaggtagaatataccattccagaaaatggtgatggtgattctcctcatgtccaaaaggcaaacatcccaatagaaaaaggaggttatctcatttatggcactgctcatatgcattcaggcattgtaaat

SEQ ID NO: 35286 - DNA, 1323 bp, Glycine max
  Peptide Sequence Number=SeqID_126971
atggcggcgacttcccgcgaaaaactggcgagtctcgtgaacgccgccaagctggccatcgacatcccttcgaagctagaatcgctgcgccaactccgccacgaacttccccccgaagaccccgttctcctcaccgagttcctcccctcgctcttcctcttccactccgatcgcttcggccccgttcgcaaattcctcaccgagattgattctggaagctatccttccctcactcttcctcttccgctccaatgcctcggccccgtttgcaaattcgtcactgaggacacctttttcccgatgcttggggagattggattgaagaacacagagttcttgtccaacattgtgcctgtgcttattgatttattggatgatgacacgccggcggttgttcgccaagttctactgtgcggaactgacttgtttcgcgccactcttgagaaaattgtggttcagggtctatactctagtgatttagatggtgcccttgaatctgcttgggcatggatgcttaaattcaaagacaaagtgtactcaatagcttttcaacatggaagtggtggcgcaaagctgctggcactgaagtttgttgaggcagttattcgtctttacacacctgatcccaatggttcctcagagcccacttctcatcaaggtattacattgagattggttgggcctgtggaatttaatatattatggctcaggcggggtcatcctgtacttaacattggagatttgaaaattgaagccagccatcgtttgggtctcttgcttgatcaactcagatttccaactgtgaagtcccttagtaactcagtaatcattgtgctgattaaaagtctatcagccattgcatttgacaggcctgcattctatggccgcatcttgccagttttgctcagtttggaaccttccagctctgttgttaatggggtctgtgtatcagctacacattttgctttgaagaatgcctttgttacttgctcgaaatgtacacatccaagtgctgctccggaaatgcagtcagaaggaaaggcagatcgggtgttccacctaatctctgctagtaatggaaccatagagagagagaaagatgatcaacctgttatcaagctgaatgaaatattagctgtatgcctatcaatgttatcaatggcggatgccgggatgtggtggaaggccaaaattcccccatatagacatgcaattgctgcctatggcgctgccatggtaggcctaccttcacaaattgcctatggtggttggcaaaaatccgccatgccattccgctatagcagtcatggggccaccatttaa

SEQ ID NO: 35287 - DNA, 378 bp, Glycine max
  Peptide Sequence Number=SeqID_126972
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgggggggggtgtgggtggttacgcgcaggggtgacccgctacacttgccagcgctga

SEQ ID NO: 35288 - DNA, 304 bp, Glycine max
  Peptide Sequence Number=SeqID_126973
tgtgatagcctccctctctagttgtgctcgcacagttggcgctcctccaatatcagggggtggcccaggaaccgtgtggatatggagcccactgaaagtgaggacacgtagtcctctaaaggtgagggcgtgcagccctttcaaggcgaggatgtgtagtcctctggaggtgagggcgtgtagccctctcaaggcgaggacatgtggtcctctggaggtgagggcgtacaaccctctgatggtgaggacgtgtagtcctctcaaggcgaggacgtgtagtcctctcaacggtgagggtaactag

SEQ ID NO: 35289 - DNA, 315 bp, Glycine max
  Peptide Sequence Number=SeqID_126974
atggagtgcctagagggagtttgggagaccctcgaaggcaacacgaggtgccgatttcggggcaccattcgattcacggctacttctttgcccgtccaagtgatcgaggtaacgtcatccgaggaagaccctgaggaggatctggaggagctacctcctgagcctgctgtggatgcccttgactttctagagggtgatgaggatccactacttgaggtgaattctcccgaggaagtcatgtcggcatctgaggcagactctacggaggatggtggtccgggggagatggcgatcagcggaggctcttcatcctag

SEQ ID NO: 35290 - DNA, 145 bp, Glycine max
  Peptide Sequence Number=SeqID_126975
atgacaagcagagaccatgtgtgctcattttgcacccttgtatcatccagaggcggcgggcccgattatacgcggatataccttacggttatccgcacccttgtgtcatccagaggcggcgggccctatgacaagcagagaccat

SEQ ID NO: 35291 - DNA, 1063 bp, Glycine max
  Peptide Sequence Number=SeqID_126976
atatctcggtgaccgacgcggtaacaccgtcgggccaatcaccaagaacaagaagtccttctcgttgaccttctccggctgttcgccggcggccggtaccgcgggcaccccgctgaaaatctacttctcctccgcggataacatctccaccgacggcaaatatttgctgaacaactcggtcaacgagaacgacgcttccgtcgcgaagaacgtaggcttctctctggcggaaaccggttcttccaccccgatccagctgaacgtgccttatgtcaccgacatcatgggcgacaaagaggcgccggattcagaaaccctgacgctggacgcccaggcccttgatagggcctggccacccgggggaacgatgaaaaaatacatgatgatagcggcgctgatgctgggttccgttggcgcgcaggccaatgtggtggttaacggcacgcgggtgatctacccggcaaacaacaaggacgtgattgtccaattgctgaataacggtaccgacccctcgctggttcaggcctggatcgacgacggcgatatcaattccaccccggaaaccgccaatgtgccgtttttgctgtcgccgccggtggtgaaagtgaacggcaacagcgggcagcagctgcgtattcagaaagttggcgccgcgttggcggcggatcgtgaatcggtgttctacctcaacgtgctggatatcccgccgacgccggaaaacctgcagggcaccaatacgctgcagctggcgatcaagtcgcgcatcaaactgttctaccgcccgcaggcgttaacccgcggcgtggaaaatgccttggaagaactgacgctgcaagccaatggcaaaggcttcaacgtcatcaataaaagcccgtatttcattacggtagcgaatataggccagggtgcggacaagcatctgctggttgattcgctgatggtcgcgccgttttccacccagtttgccgccagcaaacgagcggtcagcaaaaacgcccgttatgacctgatgtatatcgacgatctgggggcttacaagtctaaagccatcaccgcacattaa

SEQ ID NO: 35292 - DNA, 147 bp, Glycine max
  Peptide Sequence Number=SeqID_126977
atggcaaaaggtgcagaagacgatgttagtctctacgcgtcaacgggctcatttgctccttggttgacgaaaggtgcgggacgacagaaggtgcaggagacaatgttggtctctgcgcgacaatgggcttatttgccccctggttga

SEQ ID NO: 35293 - DNA, 202 bp, Glycine max
  Peptide Sequence Number=SeqID_126978
attgaagattgtggctggggatagtatgggatcgttttccattgctagtgcttattgtcagcttaataagtttcatgagatacaacaaaatgaaacaccgtctgagctcgtggaacatcgatcgagtgtaagcgtaggagcacacgtagaattgcacccgctagtcaagggagcagtcatcgttgcctatcaggcgacggag

SEQ ID NO: 35294 - DNA, 171 bp, Glycine max
  Peptide Sequence Number=SeqID_126979
atgcagagttcaaaacaggatgtctacctgggagcctacgtgaatgagtcagacaactatttaaaaggaataattaacagtgctttgaaaggacttgacgatactccacaacctaaatccaaggctgcaggtgctaggtggaatgttgttaaattaacattgaatatctaa

SEQ ID NO: 35295 - DNA, 360 bp, Glycine max
  Peptide Sequence Number=SeqID_126980
atggaggggcaaccaacgcagacatctgttagtaatgccaatgtaaattctggcgtaggagcaattcctgaccaaactattggcacgataagttcgaccgcttcgacggttatgaatcagacaggggtaacttctcccatgaccaacatgacgttggcaagttcgaccacgtcagcttctgctcttgccccatggaataaccctagtttagggaatcccagtggaagtccctttcgaccgcttcaaaaccctctatatggcatgcctacatctttaatggcaggattgcaaaattctcaaccaaatatagagaatcttaatatgtcctctccatcaggacagaattaccaaggggtgtga

SEQ ID NO: 35296 - DNA, 694 bp, Glycine max
  Peptide Sequence Number=SeqID_126981
acaagtcctcgcctttagagggctacacgccctcaccatcagcgggctgcacgccctcaccttcaaagggctacacgtcctcaccttcatagggctacacgtcctcaccttcagagggctacacgccctcacctttagaggggtgcacgccctcgccttcagaggactagacgttctcgcctttagaggactagatgtcctcacctttagagggctgcacgccctcgcctttataggactacacatcctcgccatcagagggctgcatgcccttacctttagaggactacgcgtcctcgcctttagaggactacacatcctgaccttcagagggctgcacgtcctcgccatcagaggagggctgcacaccctcgccttcagaggactgcacatcctcgcctccagaggactacctgtcctcgccttcagaggacttcacgtcctcaccttcagagggctacacaccctcatcttcagaggattatacgtcctccccttgagaggactacacatcctcgcctttggagggctacacgccctcaccttcagaggactacatgtctcccctttcagagggctacacgccctcgcctttagagggcaacacatcctcgcctttgaggggctgcacactccctcgcctttagagggctacgcgtcttcgctttcagaaggctccacatctgcaccttaa

SEQ ID NO: 35297 - DNA, 549 bp, Glycine max
  Peptide Sequence Number=SeqID_126982
atggcctctaggaagagaaaatcatccacctccttacctcaagaaccttacgatactacaagattcgttttcgaggtcgcctgggaacgttatgagcaaaatgtacatgccaaaaatatcctcctagaaaggaatgttgatttatacatgacccagtacaacgagttccgaaaggagctcgagatgaggaggtggcacaaggccttgaccaggcagcttgatggttgcattgatgtggccctggtcaaggaattctatgcttatttgttcgatccagaagataagtccctgaggcaggtcagagtgaggggcaaattgattaagtttgatgatgagaccctcaacacattcctggagacccttgtggttttggagccaggggagagggcgaggttggtatacggacttgtcatgaagatggacatggatgtgggctcgatcatctgtagtcagatctcgcagatggcccaatccaactcttccaggttcaaatttcagcactcatcattgctctatgcatcgcccagggagctgttcctaattcattga

SEQ ID NO: 35298 - DNA, 220 bp, Glycine max
  Peptide Sequence Number=SeqID_126983
atgtacatcaagtatggcccaaaatacatcatgaagcatagccaacgaaatatgttatccaacaaaaccccctacacttattcccaaaacaattccaaagctccaaaattccttaaggttaaggaagcatcaacaagaatcaagccaaggctattatgcaagcaatcaatggggcaaaacacaccaaatgattatgatgatggctcaaattctcacaaag

SEQ ID NO: 35299 - DNA, 605 bp, Glycine max
  Peptide Sequence Number=SeqID_126984
aaatcactgaaaatactaatcatgcaccgctggaaggtaccaggggcattgcacaggccgaaaggcatcctcctataggcaaaagtgccgaaggggcaggtgaatgtggtcttttcttgatcctcaggagcaatagtagtttgcatataaccagaaaaaccatcaaggaaacagtagtgagatttacctgccaggcgttcaagcatctgatcaatgaatggcaggggaaaatggtcctttttggtaacctggttcagcctcctatagtcaatgcagactctccaactgttctgcacccgagtaggaatcaattcctccttctcatttttgatcactgtgaggccggtcttcttcgggactacctggacgggactcacccattggctgtcggagataggataaatgattccagcttgcaaaagcttggttatctctgtcgcaacatgcccttttgcgggcgagcgaggcgaggctcacgggtgcgctttccaaaggaggaaagatgcacggagtcgccaccaacgtttatttgtggaaaacgtcggaaaaccgaaggaaaccgatcgaaacgaaattctaagttcgggagttgtatttacgtttga

SEQ ID NO: 35300 - DNA, 804 bp, Glycine max
  Peptide Sequence Number=SeqID_126985
gttgcaggatgtaccatctatgggggagctcatcaatctggatgttgtatccctattgaagaacaaaccactcatgaattcaattacatgggaaatcagcccaaaaacaattttaatgcaggaggattttctggattccaacatggccaacaatataatcaacagcagggacaatggagaaaccaccctagaaatcaattcaatagagatcaaggtggaccatccgtaaggccaaagcaacaagggcctagtctctatgatcgcacaatgaaggtggaagagactctagctcagttcatgcaggtttctatgtccaaccagaagagcacagagtttgccataaacaatctagaggtcaaagtgggacagcttgcaaagcaattggtggatagatcatcaagcatttttaaagctaatacaaagaaaaatcccaaggagaagtgtaaagctgtgatgacaagaagtagaatggcaatccatgtggatgagagtgaagctgagaagaagatggaggaacataaacaacagctggcacctaagccagcacttgaacctatttttgattctgtagaacttgatgagaataatgaggagactgaagatgataaggaagaagagacaccaataaaagagaaagaaaaagaaagaataaaagaagaaaaagaaaaagaaaaaaagttgaaaaatgaaaaacaaaaagagaaagttgttgatgatgagatgaggaaaggaaagagtgaggcaaacactaaaaagaagaaagatactactccaaatgaaggcaaggaagtaccttatcctttg

SEQ ID NO: 35301 - DNA, 318 bp, Glycine max
  Peptide Sequence Number=SeqID_126986
atggtgaaagttggaacctcttacgtgccgatcaacgtctcattttcgccaaaagttggcccagggcttccccggtatcaacagggacaccaggatttatttattctgcgaagtgatcttccgtcacaggtgctccagtggcttctgtttctatcagctgtccctcctgttcagctactgacgggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 35302 - DNA, 460 bp, Glycine max
  Peptide Sequence Number=SeqID_126987
ggtagaagtctccatggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcaggaaaggacagagagcttaggggaagcagtaatgggatcatcggcggctatcataagtggttgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaaggcagcaatagtgagctcaagctccgaagaggtgaaaggaatcatcacgggtcaaaggcatgatcttgaaggacgagctaaaggcttgccttag

SEQ ID NO: 35303 - DNA, 210 bp, Glycine max
  Peptide Sequence Number=SeqID_126988
atgggtgccaagcacctcacgaggaccaaagaatggtcgcatgtcatcaagcaaaggccggacgaaattagggacgtgcagaagaccaaacttgtgtctctgcgtgccatgcatcaagctgtgtctgccttaatagcaaagagggtgcagataaccgtaaggggtgcagataaccgtaaggtatctccgcgtatcatgggtgcagaatga

SEQ ID NO: 35304 - DNA, 207 bp, Glycine max
  Peptide Sequence Number=SeqID_126989
atgcatagtagctgtgtgatagcctccctctctggttgtgctcgcacagttggccctcctccaatatcagggggtggccaggaaccgttaaaagtgtggatatggagcccactgaaagtgaggacgcgtagtcctctaaaggtgaggacgtgtagtcctctgaaggtgagggcgtgtagccctctcaaggatggtgaggacgtgtag

SEQ ID NO: 35305 - DNA, 429 bp, Glycine max
  Peptide Sequence Number=SeqID_126990
atgactctcggcaacggatatctcggctcttgcatcgatgaagaacgtagcgaaatgcgatacttggccgagggcacgcctgcctgggtgtcacacatcgtttccccaacgcaaacatgtaacaatgttgctgcgcgggggtgtatgctgacctcccgcgagcacccgcctcgtggttggttgaaatctgggttcatggccgacttcgccgtgataaaaatggtggatgagccacgctcgagaccaatcacgtgcgagccggtcagttctggacccatcgacgaccctttgcgtgcacgcacgctcccaacgagacctcaggtcaggcggggctacccgctgagtttaagcatatcaataagcggaggaaaagaaactaacaaggattcccttagtaacggcgagcgaaccgggaaaagcccaccatga

SEQ ID NO: 35306 - DNA, 285 bp, Glycine max
  Peptide Sequence Number=SeqID_126991
atgtgggccatcatcgatgagtgcaaagagaagctaaatctagcggcgactcacgagcaaaggctagaggatgagtacgccaagatatcagcagaaagggaagcaagggaaagggtaattgattcattgcaccaagaggcaacaatgagtcaagaacttccccgattgctagccaaggccaaagcagtggcggacacctactccgcctccgaggagatccacggacttctcagctattgtcagcatatgatagacttaatggaccatatgattggaaaccgctag

SEQ ID NO: 35307 - DNA, 552 bp, Glycine max
  Peptide Sequence Number=SeqID_126992
agtgtagggttagagcactctgggagagtgcgatgcatgggattaggagctgttccttctaatacattcaggaacacaagacttcgagcttctagtctgagctcttcttcatctggtgttggctttccatcttcaaaccaatggcaagagaaatacaacaatttagaatcagcttttaaggcctacatgataatgaaggaaggaacgggacctgcagcttcacttctccttgattttatcttgcattgtacagcaactccagtattctcgggcaggagtcaggacattgtatccgacatcgtggatcctgcaacttcaattcttcatttgccattttatcttgccttgtacattgtgcagccgatcttattccttgacaaacttgttgttacatcatgtgcagcaactcctaaagctgttccttcatatgtctatagtgcttatctaaatgatgccaagtgttccaatacacttggcaagaggactatagcggaacaaattgaagtaggattgactcaaagcatagttgatgaatctgagtttctctcttga

SEQ ID NO: 35308 - DNA, 833 bp, Glycine max
  Peptide Sequence Number=SeqID_126993
tggtcaaagaaaagctaaagacggcagtcactaggatcaggaaggagtgtgatgagctaaggcatgccaacatgaccacagctgaagcggctaaaagggacgagtcaagggtggaaggcatgatattagaggacaagttgaaggcttgtcaaaggtcaaagagaagtttgactgaacagctgagtaggacggaagagaatatgttgacaatcattgaccagtataaagagaagctaaacctagctgctagccatgagcaaaggctagaggacaagcatgcgaaggtatcggctctgcacgtggaaaaagaagcaagagagagagtgatagaatcattgcatggaaaagctatgaaatggctggataggttcgctcacactctgaatgggagtcaagagctttcaagcctgttagccaaagccaaggcaatggcggatgaagttcaagagcagatgaaggctgacatggaggccatgaaggaccaaatgacctccatgattgaggccatgttaagtatgagatgggtaatggaggataatgcggccgtagttgccgccatcagcgctgtcgctgaggcggatctgactcacccatccatcataaaccaaacaagctgtctagtcctggacatggtaggccagggaggagaggtggtctacctctatgcccctactggaaatgatatgccctacaactataccttattctaccatgaagtgacatttttcaaaattcaacacaaggccaaagggcatcctcctataggcaaaagtgccaaagggacaggtgaatgtggtcttttcttgatcctcaggagcaatatgaatttgtaa

SEQ ID NO: 35309 - DNA, 204 bp, Glycine max
  Peptide Sequence Number=SeqID_126994
atgatattgcacaagtttagaaagcctaactctctaaaaatagtccccagtggagttgccaactgtcgcaacctaccattcggcgggagggcgacgcagggctcacgggatgcgtcttccaagggaggaaggcgcgcggagtcaccaccaacgtttattcgaggaaaacgtcggaaaaaccaaaatgcagtctacgaactttaa

SEQ ID NO: 35310 - DNA, 647 bp, Glycine max
  Peptide Sequence Number=SeqID_126995
atgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacaaggccccgaagggcccgttcccaatccgtcccccgaccggcacgcgacgacccgctctcgccgcggaagcagctcgagcagtccaccgacagcgacgggttcgggactgggaccaccgtgccagcctcagagccaatccttttctcgaggttacggatacattttgccgacttccttagcttacattgttccatcgaccagaggctgttcaccttggagacttgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 35311 - DNA, 315 bp, Glycine max
  Peptide Sequence Number=SeqID_126996
atgtcgtcgcttccctcggaaccaacacaacaacaattagaagcacactacagagcttacattttgcgactaattggtggggttttaatgctagacaagacgagaaatcaggtcactaaccctgatgccaaaaccatgggcggctgtgcgtcattgttgcaatcttgggcatggtatcgcatgcccttcattgcaacaagagttaatcggacaccatcatatccgttggttacaagctttactggtacaccacatggagatgtcatcggttatagaatgagattagactacatgacaactgaacagttcttgtga

SEQ ID NO: 35312 - DNA, 289 bp, Glycine max
  Peptide Sequence Number=SeqID_126997
gggagggggagaatcaaaacgaccaagggctgaatctcagtggatcgtggcagcaaggccactctgccacttacaataccccgtcgcgtatttaagttcgtctgcaaaggattctacccgccctcgggggggggggggggaattgcgcttcaaggcgtctcgtagggctaatccgcctcacgagggtcaccaacggcacgtgcctttggggggccgaggcccccctactgctggtcggcaaacgaacggcggggcgcacgcgtcgcttctagcccggattctgacttag

SEQ ID NO: 35313 - DNA, 609 bp, Glycine max
  Peptide Sequence Number=SeqID_126998
atgggtgaagtagaggagatacaagagaagatgaaggccgacatggaggccatgaaagagcgaatggccacgatgatgaccatgatgagcatgaagaagataatggaagccaatgcagttgcaattgccgctaccagtgttattgctaaggtgaacctgatgtccccatccggcatcaaccaaatgaatcatccaaccttagatatggtaggcaaagatttgggaagtaggggcggcccctattatgcgcaaaacaagcatgccttcccaccatatggcttgcctcccaactatacgccacccaatgtggcgtacactcccaataagaatgtcaataactccactcctatacccattgagagccaacaaccccaaactgatcatgcacatgtctctcaacccatgggtgagacacatgaaatgccccaccacaatctagccgacttcgagccttgcctcggatatgccacggaagggcaagcagttggtggtatacccctacaaaccctttggaaggccctcagtatcacccccagctacacctcttgcattccacaacaagtaaaaaccctcgtgctatggcagaaatggaaaagttggatcatttag

SEQ ID NO: 35314 - DNA, 816 bp, Glycine max
  Peptide Sequence Number=SeqID_126999
taccctggtcttcagaggactacactcctcgccaacagagggttgcacgccctcaccttaagaggactgtgtgtcctcactttcagaggactgcatgtcctcaccttcagagggctacacgccctcgccatcagaggactgcgcgtcctcaccttcagagggctacacgccctcgccatcagaggactgcatgtcctcaccttcagagggttacacgccctcgccatcagaggacttcatgtcctcaccttcgtagggctacacgccctcacctttagaggactacatgtcctcgccaacagagggctgcacgccctcaccttgagaggactacacgtcctcgccaacgtagggctacacgccctcacctttagaggactacacgtcctcgccaacagagggctgcacgccctcacctttagaggactacacatcctcgccttgagaggactccacgtcctcaccttgagaggactacacatcctcgccttgagaggactccacgtcctcaccttgagaggactacacgtcctcgccttgagaggactacacatcctcgccttgagaggactacatgtcctcaccatcagagggctgcacgccctcaccttcagaggactacatgtcctcaccttcgtagggctacatgccctcacctttagaggactacacatcctcgccttcagaggactgcacgtcctcaccttgagaggactaaacgtcctcgccttgagaggactacatgtcctcaccatcagagggctgcacgccctcacctccagaggactacacgtcctcgccttgagaggactacat

SEQ ID NO: 35315 - DNA, 363 bp, Glycine max
  Peptide Sequence Number=SeqID_127000
atggctactcagttgaaccaagctcagtcccaaaattctgacaaattgccttcacaaactgtgcataatccaaaaaatgtgagtgtcatcaccttgaggtttggcaagcaatctgaagtgcctccaccagtagcagcacctgcacctgaacctgtcaagcttcattctacacctgaaaaagaggatgagatagttgcacaaaagagaaagcttcctaacaaaaattttcatgcaggtggaccttctagtaattctgacttattgcagcctcctatcccccttccattcccacctagagcaattccaaacaaaaagatggaagaagcggaaaaggtgatcttggagaccttcaggaaagtagag

SEQ ID NO: 35316 - DNA, 186 bp, Glycine max
  Peptide Sequence Number=SeqID_127001
atggagaattggcgaacttcgccaagcaatgaattcgtggggctccagactcgaagcgctaggcaattaattcatggggctccgaataaaagtggagaatggagaattgccgaacagcgcgaggcaatcaattctccgggttccagactcgaaggtggaggacacatgaacagcgctaagcaataa

SEQ ID NO: 35317 - DNA, 688 bp, Glycine max
  Peptide Sequence Number=SeqID_127002
atggaagaaagcatgtctcctttccttgtgagggatttcggcgcacaaaatttcaaggctatacaaagaatccataaggcatgggaaaccccgttaaggaaagatcaagaacttaggggcattcgtaatggcatcattggtggttaccatgaatggctgaaagacgaggaagtccaagctctcaaaagcgagttaggaaaggcaaacttgccaaggaaaagttcaagttggccgctacacacatcccggaaggagtgtgccagattacgggaagagaatgcaactaccgcaagagcccttgaacaagagaccaagagggctcgcaaggaagagtatggccggaacaaatttcgcggagctctgtggggtagcaacaatgaacttaagttgcgaagggaagagagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccacggcccacgagcataggatcgcggacgagtatgcccaagtatacgcggaaaaagaggctagaggaagggtgatcgactctttacaccaagaggcaaccatgtggatggatcggtttgctcttaccttgaacggga

SEQ ID NO: 35318 - DNA, 273 bp, Glycine max
  Peptide Sequence Number=SeqID_127003
atggagaacgcccagtctcactccctgctcatcactctctttacaaaccctaaatcacgagagatcctagctcaaggtttgaagggaaccaatgagattcaatctacctctcagggcattcaaggctttggagtttccaagtgccaattcgtcttcttcttatgtccagtcttcttctggcttcaatccatcagtgggctttccttctgtgtccagcatcttgggatgttcccagcctttgatgacagctttccaggttctgctatccagtga

SEQ ID NO: 35319 - DNA, 210 bp, Glycine max
  Peptide Sequence Number=SeqID_127004
atgacgtttgccataatgtcactcgcactaagtcgcaaattcatagagatggccagtcagggtccgattttggagactatgactccaaccagtggtatggatcagcataggacattaaggagcactcaagacaccgatgacccccaagcctacactagcgttgtgtcccgacgtccttcagcacaatattccttaaagcagttcacctag

SEQ ID NO: 35320 - DNA, 261 bp, Glycine max
  Peptide Sequence Number=SeqID_127005
atggttgactcatggtacctaacacatgcaactaagaataggaaaatacaaggatcatgtatgagcaaacaaaaaggggcgcagtgccccatgtgtgtagttaagaagacgatatggatcttccagcttcccatgacaaaagacgagacccacatacaacgcatgcgtgacggtatgatgcagatgcgtatgcatgaaacggaaagaaaacaacacaaaggggtaattcacacatacgagactgcagagatccaactttaa

SEQ ID NO: 35321 - DNA, 543 bp, Glycine max
  Peptide Sequence Number=SeqID_127006
atgcaaatctttattcaatcaatgatcccagtgcatggaatgctattgttaaaggagcattttataccaactaaagaagtgaatagtgaattggtgcctaaagaatgggatgagatgaaagatgaaaggtgcaaaagtgcaaaggaaatacgaaaaatgcttgaagtcactcttgaaggcactatggataatggagaaaccatttcaaaacttcaaacaagattcacccatattgtgaatcaccttctaggtcatggaaaaacgtttaaagatgatgagctaaacatcaagatcctcaactatcttacaagaacttgggaaccaaagatcacaacgatcaaggaatccaacgacttggcatcaatgtcgatgaaagctctcttcgaaaaattgcttgcatatgaacatgagctaattcaacaatctcatgtagaagaaacaaaaaagaaaagaaaaggaattgcagtcaaggttaattcttcaaaggaagattgcaaagaaagctctagtgatgacaaagatgaagagaatttaagcttgatg

SEQ ID NO: 35322 - DNA, 255 bp, Glycine max
  Peptide Sequence Number=SeqID_127007
atggaagctccattggagcttgtaggcctaggatcttcttcatcaatgggttcctttacttcttgggaagatgaatggcagcgggaatggagaaggaagagagagaggagacaccacttcaaggagaagatgagtctaaaagaagctcaccaccataggaggccatggataagagcttgggaggaagaaggaaatgaatggaagggagaggaagagaagagcacaaaagttttgtgcctcttaaaagagctctga

SEQ ID NO: 35323 - DNA, 534 bp, Glycine max
  Peptide Sequence Number=SeqID_127008
atgcattcagacacagtcgtgtccgatggcacgcagagacaaaatttggtcattctgcaccatttgtcatccagaggcggcgggcccgatgacacgcggagacaaaatttggtcattccgcacccctttgccattcagacacagtcgtgtccgatggcacgcagagacaaaatttggtcattctgcaccctttgtcatccagaggcggcgggcccgatgacacgcggagacaaaatttggtcattccgcacccctttgccattcagacatagtcgtgtccgatggcacgcaagacaaaatttggtcattctgcaccctttgtcatccagaggcgacgggcccgatgacatgcggagacaaaatttggtcattccgcacccctttgccattcagacacattcgtgtccgatggcgacgcagagacaaaatttggtcattctgcaccctttgtcatctagaggcggcgggcccgatgacatgcggagaaatttacattatcttccgcaccccttcacaagatccgtcatggactga

SEQ ID NO: 35324 - DNA, 248 bp, Glycine max
  Peptide Sequence Number=SeqID_127009
atggtggatgagccacgctcgagaccaatcacgtgcgagccggtcagttctggacccatcgacgaccctttgcgtgcacgcacgctcccaacgagacctcagggtgagagcccccgtcgtgcccggaccctgtcgcaccccgaggcgctgtcggcgagtcgggttgtttgggaatgcagccccaatcgggcgggaagcggatgggggccggcgatgtgtcccggtcggatgtggaacggtgagagccg

SEQ ID NO: 35325 - DNA, 577 bp, Glycine max
  Peptide Sequence Number=SeqID_127010
gctgcacgggttctgtaccaagtcagagattgaagagttattttgtgagttttgtgacttgagtgtttttgtgagccaccttgatgttaccctaacatcaagtgttggacctgagtgtgtagagttgatctctattgttcagagagcaatctctgagtggctcttaggtagaagttgcacgggtagtgatgtaggtgacgttgcaccgaactgggttaataattctcttgtgttatttacttgtttaatctgttcatacggtcatatacaatctgcatgttctgaagcgcgatgtcgtgacatcctgtacgacatctgtccccagaatcagaatttcacccatcttgttaccttttttcttcaccatttcaatgtccccttggatgatgaaccttttgtcaaattcaaacgttccttttctattggtggcggtgctgtcacatctattgggtaccagaaagacatggatgacatgcctctccctattcctgacgagcgtacaccatctccaccaccgcatcgggatgcctcttcttctctcgtgactgaagttctcacggagctccatgatctttaa

SEQ ID NO: 35326 - DNA, 294 bp, Glycine max
  Peptide Sequence Number=SeqID_127011
atggattcctttgcttcttggaagatgaatggcagcggaatggagaaggaagagaaagaggagacgccacttcaaggagaagatgagtctagaacttctcaaactgttagtttttcggatattcaatgtaatgttctcgaactcaaaggagataactataagatatggaaggagagaattcttctacaattggggtggatggacatagactatgctataaggaaagacgaaccacttgcaatcactgatgaaagtagcccaactgatgttgcgctatatgagcggtgggagtga

SEQ ID NO: 35327 - DNA, 171 bp, Glycine max
  Peptide Sequence Number=SeqID_127012
atgggagctcttgaatcgaaaggttgtagctatgattcttctctgcttgaaagttgggacacattgactgtcattgtcagcaactttgcattagatggaaagtttagcatgtataatgtcacaaacagtttgttgaatgaagagtctagacgaaacgagaaagaggcttga

SEQ ID NO: 35328 - DNA, 237 bp, Glycine max
  Peptide Sequence Number=SeqID_127013
atgattcatttggttgagattagatgggggcatcgggttcaccttagcaacatccctggtagcggctactgcaaccgcattggcttcatgctcatcatggcctccatcattatggccatttgctctttcatggccaccatgtcggccttcatctgctcttgcgcctcctctacttcacccattgctctagctctagcacagaggaaaatgcaaggaccacgcatgagcgaaatgtga

SEQ ID NO: 35329 - DNA, 147 bp, Glycine max
  Peptide Sequence Number=SeqID_127014
atgggaataagagaaagtatgtgtgatggtacgaaaattccaacacctacctcccacgagaattccttgttgtacaactcaatgggggagcaaagggatgctcacccagtgctacaactttggtcactgagtgctctagcgggttaa

SEQ ID NO: 35330 - DNA, 405 bp, Glycine max
  Peptide Sequence Number=SeqID_127015
atgcattggttgtatgttgatgacattcttccctacttggttgtcctagggaaagtttatgaagggtcgtcaatcgtacaccacgggcctttggccaatgatatggtgaaggtgggtgttgaagaaattagagatgctgatgcttgtgaccttacacctactaaaaagattcagttagtggggataaaaagtggacattggcaactggtagttatatgtcctaacgacaatgttgttgcttggttttatttcttgcacaataagtccgacaagtacttcaaaggaatagttaacagattcaatgataaacaaggaagtaaatccaagacaaatgttaaatggattccagttaaatgtaataagcaaagaggaagcactgagtgtgactattacgtcatgcattag

SEQ ID NO: 35331 - DNA, 309 bp, Glycine max
  Peptide Sequence Number=SeqID_127016
atgacgctgccaaatataatcactgcaatacagtcatcaattacagataatggtgttacgcctataattaatgcactttggtatctttgtcctgtatatcaattcaatggtgaagttcaatatagggaaattcaaattattgacgaagaaggtgtcttatgcatgtttcatacatttctcaatatgacaagtgtaatatgtatggaacttaaagttgatgttcataatttattatcacctactcaagttaatgacctaagttgggccaacatggagcagaagctggagaataccttgaaattagaatga

SEQ ID NO: 35332 - DNA, 267 bp, Glycine max
  Peptide Sequence Number=SeqID_127017
atgccgttgaggtattgtgctcagaatttgctcaaggttgagcctactccgttgtacaagtttgagtggcaccttgagtccaaagctttaatgcatgccatgtgcaagactggtgggaaaattgttggtcggttcagaataccactggatggaagtccatatggaacactagaggcggcattggagccaaatgaacatgggagaggaggcatcgacatatgcagtattggagccaaaggaacactagagtatactgtctccaagtag

SEQ ID NO: 35333 - DNA, 178 bp, Glycine max
  Peptide Sequence Number=SeqID_127018
atgatggtcatgtcataccgactatggggttatatgtacaacatgaaaaatgtacacacctggtggcatgaactatggtttgtgcttaagttaccaaaaggatttattcaacctgaagcaacaccaatcggctggatgtcggagcaatccatcactttttctgtcatctgcatgccat

SEQ ID NO: 35334 - DNA, 249 bp, Glycine max
  Peptide Sequence Number=SeqID_127019
atggacatgatgcaaaaaaccttacatggcatgcagatgacagaaaaagtgatggattgctccgacatccagccgattggtgttgcttcagataggggtgatgaatgtgaacattacatacaaacatgggtgaaggaatctcaacgagaggtgtacctaggaacttacttgaatcatgcaatgaagacaataaagaccactgtggatggtaaaaatgatcaaggaactcctaagtggattaaagtaaag

SEQ ID NO: 35335 - DNA, 384 bp, Glycine max
  Peptide Sequence Number=SeqID_127020
atgatgtcaaagaaaacaggaggagaatacatctccaactggcacagtataattgcagcctcattttccaggtcatcaaacttgacaggatcaaggactttgctacatatggcattgaagaaaaagcacaagtatctaagatctgaggaagtggagaggcaagtggatgtgactaggcctttgagaatgcattggactgcctgccgtaacactagtggacaggttcaagttgctcacattgctttcatggggcgcatggctagggatgacaatggtaaggccactgaaggtgtggatatgttccttggagggagaataggaagtgattcacatctacctcaagtgtataagaagggttttccttgcaaggactttatagtataa

SEQ ID NO: 35336 - DNA, 270 bp, Glycine max
  Peptide Sequence Number=SeqID_127021
atgctagcacgcattatccgcactcgtctctttgcatcggcacaggtgaaatcttgccccggtatgtatagtagctgcgtgatagcctccctttctggttgtgttcgcacagttggtcgccctccaatatcagggggtggcgcaagaactgataaaaggaaacgcccactgaaggcgagaacgcgtagccctctgaaggcgaggacgtgtagtccactgaaggcgaggacgtgtagtcctttgatggtgaagacgtctagtcctctgaag

SEQ ID NO: 35337 - DNA, 189 bp, Glycine max
  Peptide Sequence Number=SeqID_127022
atgaagcttggattaattcggcctgacgagggattgaggcgtcacgacctccatgtccaccaccatcatggtgttgaagtaggtgttgtcgaagttgtagcagtcatggtagaggtggcaaagatagacactgttgatgttgccagcatcgatatatgtgacggggaaggcgaaagtcacaaaatgtga

SEQ ID NO: 35338 - DNA, 862 bp, Glycine max
  Peptide Sequence Number=SeqID_127023
ggtgaaaggccacttaattaagtttgatgaagacaccctcaacaccttcttgaagacaccagtgatcatcgaggagggggaagacctcctagcttactctagattctatcgtttgaggccagatccacaggaactagcagcccgactatgcatccctgggaggggatttgagcttaatgctgatgggctgccattgaagatcttgcggaataatttgaccacgctcgctcagacatggagtgttttatcattctccaacccgacccctacttctcacacatctgacatcacattggatagggccaggttgggtttccctgccctcatcattgctttatgcaaagcccgaggagtcacttttgattcattgacttttgagagtctcagtctaaccattaatttggcttatgtgaagaaaaattgctggaaccttgatgaccccacggtcacttttcgagggcccattaaggctaagcacaagagatctaaggctccgtcttctgatattccccctacttcaactccttcgacttctatagcagcactttctgcgccagcttcatccactcctttgccaattccgactccacctatcatgagcgtggaagagttcattagccaagaggacgagctcatccctcctgagccatttgtttatgagactgatctagctagtgctcaggaggaggtagcatcactagagcccgttcctcagtcatctccagctgcagttcttgatgatccacaaccatctgctccagcatcggtgcctgatcagcccattgttcaagatccaccagttgcaccggtgttggacttgaatgagcatgcacaggatcactcacatgatcaggatttttaa

SEQ ID NO: 35339 - DNA, 786 bp, Glycine max
  Peptide Sequence Number=SeqID_127024
atgatagagtactgcaaggaaggttccaagcctcatatcatagatttccttggaaacaacgaacccatctcaatctacttcttccctctaatcgaacccttcaaatcgcatatcaaaatcgaagcttattatacatacatcacgcgtgaatccaacagtgatgatgactgtgaagcaaggtttcttctctctgcgaggctcactcctcttcttgcaatccttacccttctctccttaacctatctttctctcaaatactccaccccaacacaggttaccaagctctcgatcgagaacctcaacgatgtgctggtaaacgagaaagaaggggaccacgtgagtgtagagccaggactatgccacagagcgattttgggcgatggagctgaccatgtagttggggattgtgaggaagagggtggtgttgctgtagaggaggctgcaggtgatggtggggtcaacgtcttcgaggcggggggatcttgcgttgaggtggcgaagcctggcggcaatgcgctccggggagggggacaagtgctgcagggtggcagtgggggaggagggagagagaggaagtgggacgggtgctacggctttgaggcagtgctttcagtgccagagcttgtctccaaggaaggaggtcttgaaacattttgtggaatttttattcgtgcccctacaattcttgaagcagggccagaagttcaagtgctggctgattatcctagaccatctagcaaattgttgagttctgattcttctattgaagaccaaaaaattagttaa

SEQ ID NO: 35340 - DNA, 816 bp, Glycine max
  Peptide Sequence Number=SeqID_127025
atggtcctaggtatactagaagtcatatctaagccttggaggtttatgctagaaaactggttgtgtgactcagatctagatattcctactagaatgcatcagatcctgattgagaaagaccttcttgccgattcattctcagattgtcttgagacttctattctagatgagaatgagtttctcctattgaaggggtgggtctggggattgaaggtcgtcatcatcagtcgttcaaatggaaaagccaaggaccatgggtcatcatcatcagtcgttcaaatggaaaagcctttgttcaaacctgttaaggttagcaaaaaagccaaacacaaattcaaggaacttagaaaacaaaaatcctacactgaggagataggtgatagcaatagtgaattattaagcaagattaatagtttacttaaaaccatccctgaaacccctcaacctttagaggaatcatccaaaataaggactagatacacctccaaactaataaatgccattaacggggatagtgacaataattcagaacaagtatctcaagaaggtttagtgtctgaaaaggaaaacacattttcaagaattcatatcgtggaggaggagggtgttttggagtggaaggaggcacaagcattgaagtcaaagaaggaggaagtggtggccatgagggaaagttttttggagattaataggctaagggagggggagggggtattgggtaacagtgaaagagtgaaggggtttgttgggtcttggaagagccataggaccaatacttgtattctggaaagaggcacatgcgagagagttagatag

SEQ ID NO: 35341 - DNA, 276 bp, Glycine max
  Peptide Sequence Number=SeqID_127026
atgcaaaccgccagccccattggcgtgtttgctgtggctatgacacgtggtgaagacaccacaaccactggcgagttccatggtgtcgccagccccattggtgatttcatcgtgcaagggggagtagctagtcaaactggcaagttccaagcacaggctagagggagctgcatcactccaactgctcccttgctccctcttcgttcatccctcccttgtagttgcagtacatcgttttcttcttcttcctactacgtgctttctcttcttggttag

SEQ ID NO: 35342 - DNA, 390 bp, Glycine max
  Peptide Sequence Number=SeqID_127027
atgcaagaagaagaagaagaagaagaagaagaagaagaagaagaatctgatgatgaagaggacttcttactctttgtgaagaagtttcataaatttgtcaaaaatagaagaatggagagaagccataacttcaacaatgggaagagatcccaagaagtttctcctacaattaaatgctacatgtgcaatcaacccggtcacataaaagtaaactgccccacaaatgagtcatggcccgagaagaatgagaagaaaagctataaagaaagaagatccaagaaggcttgtattgcttgggatgacaatgactcatccgatggttcggagaaggagatcagccttctatccaaagactatgaaagtgatgagaacatcactcaagaagattaa

SEQ ID NO: 35343 - DNA, 342 bp, Glycine max
  Peptide Sequence Number=SeqID_127028
atgagtgtggaagagttcattagccaggtggcttggccaggagtccagccttctcctttgggaaggggtgaggcctccgcagcccaggagactgtgccagaggaggacgagctcatccctcttgagccatttgtttatgagactgatctagctagtgctcaggaggaggtagcatcactagagcccattcctcaatcatctccagctccagttcttgatgatccacaaccatctgctccaacatcggtgcctgatcagcccattgttcaagatccaccagttgcaccattgttggacttgaatgagcatgcacaggatcactcacaggatcagaatttttaa

SEQ ID NO: 35344 - DNA, 555 bp, Glycine max
  Peptide Sequence Number=SeqID_127029
atggctttccgaaagagaaaggaatctactttagcatcccaggcccgttatgaccgctctatattcacatctcaggaagcctgggatcgctactctgatatagtgattggtaggaggatcctgcctgagagaaatgccataatttaccttgcaaaatttggagaattcaagtataagctcgagagaaggaattggcacaaggagatgatcaatttcatggatgggagcatcgatgttgccattgttaaggagttctacgctaacctttatgatcctgaggataaatcacctaagcaggaactagcagcccgactatgcatccctgggaggggatttgagcttaatgttgatgggctgccattgaagatcttgtggaagaatttgaccatgctcgctctgatgcaagctccattggagcttgtaggcctaggatcttcttcatcaatggattcctttgcttcttggaagataaatggcagcggaatggagaaggaagagagagaggagacgccacttcaaggagaagataagtctagaagaagctcaccaccatag

SEQ ID NO: 35345 - DNA, 549 bp, Glycine max
  Peptide Sequence Number=SeqID_127030
cttcttcgcattctcttcgtctggagaggcctaaaaggtggcttcatttgttcaaaggtaatagtctcaagacttgggatgaagtagttgataaattcgtaaagaagtacttcctagagtctaagacagctgaaggcaaagctgccatttcatccttccaccaatttccagacgaatctttgaggggaaagatcaaattgaagaccccggaagaagcgatggaattaatagggaacatggctgctagtgaccatgcaattctgcgtgatagagcccacattcctaccaaaagaagcctgctagagctttcatcacaagatgcattgttggcacaaaacaagttgttgtccaagcaattggaagcattgacagaaacactaaagcacatgagtccgactgctgtattccccaagaagaaacaccacaagaagtcaactgcatggggaacaagccaagacaaaatttcaatgcaggtggatattccggatttcagcatggccaaccatataattaacagcagggacaatggaggaatcaccctggaaacca

SEQ ID NO: 35346 - DNA, 591 bp, Glycine max
  Peptide Sequence Number=SeqID_127031
gcagttgtctcttctgcgctaagcgcaagattggcgctaagccaaatatcacttactcgcgctaagtgcgagaatggcgctaagcatgccttcgagagaacagaggaaaagctgagcaaggaagcaaaggttcttagaggtggaggagacatccccactactttgtatctggaagtagctgcagaggtagttcaaaagttgcaaccacgtgaagcatcaactgtgtttattaagcttgttagaccaaaatcacccccttcaccagtaggatatgtctcaacaattcagactgacaacaaaggagaggatgaatggtggaatcaatttgacacaacaaaagcagaacaagacaaggtgaaaatctggtttaaagctcatccagagttccttaaggcagctgatctagagacttcaatgtttcttaatcagaaatccaagctaacgactttcctagcaaggtctaagtcgaaggaacatctgaccaagaacttaaaagaagttcttcaattgcttcaagaccacaaagaaggatattcttcgtcaaagaaagaagacgctaagtcaacaagcactttagatgttttttactag

SEQ ID NO: 35347 - DNA, 339 bp, Glycine max
  Peptide Sequence Number=SeqID_127032
atggttgaagcagagagttcacaaaatttacaaagcatacaagattctattaattggacaaatgatacatattcaaaagtcaaaggacctgaaaaaagaggacatgtgcgttgtcttggcaagcttccacatcaagccagttcatctcaaagctcttgtgcaaacaatagaattaaaaaattggagaatttgcttggaaaccttgttgttgtccttaaagtgggatttgtagaagatccacaaattaatcaagtcttagaaactatagatgaagaggcacctacaaatggttctactagtaaaaatcatcaaactacaaacgatcccaaccagagctga

SEQ ID NO: 35348 - DNA, 88 bp, Glycine max
  Peptide Sequence Number=SeqID_127033
gtcgactctagaggatcccacagctctagcttctcaaggaagttttctcaagaaagcttctcaaggaagctacctagtctataaatag

SEQ ID NO: 35349 - DNA, 246 bp, Glycine max
  Peptide Sequence Number=SeqID_127034
atgatagctaagccagcagaagacccagaagaggcatcgttgactctagttatttcaaagacaagcgaagcggatagatgtcagaaagtgatacagccaagcaactgcaatcttggaaaatgtcaggcggattgcagcttccaatatcgagactatcgcggcattggaaagtgtattggcggcagtaatgcaacttttcaatgtgtttgcttctatgactgtggagctccatcaagtttagtgtaa

SEQ ID NO: 35350 - DNA, 219 bp, Glycine max
  Peptide Sequence Number=SeqID_127035
atgttcctcgtattcagcagtgctttgaaaggacttgatgatactccacagcctaaatccaaggctgctgctagacaaaaaggaaccactgaacgcggctattacgtcatgcactggatgtccaccatcatcttaggaagtttcaggaacaacggggaagcgtattttaacaatgctagaccattggagccagagagattaaaggcgcttcgcatctag

SEQ ID NO: 35351 - DNA, 1047 bp, Glycine max
  Peptide Sequence Number=SeqID_127036
atgaagaagatccttccgtcaaatatggctttgatgcatagatatgggaggaatttgcggcaacccgcaaaacccctaattggcaggaaaaagatgcaggaaatccaaaagaataatgactgtctccatttgctttcccgtgggggatatgatttgctagaaaagaagccgttagatgagaaaatcaagaaaaggcaacatgacgcattgatgattgaaaatccagcactcattgaggaccccccatctcccattaaaagacatgtcaagtggaagatggcacgcacgaaccgatatgggaagatgacatctgaggccgcaagacaaattgctgataaaattgccagttccaacttcaatttggattacaacaattttaattttggattaaaatgtcacatgggtcgtcaaaatatacttaacacggccatagggagaccagatcatggaggtcgtgttcgtgcagttgggtttgggatcacaattagtcaatactatgggaggacatcacgtgcctcaactaccttatccatatcattcaccaaagaacagttggctgaaataatagcttggaaaaacaagctgaaggattccatcattactgacatatttaatggagataaggtctcagcacgggctaattttgacttaaatgtgttaggtgcacgcgtgagcactaaggagagcaatgctgaaattgctgtgaacccgtctgaggaagaacatgttggtcgtgtaacaccgcctatggggttgtacgtccaaagtcaagattgtacaaagctggtggcattgggaaaaattcatgatggaccatctaccatacattgcgtagcatatgcagatgatgtcgtaagggttagcatcgaaaaagtaattgatggtgaagctgaagttccattagcgacatcaaaaattaagtatgtgagagaggtcgttaacacattcattgcatggccattgcctttgcattcaggcatcactccgaacaaagttacgaatgctgccgaattaaacaatgatgttcctaaacaagaccccttgtga

SEQ ID NO: 35352 - DNA, 546 bp, Glycine max
  Peptide Sequence Number=SeqID_127037
atgactgctgatgggaaagttcctaaaactagaccccagtggcttgaactgaagactaacgttcaacgcggaggctatgagtgtgggtattatgtgatgcattggatgcggaacataattggcgtggagttgaagagtgattggagtgtgtggttcggtgatggctcgacactagacccggaggcaatcacaacattacgtaaaaaatgggcagcttactttttgaaacttagaaccatccaatcatatgaagcgccaaatgtaagctttcacattgttggtattgttagaaaaaatggatgtaggattatgtctttgcaggtgctatcttcatgtataagaggtcgcaaacatacagtagttactgcagagaccatcaagggtaggctcttgatggaaatgaattatatgctagcatatggttccggggaagcttctttgaggctattatggaattccggtagcctacatatacttctcccctttgaggtagatattgattttgcatttaatttcattgcagtctttgttctccaacttggataa

SEQ ID NO: 35353 - DNA, 117 bp, Glycine max
  Peptide Sequence Number=SeqID_127038
atgaggctcacctgtgggataatagttgtagaagagacagacaaactcgcaaaggaaggcaaggtggttatgataaagaagaaaaggcagctagagcctacgatttggcagcactaa

SEQ ID NO: 35354 - DNA, 321 bp, Glycine max
  Peptide Sequence Number=SeqID_127039
atgctgaagccacccgctttttgcaatgcattctttgttcttcttcttcttcatttgttgcttgctttggtctctgcacgaggatctcacagaaccacttggaacattctcacccgctacagtaacaacagcggctttggcaaagaagttgtcggagaaattaagaggaagatagaggttatgtgtttgatcaaatgtcaatatgatatttttggaggctctgtgccttggattaggaataggcatctctatagcttggagttgaagctcataatcatgatcttacaacctcctattgatctgattggaacaaatatctaa

SEQ ID NO: 35355 - DNA, 270 bp, Glycine max
  Peptide Sequence Number=SeqID_127040
atggaagtggtggttaagtcgttgagtgatgatgatttgactatcaagatcctacaaccatttgcccaggttaacaaccagctcacctggactaatcaagtttcttcaggcctaagtaaccaactcgcctgggctagctacagctcacctgggcgagtgagtaccttcagtactaagcaagaaactcgcctaggagagttggtcaacacctcttggctcaaattgtatataaaccagacaaaactagaggaaaccagaggaatcaagtag

SEQ ID NO: 35356 - DNA, 465 bp, Glycine max
  Peptide Sequence Number=SeqID_127041
atgaaagcttatgtcaagcaagcccacaagaaaaggaaggaagtggtacttgaacccggtgatgatcctgaacatttgaggacaaatgttttccaagaaggagggaatgatgagaatcatgaaactggccaaatacaggctaaaggcccaagtggagaaggacgaaggcccaaacttatcaaggtaatccttgtggcgtctacccagacttatcttccttcaccggaagtggcgtctacccagacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaatctctgtaacctgtatcaaacgatccactcctactcaggttcacatcataacatcagtcctttttcaaaatccttaa

SEQ ID NO: 35357 - DNA, 603 bp, Glycine max
  Peptide Sequence Number=SeqID_127042
atggattgggcagatacaaaatcaggaacctcatttgaactcgaggttactcaagctttgtgccgattggagcacgatcaaagggtgatcagcaatcaagaccaatctgcaactttctctagaccagatgatgaagggctattttatgacggatataatgaaaggcaagttcagatgcctatcaagaacctatacatgttcattgagatggcagcgcaagggaagcaactgtgtttatgtaataatgatgacaacagtaataatgatgatcgtgacagtggtgttgatgacattggtagtagtggtgatgatgtcaatgtcgatagtggttgttggcaaattggcaatggtgtttgtcgtggttatgttgataacattctcgcagtgctagtggtgatgatggtgttaatagtgacaatctgggagggaagtgatcttggtagcggtgttggaaatcccttagatcttgtggccttctatgttttgagccctggtgtggtggtgcggttgcctgaccaatggggcagggtagcagtgctacaacaatggcaatcagggaggtgggggtgtgcaatggggagaaaggaggttgtgacacactga

SEQ ID NO: 35358 - DNA, 704 bp, Glycine max
  Peptide Sequence Number=SeqID_127043
cgaaatttgaaatcccagacgcttttgacagtaggacgaaaaataagttacttaagactattggcgagagatggaggcagtttaaatcagacctcacgaggaaatgggcccttgcagccgatcaggatggtgtggatgacattgtctttgagaaatacgacataagcaaggaaaaaatgggcccagttttgccagactcgcagagaccctttgatgaggacacaactaagggcaaggaccatgaagcacttgaagggcccatgaccagaggcagacttaaacaggcccaacacattatagagacaaggctggatgtgtggaaaaaggcacaggtcatccagaaacagaatactgtcccccacattttgtctcgtgggggttatgaatatttggagcagaagctcctggctgagaagaccaagaagaagttggaggaagctacacagtcaggaagcgtggatggcgttatcgaccctccatccctcgtcagacgccacgtgaagtggaagatggcccacaccaagaaaacaggggagatgacgattgaggccgcaaaggaaatcgctgacaagatcgtaagtcattttcaactaaccattaaagtaactcggtgtggaagcaatgccttccaagaatattttgatgatgccaaagaattaagagtcaaacatgtttcaagaatcaagatcaagattcaagaataa

SEQ ID NO: 35359 - DNA, 426 bp, Glycine max
  Peptide Sequence Number=SeqID_127044
atgattgaagaaaatgatgttggaagtacattaactgttgttaaccaaaatggatgttgttcacatgtctgcatatgcttgctgcattcgtatggcttgctacattcgtatgaccatagagtggtgacagtgaagtgccttaagaatgtcacaagtggagatgctgagttttgggcagaagtcacaatcattgccagaatgcaccacctcaacttggtgaggatgtggggattctgtgctgagaagggccaaaggatacttgtctatgaacacatccctggtggatcattggacaagtacctcttcagggtcaataagtctcataacaataaccatctcaaggagcaatcaagtagtttgaatccaaacacaccacaacaagtcatttcactatgttatacctatgatggtcaagttggtgactaa

SEQ ID NO: 35360 - DNA, 504 bp, Glycine max
  Peptide Sequence Number=SeqID_127045
atggggacatgttggggagtcggggtcggggattggggagacaatactcgtccccgccccatcccattgccatgtctatttcccttactgtgggaaaaagggtattttggcatctaccgattttcttcattcccaaaaaggattacacaacccaaaattgactcttcattcccaaaagctatgttcttgatttttcttcatctcccacactttcagaaacttctacaagagaagttctcatctcccacacttccacagctcattacactggaaaatctcccaaccacagtgacgcatagcaacacacgacgatgcacaacgacacacggcaacgcacacccatacaatcgttcccgtcgacggatgtctgatgaaatcagtcttattttgcaccacaatggtaaattcatacaaaatgaaaatggggtactagagtatgtcgatggtgaattctgtgtccgggaagaaattgaaatagatttggttaatgtctggacaccctaa

SEQ ID NO: 35361 - DNA, 84 bp, Glycine max
  Peptide Sequence Number=SeqID_127046
atggctgcaccgtttttctcaacaccctttcagccttatgtttatcagatacaatatcatgcattgatggcttctctcagctag

SEQ ID NO: 35362 - DNA, 390 bp, Glycine max
  Peptide Sequence Number=SeqID_127047
atggagcataaaccatctgtttcgaccattggctgggacatgaaccttcttgctgcagcctatgatggaataatatcatcaggtatcacctactatgttcaagggattgtcatgcagaaaaaagggcctattttcgttactactttcaaccctttgatccatcatgggtgccttcatccttgcagaaaaaatatatcttggaagggcaaacacaaggagaacaaagagaaagagacagagataaccattgaggtattaaagtgttgttcagaaaataggatgacattggagactgtggtagaagatgctgaaacaaacaacgacattgagatgcaaaagggtgaagcctcaagaaagttaagggtagccattggtgttcaaaaagtttaa

SEQ ID NO: 35363 - DNA, 150 bp, Glycine max
  Peptide Sequence Number=SeqID_127048
atgggtgaatatttggagactccaacggaggatgctcacccttgcggtagtgataaaccccaacgacagtcacgaaccccagcggcgacgatgatgaggagaagacggcggtcacaggttgcaaacgatggtgatagttcttccaggtga

SEQ ID NO: 35364 - DNA, 384 bp, Glycine max
  Peptide Sequence Number=SeqID_127049
atgtcgcccttgtatccgtacccatatcaaagcggaacttcatcagatgcatattttatgggaacgcaacctccgctacaaccaggatatgttatggctgacttatttgggtctccttctcctgcgggaaccccttcatttgcacatggttgtcagatatcaatgcctaatgccccaatggatcctccatggagtgtgtcgagaaacatttctaacattactgatttattaggggtagatttaggtaatcaattttctgctgagactgatgaaaggaggggcgataggagaaggaattcagaccgacaagctcggagatgggagcgaccatgtgggatgtcctcccgccataacacacatgatgttgttgttgatgatgattga

SEQ ID NO: 35365 - DNA, 363 bp, Glycine max
  Peptide Sequence Number=SeqID_127050
atggcttcagagttatcgactgactcaacgaagacaaataccagttctgattcatcattagctacaaacaaggacattatagaagtgccatctttttgccaccgacaatgggcaccagagtaccctaagtttgtgaactttagatatgatggagcaataaaccaaatcaggctaaggcaacatcgggcaaaagtctactttgtggaagggctgaacgaatttagaaaagatttatcaatttttgaatctgtgattagcttaaattttatttctgttttgcaaaccacgggaatagaactgatccccgataacaaaatcatgtactgcatcctcatcatcattgtacaatatgatgcagcttaa

SEQ ID NO: 35366 - DNA, 1386 bp, Glycine max
  Peptide Sequence Number=SeqID_127051
atgccgttagcgccgttattctccgcgtctcggagcctcgccgctgcagcagcatttctgcgccactgctccaccgccgccacgacgaaccgaagaaacctctattcccgaatcagccccctcggagacccttccatcagcgtggttcccgttctcgacgagtggatcgaagagggtaacgccgtcgacgggccccacctccatcacatcatcaaaatcctgcgtacccgcaatcgcaacacccaagcactcgaggtttctgagtggatgagtagcaaagggctcccaatttcctcacgtgaccaagcagtgcagctggatctcattggtagagttcatggagtggagagtgcagagaggtatcttcagagtttgagtgatggagacaaaacttggaaggttcatggtgctcttttgaattgttatgtgagagaagggttggttgataagtcactctccctgatgcagaaaatgaaggacatgggttttgtttcctttctcaattacaacaacataatgtccctgtacacgcaaacccaacaatatgagaaagtccctggtgttctggaacagatgaagaaggatggtgttcctccaaacattttcagctacaggatatgcataaactcatattgcgtgagaggtgacctcgcaaatgtggagaaactgttggaggagatggagagggaaccccatattggcatagattggattacatactctatggtgaccaatttctacataaaagcagacatgagggagaaggctctggggggcatgatgagagcttggaagctccagaaggccaactgcaagaagcagcttaatagggagtatataacaatgttgggttgcttggtgaagctgggggagcttgataaagctgaaaaagtactcggtgagtgggagttatctggtaacacttgtgatttcagagtgcctaacatccttctgattgggtattgccaaaggggattggttgagaaggcagaagcacttctccgaaaaatggttgcggaagggaagacgccaattcccaacagttggagcatcgttgcatctgggtatgtggccaaggagaacatggagaaggcatttcagtgcatgaaggaagctgtggctgtgcatgcacagaataaacggtggagaccaaaagttgatgtcatttccagcatattcagttgggtcactaataacagagatatagaggaagcggaagattttgtcaattcatggaagtctgtgaatgcaatgaataggggcatgtatctgtctttgatgaagatgtgtattagatatgggaagcatgtagatgggattttagaaagtatgaaagctgataatatagagatcgatgaagagataaaggaaactcttaactcataa

SEQ ID NO: 35367 - DNA, 150 bp, Glycine max
  Peptide Sequence Number=SeqID_127052
atgattcaaagctttgaggcagagctttcagtgccagagcttgtctccaaggaaggagggccagaagttcaagtgctggctgattatcctgtaccttctagcaaattgttgagttctgattcctctattgaagacctaacggaaacatag

SEQ ID NO: 35368 - DNA, 414 bp, Glycine max
  Peptide Sequence Number=SeqID_127053
atgaccacaccttttaaaacaaaggaagtcaatgaggaaataaccacgaaggatattaggagcttaatggaacaggctaattacgccaacaaataccttcaggtgttacaggaatctattagtgaagaaaaggaaaacacattttcaagaattcataccgtggaggaggagggtgttttggagcagaaggaggcacaagcgtcgaagtcaaagaaggaggaagtggtggccatgagggaaagtgttttggagattaagaggttaagggagagggagggggtactgggtaacagtgaaagagtgaggggggttgttggtcttggaagagctataggaacaatacttgtattctggaaagagacatatgcaagagagttagatagagagagagagttacaccacgaaggagagtga

SEQ ID NO: 35369 - DNA, 339 bp, Glycine max
  Peptide Sequence Number=SeqID_127054
atggcagatactcttagtaatatagaaacacaagaaattgagtccattaatgtcatgcccatggatacaccaatttcgtttgaggaggttatgcccggagatgcttcaaatgatgctgaagaaatgaatatccagccttgtcttgggttggagtttgagtctcttgaaaagatgagtgttcctgcacagagtcttgtggaaaaatttgaggaagaagggttgcctacaaggaaggttgcttcaattttcaacaatggtgactcatctttctccaataaggattgctggaatcatatcagaaatcttcgaagaaagaatttagatattggaagatgctaa

SEQ ID NO: 35370 - DNA, 2352 bp, Glycine max
  Peptide Sequence Number=SeqID_127055
atgacccaagaaaccgtggaccacgaccaccaacaagacgacgacaccgagtcttgctttttccacgactccaacgaccgtttactctcctcttcttcctcctgctccacttccacctccgacgacgacactcccactacccaaaacgacaccctcactcaccgaaacgacgcctccatcaatgccctcccacaattcccttttccaactatgtgcaagtacgacgcttggatctccgaaccctcctccctctccgaacgccgctcccgcctcctccgccagttcggcctccccgcgccgccgccttcctccgccgcaatcccccgatcagcctcctctcaccattgcaccgacacttcctccaccgccgcctcgattccccgatcgaaatccgacaacacctcggatcgcggcaccaagcattgcaagtcttctgttgttccaatccacgacaatgacgacggttttctcgtaaataatagtaataatcgtggtggtggtggttctgtttgtgtgaataataataggatttgtgtgagtgtgtatgaggatgatgacgacggtggtggtggaattggggagggtaatgttaatgtcagtaatgtggtggatgaaactgtgcaagcgtgtacgattagggatttggataatggaaaggagtttgtggtgaaggaggatggggtgtggaatgaggtgaaggaggtggggactgggaggcgtttgactgtggaggagttcgagatgacagtggggcattcgccaattgttcaggagctcatgagaaggcagaatgtggaggaaggtggtaatggggagggtgtggatggtgatcgggatggggatggtggtgttggtggtgatgatgatgagggggatggtggcaaggtgaagaggaaaggagggtggtttaagtttatgagtttgaagagtgttgtggtgggtcagaaggagaggcggagtggggacgagaaggatacgtctttgtcggagaaggggggtggccagaggtcgagttcggccacggatgatagccaggatggtggtggtttggttcatgggggtgagagagtgagggttaggcagtatgggaagtcatttaaggaggttacgggcctttataggagcccggagattcaggctcatgagggttccatttggtgcattaagtttagtttggatgggaggtatcttgctagtgcgggtgaggattgcgtgatccatgtttggcaggttgtggagtcagagaggaagggcgagttgctggtggagaaaccagaagatgggaatttgaacatcatgtttcttgtgaatgggtcgccagagccttcttctcctggcatggacaataattcggagaagaagagaagggggaggttgtctgttagcagaaaatcattgagcttggaccagttagtggtgccagaaactgtgtttgcactcactgaaaaacctgtttgctcctttaagggtcatctccatgatgtgcttgacctttcttggtccaagtctcagtttaatcctgttgatgatagatacttcattagtggatctttggatgctaaggttcgtatatggagcattcctgatcgacaagttgtagattgggctgatttacatgagatggtcactgctgcttgttatacacctgatggtcagtttgtgcctggaagttcatcagaagtacttatcacttcttctgattctcggattcgacttgttgatggtattgaattagttcataagtttaaagggtttcggaatgcaaatagccaaatttctgcctgcctcacagcaaatggtaaatatgttgtctcagcaagtgaggattctcatgtatacatctggaaaaatgaagctgattgcagacctagcaggagtaaaggtgtcactgtgacaagcacatatgaacattttcactgtaaagatgtgtcagtggccattccttggtcaggtatggatgatacatgggagatgcatgattcatattttgcagaagaacctgagcttgatgatgatggggatgaggatgaggtctcatcggccaatcatcctcctactcctgtagaggaaaatctaggttctgagggttcacaatttgcttcaggttgcaacaacagtccacttcatggaaccattgcaagtgcaacggatagttattttcttgatagaatttctgccacatggcctgaggaaaaacttctaacaacaagggaccgaagccctcgggtaagtgtggatttatctaatggggtgaatcaaaacatgtcagcctggggtatggtgattgtaactgccagccttcaaggggaaattaagattttccaaaattttggattgccacttggtatataa

SEQ ID NO: 35371 - DNA, 1041 bp, Glycine max
  Peptide Sequence Number=SeqID_127056
atggtggttaagcgaaaggggaaaggtcaaggtagtgcgcctaccgtgccgcttccgcttccgctgtctaagacatctaaatttgctaggagatgggttccattctctaagaaatacaatattgagccttgggcaccggaatggtacttcgatcagaagatggactatttgaaaaataaagtacacccaacatttgtcaaggaaaggagagcaatgaagatgcaaccatttaactctgctaatggtctttttcattctgattgttacagagggattatgaagaatttaagcaacgttcaaatccaaaacataacttatcgtgcaccaactgaattcccttacacaagtggtatagttccaaattcttttcagtatgtatgcattgataacaatagcattagcattggtcatgatgcaattattctgaagggtggtgctagcttggcatttggaagtgacatgcctgggggaatatttgatattattgcagaaaagcgtcggattctcaactctcctattggcattgaactaaagacaactaggggtagaggtggctatatgagaggcatcttcatttttgatgcagaattggaaaatattagcttgggaataagcatgacaggatactccgatttccatccagatgacaagtatgacactagttcacttccagttgttggtgacattactttcaagaatatgattggggaaaatattagtgttgctaggaatttttcaggaatagttgaatcaccattctcaaaaatatgtctttcaaacatgactttttctctcaactccgatgcatctccttcatggttttgttctaatgtaattggtttctctgagcatgatggtctaaatgttgtgagttgtagaaagtaccctctccccattgccctcatgtatggagctaaggatccttccattgcagggatggttttagacagtcccttttctgatttggttgatttgatgatggaacttgtagatacatataaagttcatctgccaaagttcactgtgaagtttgcaatgtag

SEQ ID NO: 35372 - DNA, 124 bp, Glycine max
  Peptide Sequence Number=SeqID_127057
atgatgatgcctgtgacggaaccatcccttactgcatcggctattatggttgttgttcttgttaaggctaaggttgaagttgaacatgaggtggtgacggtgacagtggagagtaaaagcgaga

SEQ ID NO: 35373 - DNA, 372 bp, Glycine max
  Peptide Sequence Number=SeqID_127058
atgttttcccagaaggaggaaatgatgagaatcctgaaattggccaaattcaggctaaaggcccaagtggagaagggcgaaggcccaagtggagaaggacaaagcccccaagtggagaaggatgaaggcccagaggcagagacactatcaagactaataattgttgttgaaggctcagagattaatttaaaggcccataataaatatgttctaatttttttggctcaaactgttttaaaggcccatacttatcaaggtaatccttgtggcatctaccctgacttatcttccttcactggaagtggcatcttccaaaatctccgtagcatatatcaagcgatccaccccgtaaggttcacatcatcgcgctga

SEQ ID NO: 35374 - DNA, 282 bp, Glycine max
  Peptide Sequence Number=SeqID_127059
atggcttgggtgttgctggatgaggagttttgccccaaaaagtttcaattttttagaacaagcacattcacggccctgcttcaattactttctgggtgtagagctatcaagagaagggatatatatggtgcttgggagcaatatcttggactggaacatgatgacagtgctccaaaaaagtcctatgcagtcaacgaggaaataaattgttgctttgttgagtggatgtgtaagttgaggtgcaatatcaacaaaaggctctgttcttctatagtttcttag

SEQ ID NO: 35375 - DNA, 228 bp, Glycine max
  Peptide Sequence Number=SeqID_127060
atgggaaagcgtagaaagttgaataccattcagaatgatgatcaatcacaagcaaaagagcaatcaattgaaagctctactggagtgaaccaaaataacaactctataattaaagaaaatgcacaatttgaaagagaacaacacatacaagaagaaagtcatgttgagtctcatacttctcttggaagtgcaaggaaagttcaactaaaggtaaaaaaagaggactag

SEQ ID NO: 35376 - DNA, 489 bp, Glycine max
  Peptide Sequence Number=SeqID_127061
atggtactaacagaaaaaacaacaagaattttggcagtcggaactccgaaaaaggtggccagaacaccgacggtggctcaaacgatggctccgtgggctctatggacttgccctccttctccatatccttcctacaacaattgggccaaacccactttcagtcctagaccaccacagcctgcagctcttcatactctcagccttgctcaacctgatccgtcatggtacatggacatcggggctacatcttacatgacatccacggaaggtaatctctcgtcttattctaatttgagcaaaagtcatggtataattgttggaaatggccattctattcctattcgtggttttggtagtgctaatttacctcatccccaccctccattagtggcgagctatatcccatcaccaccaccaccacaaatactcaagtcgtttctccatccacttttgcagctttgtcttcttctctttggcattaccgtttag

SEQ ID NO: 35377 - DNA, 558 bp, Glycine max
  Peptide Sequence Number=SeqID_127062
atggaagaaaatgatgaagaatgtcttctccagcctctcaaacctaaatctctttgtttttcaggaagccaagctctctttgttgctctcaaccagttgtgtcttttcatttctgccaacttcagtgttttaaaggctcttggacttctcagcttccaaaggctcgctgagcgagaaatctggctcaagtctcattgcaggaggcaaaggtgggctggcaagtcatacaagaattcccatcttggaaatgaatggaagaaactttttgctggttcatcccatgccaagggaattgtccttgaaaagataggtattgaggctaagcagcctaactttgccattgataagtgtgccagggttcaacttatcaagaattggaagaagattgccgcttttttccctaatgatggtttcttgaactacattgaagcaaatgtgagtgcttgtctgtgtttgctagtttcattattgtcataccctaatttcgtccggggacctttgcttggtggcatgcaacttgtgtttggtcattttgaggtgcttggcacccatcattag

SEQ ID NO: 35378 - DNA, 387 bp, Glycine max
  Peptide Sequence Number=SeqID_127063
atgttaagtcaggtgcctccttcttggcctcattttcgtttttcccattctcctctcaaaaccctttcttttttccgtagcccacaaaacctgtctcagaaaaacaatgatcccgaactcattcaccgttggataaaatttgggtacaacgttcacaacacaattccgaacattttcaccgttgggaattttaaaatcatatctgagattagaggaaaacccttcgcaatgaagccttttattttcccgcagaaatccaaaactatctcgaaatctcatgaagacagtacaagtggaggtttcaatctcttctccgtctctttgacgtttgggaattctatcggagcagtcggaggaataactggaggaacctcagggaaccgctag

SEQ ID NO: 35379 - DNA, 255 bp, Glycine max
  Peptide Sequence Number=SeqID_127064
atgcatcttgttgagcctcttggaaatggtgacgagagaagcgttgatgtagcttctagaaagcgacgccaatgtcaggatttctctgacatatttttcatcggctgggacttattcatggttggtggctttgacgatgaagactttgaggttgggggccaaattgtcggtgaatatactaccttggattggggcttagggtttcctcccagtgagagagacgaggcgcgagttaaagagtcacatgccctttaa

SEQ ID NO: 35380 - DNA, 297 bp, Glycine max
  Peptide Sequence Number=SeqID_127065
atgcctgatacgacgacggtcgataaccgatgttataggctacaaataaccgatgtagtaggctttcattgtagtagtgttaacaagagaaattggagaagcagagatcttggaggatcaatcatcaatggctgtgaaaatttacagacaaaagactacaacattgacttcaatagttcaatcatcttcttgtgttttataggatatatatctaatgaaagtttggcaaagcaagtggaaaaaggagctaactctatagaaggtgttgaggccaaactatggcaggcatgtgtttag

SEQ ID NO: 35381 - DNA, 606 bp, Glycine max
  Peptide Sequence Number=SeqID_127066
atgagtatgagtttgaattccaatttccaacgaaacaagcttaggaaagagtggagagtgcataaagaacaagggcttcttttcgagtttccgttgatggtgagtttcatatcacagtttgggttgggccattcgcatcgtcttgtggcagatccaacaccagccttggtggctccattcggtcaacctcatgcagcggacttcctcgtcaaatctgtcataggatcttctacctcttcctccctacaaacctttgttgttgccgctattgcgatcgcctttggggctcaactacgagagagagcaagcgaaagggaaagggtgagagagctacgccatgagagattgggagagcacacaaaagggaagggtgagagagttgatgcaccacgagagactgagaaagcaaagaggaatatggatcttcttttcgtggatattttaagtgataagcaagagaaggatctagaaactaatgaagttgaaactcctcattctcaggctcctttgccgtcattcaaggttcctaggatagaagaagttgatatcccattattagagaaagatccaagaaaaatgttgttctatttggcaatatcttgttga

SEQ ID NO: 35382 - DNA, 314 bp, Glycine max
  Peptide Sequence Number=SeqID_127067
atggctgctccatttaaggcttttctagaagatctagggaaagcaggacatcttgcaggcaagtctgctggatggaatcttcatcaccaccacttcccgagttggcttgaggtctttgaccgcgagaagtttaacaattgggtggagaagggtgtaactccagccattgaacccagtttaaagctctatgaagatgttttgaatctgggattcaaggttattctactgacaggacggagtgaaaggcgcaggagtgtcactgttgataatttgatcaatgctgggtttaaggaatgggaccagctcatactaag

SEQ ID NO: 35383 - DNA, 273 bp, Glycine max
  Peptide Sequence Number=SeqID_127068
atggagcgtggtcatgaaatgtattacacgccagaaacatttttccaatatcctttacagatgtatcagtatccttttgaaggtcatcacactgatacttctgtgagcgaacattcgttcggtggtgttgatttgcgtcaggagttttctactgaggctgagcaagtaaaagcggggagacatcgcggcagaaaaaatcctgatcgtcaagcgcgaagatgggatcgatcatgtggcacatcctcacgacatcacggacaccataatgaatga

SEQ ID NO: 35384 - DNA, 297 bp, Glycine max
  Peptide Sequence Number=SeqID_127069
atggttacctcgaagaaaatagtgaaggtcagattgggcttcattctcaaccaaaaccgcgaggcaagtttggaagattctgctccaattgaagggttcctcttggtgtggggtttcaacggagaactacgatggtttcgtggtggctgtgggctacacgaaaagcaaagtctgaaacactcaagtgcttgtgctcgagagaaaggaagcattcctaacactccagacatgatccagaccaaatttcaagaagatccaacggttaacgaaggcaggagcgcgattttagcgagatag

SEQ ID NO: 35385 - DNA, 210 bp, Glycine max
  Peptide Sequence Number=SeqID_127070
atgcattttcagatgaactcgctaagcacgcctaccgtgctaagcgagttcatcttttggggaagaatattcatcttcttgaggagatacctttggctaagcggggtaagcccagctatcattaggcttagtgggcagtcactcgctaagccgattatgcagaagctgaattttctgcaatatccgctaagcggccctccatgtcgctaa

SEQ ID NO: 35386 - DNA, 381 bp, Glycine max
  Peptide Sequence Number=SeqID_127071
atgcctccaaatgttctttacgatgccatgggatatatcaacggtgttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 35387 - DNA, 312 bp, Glycine max
  Peptide Sequence Number=SeqID_127072
atgtctacccaaggtgcagaggggatgggtaaggcaacaacccgtgcctacatccagtccccaagcgacttgcggtccttgagatttcttttccaaccttgtaaaaatccttttacaagcaaagatccacaagggatgtaccctcccttgttctctttgaacaacctagtggatgtaccctccactagaactgatccacaagagatgttccctctcttgttctcagtcaacaacccaagtagatgtaccctctacttgtaccacaaaggatgtatcctccaatgtgttaagacaaatttctcaggcggttaa

SEQ ID NO: 35388 - DNA, 152 bp, Glycine max
  Peptide Sequence Number=SeqID_127073
gtgttgagggaaggagcctagagtatgaagaacctcgggatttgaggtcaaatcctttccaaggtggagggaatgatgcaatcctatccccaagggcattggatagaagactccaagaagattgggccataagatgcaagagaaggccctag

SEQ ID NO: 35389 - DNA, 291 bp, Glycine max
  Peptide Sequence Number=SeqID_127074
atggagacttttcaagtctcacaagttatccagaactacgtaggtcatgtgacatgcacccttgtatcatccagaggcggcgggcccgatgatacgcggagataccttacggttatccgcacccttttgtcatccagaggcggcgggcccgatgacaagcagagaccaaagaccaagtttggtcattctgcacccatgaacgcggagatacctatggcgcaccctttgtatcatccagaggcggcgggcccgatgatacgcggaaccaagtttggtcattctcacccatga

SEQ ID NO: 35390 - DNA, 336 bp, Glycine max
  Peptide Sequence Number=SeqID_127075
atgcatgccagtttcatacgaccaggtggagtggcacaagatctgcctcttggcttatgtcgagatattgattccttcacacaacaatttgcttctcgtatcgacgaattagaagagatgtcaaccggcaaccgtatctggaaacaacgattagtggatattggtactgtcactgcacagcaagcaaaggattggggattcagtggcggggcgggccacccaccttcgaatggtgttggtcctacggaccgtgaatggattcgcctctggcctctgggcacgtcggaaccgcatgagttcaccggggtggagcacagtccgccaaaatcggcatag

SEQ ID NO: 35391 - DNA, 291 bp, Glycine max
  Peptide Sequence Number=SeqID_127076
atgttggataaacaggtagctgtgtctccagcaaaacctgcagataggccagatcctgaggttatgtgggatgctttcttgttcgggctgtttaattcagacttccctttgtacataaagcatgaagatctgtctgaaatagcacacggtggtcaatgtcttagcatctctgttatacagttgtggattttaaagttacatgaagagttggatgcagaattcaaaacgcgatgtctaccttggagcctacctgaatggcgcatactggcaaatggtcgtcattttgcctaa

SEQ ID NO: 35392 - DNA, 267 bp, Glycine max
  Peptide Sequence Number=SeqID_127077
atgagtcttcattcttcatctagtgttaatggtgagggttctactcctaaggaccccttgtataagatattagatgagttgagatcccttaagttgtggaaagaaaaacaagagagaaaagaaaaagagggcgccatagctcacatactaaacatcactcccaaagaagagaaaatgatagaaggcctcaaagatgtaacattagtcccatatttccatggaaaagataatgttgaggcctactttagattgggaaatgaaggttga

SEQ ID NO: 35393 - DNA, 395 bp, Glycine max
  Peptide Sequence Number=SeqID_127078
atggagaagctgggccgagggaggagagaaactcgagtgggagaccttggggccgttgggagaggtaacttgactgagtctttgactggttctcctttgcaaggtgaacccaagaaagaaaagaaaagacaaggaacccaacatccacagaggacctgctatgtggcaggaagtgctgggagccctgaacacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 35394 - DNA, 386 bp, Glycine max
  Peptide Sequence Number=SeqID_127079
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaaaacgacggccagtgaattgtaatacgactcactatagggcgaattggagctccaccgcggtggcggccgctctagaactagtggatcccccgggctgcaggaattcgatattatcaaattttagtggtagaggaggatag

SEQ ID NO: 35395 - DNA, 942 bp, Glycine max
  Peptide Sequence Number=SeqID_127080
atggtagccacggcttaccaaacctcccatgaatgttcggaagaaaccattatagatatcttagtggcagggttttctggaaaactaaaaggatggtgggataattatctcactaatgaagagaaatcaaaaatttacagcgcagttaagacggatctcaatggaaaagtcatttctaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagaaaagatagccaacaacctttttggaaagaaaaattcctagccggtcttcccagatccttaggagacaaagtcagagataaaatccgtagtcaatctgccaatggagacataccatatgaaaacttaagctatggtcaattaatttcctatgtccaaaaggtagccttaaaaatctgtcaggatgacaaaattcagaggcaattagcaaaagaaaaagctcaaacaaagagggatttagaaacctcggaggaagaaacagaaacttcatcctccgtgctttccgatgaaaacctaaacctaatccaacaagatgaccaactatcatcaacagatgatgatgatgggcaaatcaatactctaacgagagaacaagatctcttgtttgaagcaatcaattccatacctgacccccaggaaaagaaggtttttctggaaaaactcaagaaaacattagaggtaaaacctagacaaaaggattttattacaaacaacaaatttgatgtaagtaacatactcaagagattagaaaattcttccaccaaaccaacgacaatccaagatctccaggggatcctctag

SEQ ID NO: 35396 - DNA, 516 bp, Glycine max
  Peptide Sequence Number=SeqID_127081
gttgatgtgacatacgagaattggaagcaagtccctgctgctcagaaggatttgatatgggatgatgtgcaggttgaatttgatatccctgaagcatctgattctgatttgacatcaaaatgggctcttgtagttgacaaggatagtgtcgatgacactgattcgttggaggagcaggcgtcacagggttcctttgccacccatggacgtcaagatgtactgattgctgccattgggcgaccagaacacctcgatcgtgtgcgtgttgctggagccaatggactggcactgcctcctgagcctgaggttggtccttcagctgctcgtgtcagcacaaaggagagttgtgttgatccctcagggaacgatccagacacgggtgactcagacaaaccaggaagagtttatgagggatccacaactgttttcaacatccctttgttgcatgatcaagtgaaggtcagtgttgaggaggttagagatgcagatgctcccattcctatacctactgaagag

SEQ ID NO: 35397 - DNA, 428 bp, Glycine max
  Peptide Sequence Number=SeqID_127082
atgttgactattggcccccactctcttctggcttgtagagtttctgccgagagatccgctgttagtctgatgggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35398 - DNA, 480 bp, Glycine max
  Peptide Sequence Number=SeqID_127083
atgatgatatccactgccaaaggtgcacagtcttacagtgacattagaacagtcaatggtgtggtatatggtacatttaaggaaacatgttttgcaaaaggctttctaggtagtgatcaagaatttattagtgctttacaagaagctaataattggggtactgcacactacctaagaaaattatttgtcaaaattttatttatgaacaccatggacagaccagaatatgtttggcaacagacatggcaatggatggcagatgatatcacattcgatcatagaaaacaaggtatccaccttactgaaaaggaaacaattcatttatgcttgactgagattgagaatatgctacaagccaacagaacgaccttgcgagattttccatccatgccatacccaataggatatgcacccaaccagcaccataataaaccaatccataatgaaatggcatatgacaaacaaatgctagcagcataa

SEQ ID NO: 35399 - DNA, 176 bp, Glycine max
  Peptide Sequence Number=SeqID_127084
caaaggcgactcgtggcggtcaccgatggtcagtggtggtggaggaggaggttgtgggtgttgagggagggtttaggggaagaggtggagaaagaaatggctcttttgcgttgctggacgtatttgtagcctgcaagactcgtctaggcgaaatttggcttgcctgggcgagctga

SEQ ID NO: 35400 - DNA, 234 bp, Glycine max
  Peptide Sequence Number=SeqID_127085
atgctacaatgcgaaggacttttctctaagctcaaatatgattttgaaattaccaacggtaagactgttcggaattgggttgtaaacatgatactcaaatttcacgacgatccaacggtgaacgagttcgagatcgtcgttttactgagacaggtttggtgggctgcgggaaaaagaaagggttttgagaggagaagaggaaaaacgaaaatgaggccaaaaggaggcagttga

SEQ ID NO: 35401 - DNA, 282 bp, Glycine max
  Peptide Sequence Number=SeqID_127086
atgacagatcttgtgagcacgaaagatgacgtaaatcttcgcgtgtcaacgggcttgccggccgcgattgacgaagggcgcagaatgaccataatttgtctctgcgtgccatcggacacaactgtgtctgaatggcaaaaaggtgcggataaccgtaaggtgtctccgcgggctaccagcttttgggtcatgataacaaaaagcggtgcggtcgacaaaagcgaggctcctactcctacgtatcctccaatgaggaactcagacctacgtagttctggataa

SEQ ID NO: 35402 - DNA, 168 bp, Glycine max
  Peptide Sequence Number=SeqID_127087
atgaagaaagagtgttccaagtatgccgcatggcgtataaagaaagatacttggtgggtaaattctagtgctactactcacataggtatgactatgcaaggttgcttgtggaaccgactaccaagtgatgatgaaagattcatctttgtgggtgatggcggaatttga

SEQ ID NO: 35403 - DNA, 261 bp, Glycine max
  Peptide Sequence Number=SeqID_127088
atgcatgctctgttagggtcattcaacagtgggaactggtctgactctaaagtccttggtagtacgggactaagttgttgtgctatcacgagggatcgggcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 35404 - DNA, 555 bp, Glycine max
  Peptide Sequence Number=SeqID_127089
atgattatgaggagccaagacatttatagtagccaagatgaggctactacttcatcttcctctagtgaaagtgaagaagcaaaaggggaagaatctagtgaagaaatctacccccaagaagaaggacaacttttaatgtttaaggaggagtgtaaggaggtaagtgtctcctccaagagcttagctaagaaggaaaggcattttgaaataaagacaaatattaaagaattttcctctcttaggcaacctccacattttctcctttgtaaaaagacacttgttagcattgccacacctcttgggcttgaatttattcctcaagtaaaggaattgttggatgagggtttggtttgcaagagcttaaatccttatgctttgttggtgcccaaaataggtattattaggcaccaaatccctaaaataggtggtatgatgaatgttttgagtggtgcaaccctcttttgtaaaatcactcgtgcacccaacatcttcatgatttgtgtacatagggactcgttaggtaggaataatcaacatgaaaatacagaaaaaaag

SEQ ID NO: 35405 - DNA, 318 bp, Glycine max
  Peptide Sequence Number=SeqID_127090
atggtgggttacacaccttcaagttttacagatttggtcttcgccagcgaaagtatcgaagtgggtctgaaaagaggcaaatttggtcatcctcctttgataaaaactggggcaaatgaagaggatgagaatgagggagaaacccatgttgtggctgccattcctatatggccaagtttcccaccaacccaacaatgtcattactcagccaataacagtccatctccttacccaccacccagttatccacaaaggtcatccctcaatcaaaccacaaaacccacctaccacacgaccaatgctgaacaccacctttag

SEQ ID NO: 35406 - DNA, 144 bp, Glycine max
  Peptide Sequence Number=SeqID_127091
atggaggatagggtcatgactgaccgatcgtcgtctcttctcggcactggacaagcggagaacgtcgctgcaaggcagcccagtattagaaataccttagaatgtgcacgtgtgcaatttttggtagccaaaatggcaatttga

SEQ ID NO: 35407 - DNA, 192 bp, Glycine max
  Peptide Sequence Number=SeqID_127092
atggcttacactcacattccggattcacaagcgattctcctcaaatttcagccagcccgcatcaattggacctttgcaccttacgctttgaggtcatatagtgctcaatggaatgccccggggcttctccatgacaagcacacgttgcgttcgagtcgtatcctcggaaaaatggaggttaaggaaacctag

SEQ ID NO: 35408 - DNA, 304 bp, Glycine max
  Peptide Sequence Number=SeqID_127093
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttcagaggactacatgtcctcgccttgagagggctacacgccctcaccttgggtactagttaccctcaccgtcagaggactacacgtcctcgccttgagaggactacacgtcctcaccatcagagggctgcacgctcttacctccagaggactacat

SEQ ID NO: 35409 - DNA, 186 bp, Glycine max
  Peptide Sequence Number=SeqID_127094
attgacggtgaagttagtatgtcatttgctgtgaggtggaaagacgtacttgaccgtttatggcatttcattgacaaggatgaaaatttccataccgttgtctacaaacaagatttggacaaaccagccattgtagcagggtggacaacactaagagatttttatcacctgatcggagatcattaa

SEQ ID NO: 35410 - DNA, 666 bp, Glycine max
  Peptide Sequence Number=SeqID_127095
atggtcggcatagtacagcccggctttgaggaacgagatctgaccgttaaattcgaggccgtgcatgttatagaacgaccacggcagctctatctcattcatatgccaggagtaaaacattccctggtaggcgagattgtgcaccgtaaacaccgatttcgccggacggccgcgcgccgccagataggccggcgtcaggcccgcgtgccagtcatgggcgtgcaccacctccgggcgccagaatggatccagcccgcaggccatttcgctccccacccagccgagcagcgcaaagcgcagcacgttgtcggtataggcgttcatgttggcgtcgtgatacgggctccccggacgatcgtagagatgcggcgcgtcgatcagatagataccgacgccgttaaatggccgaacagcagggtgatgcgcccggcaaaggtatcccggcgggtgacgacctgcgcgtcggtaatcccgcggcggatatccggataccccggcagcagcacgcgggtatccacgccgtctgcgatctgcgccgcaggcagcgcgccgataacgtcagccagaccgccggtttttaacaacgggaacatctctgaacatacgtgtaaaacctgcattatcgctcctgtttgtgccccagtttccgcagcatgtcgcgcgtaa

SEQ ID NO: 35411 - DNA, 468 bp, Glycine max
  Peptide Sequence Number=SeqID_127096
cagaagctcctggctaagaaaacgaagaagaagctggaggaagctgcacagtcaggaagcgttgatggcgtcatcgaccctccatccccagtcagatgccacgtgaagtggaagatggcctgcacgaagaaaatcggggagatgacgactgaggccgcaaaggaaatcgctgagaagattgattcctttgaggagcaggcgacacagagatccttcgtcccccatggacgtcaggatgttctcactgctgctattggacgtctagagcaccctggacgtgtccatgctgctagagccggtgtcaccatcaagcaatactttgggtcggctccacggatgtcccgcagctcttcctccctgcctcttgaagaattgcagcagctgacccagcaaatcagggaccagctagaggagtccatcacagaaaacgtgatgcggcagctcatggcattgttcaaccagatgtag

SEQ ID NO: 35412 - DNA, 1205 bp, Glycine max
  Peptide Sequence Number=SeqID_127097
atgaagcaaactcgcaacggcgtagtaggccagccacggaaatacttggaaggcaaggcaagggatatggcgagccaagagaagtggggcccgtttgcggatatactagctttgttgatttttggggttgtcctctttctggacgtggatggtttggtggacttagccgccattgacgctttcctcgcgtatcaccatagcaaggagagtccagtggtggctatcttggcagatttgtttgatacctttgaccggagatgtgagaaaaacagtgcacggattgtctgttgtttacccgctctctgtgtgtggttggtttcacacctattccaacaagacacaagacacccgtgtccgcttcaaagctatcgctcatgcgccgaaaaaggaagagtcgattgggaccaacatttggctggaataggaggcaacgcaatcaattggtttcctcgttggaaggaaggcaaggaaagagttctcttctcgtgtggggactaccctaatgttccattgatagggactaggggttgtattaattataatcccgcactcgccataagacagctagggtaccccatgaggggagcgccaaccgaagaaagtctctcgcctttccttgtgagggatctaggcgcgcaaagtctcaaggtgatgcaaagagtccacaaggcgtggagaagtccgttgaagaaagacaaggagcttagaggcatccgaaatggcgtcatcggtggttatcatggatggctaagagttcacacgcgagggttagattggctctccaaattgaaagttatcaatgaggacaacttcgaagctccggaggaagatgaagaagtccaaaatctcaaattagagctagggaaggcgagactcgccaaggagaagttcaaatcagccgctacacacatccggaaagagtgcaccaagttacaagaggaaaacgcggccactgcaagagcccttgaacaagaaactaaaagggcccgcaaggaggaatatggccgagagaaattccgaggagcattgtggggtagcaacaatgagctcaagctccgaagagaggaaagagaccggtcacgggtgcatggcatgatcttaaaagaagagttagctgcgtgcgcaagatccaagaggagtttggctcaacacttggaagccacggagcaaagcatgctagctatcatagggcaatacaaggaaga

SEQ ID NO: 35413 - DNA, 453 bp, Glycine max
  Peptide Sequence Number=SeqID_127098
atgacaattgaggaatcaatacatgttacttttgatgaaactaatattacctcctcaagaaaggagtttgttgatgatattgcagatactttggaagatactcaaaatgaagaaaaaaatctgaaaagaaagagagatgatgaagacaaggatgatcaagatgacacagcacaagaaaatgataatcttcctaaagaatggaaaacttcaagaaatcatcctcttgacaactgtcataccctaatttcgtccggggacctttgcttgatgatatgcgacctttctttggtccttgtgaggtgcttggcacccatcattaggcaatttgtgaaattccaggacatgccggaaaaccaaaaaatattgatgcacaatccgcccttccagaacattttggaagttgggttgcttaaggaggaagccactgggcggcaagctcctccacgtttttga

SEQ ID NO: 35414 - DNA, 390 bp, Glycine max
  Peptide Sequence Number=SeqID_127099
atggtgaaaagttggaacctcttacgtgccgatcaacgtctcattttcgccaaaaagttggcccagggcttcccggtatcaacagggacaccctggatttatttatttctgcgaagtgatcttccgtcacagtggcttctgtttctatcagctgtccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagaattcgatcccatcagaactccgcagttaagcgtgcttgggcgagagtag

SEQ ID NO: 35415 - DNA, 213 bp, Glycine max
  Peptide Sequence Number=SeqID_127100
atgcggtcgctgggcagaatgttgctaagtagcaatgtcatctatatctgtgtaagagtggtcatgttggtgcgcatgatcccactctctctttgcagcggcacgggtgaaatcttgcccgggcggtatgcgatagtagcctgtgtgatagcctccctttctggttgtgattgcacagttggccctcctccaatatcagggggagtggcctag

SEQ ID NO: 35416 - DNA, 198 bp, Glycine max
  Peptide Sequence Number=SeqID_127101
atgaagggaaatcaacaaaggagtaagtcatggtccccagtggagtcgccaactgtcgcaacctacccttcggcggaagggcgacgcgtgactcgcgggatgcgtgttccacgaacggaatatgcgcggagtcgccaccaacgtttatttgaggaaaacgtcggaaaaaccggaaaagacgcgatctacgaactttaa

SEQ ID NO: 35417 - DNA, 606 bp, Glycine max
  Peptide Sequence Number=SeqID_127102
atgttgcgtcgaggcgcccctgcccgtagctccaaaccgcgttaccgagtcgaggcggccaatgccctcgtcgccaatgttcccgagccgcgcgacaagttggagctagcacgcttttccgcaacccggttgggcaaagatgtgctggacctcaacgaggttaccgtcaccgtctcctccgatgagcttggcgagcgtactctacttgacaaggtgacatggtcgatcggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35418 - DNA, 912 bp, Glycine max
  Peptide Sequence Number=SeqID_127103
atgattaactccctcaattttgcacgccatggcgacaaacagaactcggctttctttgaggagtacctgcaaaagctgctagaagagcgtgaccagatgggcctgaccgagatgattcaggaaattgatgcgctgatgatcacagtggacccggatcattccattcaatatatcgctgaactctcactgatgacctcgtaccactacctagtgacgctggagagtgaaaagcactggacacatattttgcgcatagacctgaattcgccagacttgctggtacgtgaggtcaaggaccctaacctgcgcggtattttccgctcgctgaatgaaatttacccggtgggtgcacgcaaacccaacagccgctacatgggtgaaattatccgcgtgaccaatatgcatgaagtggtcaaactgcaagaagaacgtgagttccgcttttttacgcaggacgaagtgcgcaagctggagctgccaggtaatgtagcgatcagcaagccatcgccctatacacataatatcgttggctatatgaaacgcgagcccggtgagttgcgtgtgtactctctgggcatcagcaccatacgccccgatgtgcaggccgcttacgagcaagccaaagaccagcaggccaagctacgcatagacgacctgattctgccagtggaccacctggcgacacgtgtctacagccagaatcgtgaggtagccatcctggaatacctgtcctggtccagctattttttctggggtgcatacaacatctgggaccaaaactcctccaccaacgtcactaaaagtgcgcatggttttgccgagaccaagagcccggccaaagtatttactgccaacaacacgccctatttcgtcaatcacctggaaaaactcccatctcccaccgagactttt

SEQ ID NO: 35419 - DNA, 809 bp, Glycine max
  Peptide Sequence Number=SeqID_127104
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataacaagagcatcgacacaaacatggtcgatcactgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35420 - DNA, 352 bp, Glycine max
  Peptide Sequence Number=SeqID_127105
atgggatcaagtcaaaagccttcacttaaaaagaggttctatccagtcaaggtcaagagcctagggatcactagtctaagagagttagggcaattgatgggtcagctccagcggcaagcttttcgtaaagcttacggtaaaatctgggacctagccatgctatcaccaatggtggaagaatttgaagagatcctaggatgtcctctagggggaaggaaaccatacctcttctcagggttctacccctcattggccagaatttctaaaaaaggtccaaatctcggcgcaggaattagaccgccaaaggcaagtcgaaaatggggtggtcggaataccgagaaaatatttggag

SEQ ID NO: 35421 - DNA, 348 bp, Glycine max
  Peptide Sequence Number=SeqID_127106
atgggcgcgggcgctctaggttgtacgggtgctgaattggaagagtccccggcgcaagctgagaagctcggttgctccgatcctcctagcgttggtacttgtggagtagacgtaatcgaacttccctctcttcaaatctacttcaattctttccccggcgaacaccaagtccgcgaagctggagggcatgtccctccatcactgagcgtactctttaaaggtctcacattcctttttaaccatgttctgcagctgagtgcgattaggagccatatcggaattgtactaatattgcctaaggaaggcagtaatcagatccttccaagtgcggatgcgggaagcttctag

SEQ ID NO: 35422 - DNA, 347 bp, Glycine max
  Peptide Sequence Number=SeqID_127107
gtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 35423 - DNA, 261 bp, Glycine max
  Peptide Sequence Number=SeqID_127108
atgtcaatccttaccctcggaagcaaaaaagaagagaaggaaaatttccaatcacagaaaaagagaaggaaaatttccaatcaaaggaaaaaagaaaagaaaggaaattcccaatcaaagagtgggagaaagcaaaaagaaaagaaaggaaattcccaatcaaagagtgggagaaagcaaaaagaaaagaaaggaaattcccaaccaaagagtgggagaaagcaaaaagaaaaagaaagaaaattcccaaccaaagaatag

SEQ ID NO: 35424 - DNA, 522 bp, Glycine max
  Peptide Sequence Number=SeqID_127109
atgtgggatactctccaattaacccatgaaggaaccactgatgtcaaaagggaatggcagcccaaggaacatgagatggaactacaacgctttaatcaaaatgaagaaaatgacaaaaagaagagaagtatagcccttaaagcctcatcatcaacgcaagaagaaaacgaagaagaagattcagatgatgaagaagatttttcattctttgtgaagaaatttcagaaatttatcaagaaaagaagaattgacaggcgtcagaacttcaacaatggaagaaaatcacaagaagactctcaagtccttaggtgttacaaatgcaaccaaattggtcacatcaaggccaattatccttcaaatgaagagtggcctgagaaaagcgaaaagaaaaggtttgatgaaagaagggctaagaaagcctacattgcatgggatgacaatgattcatccgatggttcagaaaaggagataaatcttctaaccaaggattatgacagtgatgagaacatctctcaagaatga

SEQ ID NO: 35425 - DNA, 396 bp, Glycine max
  Peptide Sequence Number=SeqID_127110
atgtctcttgccactctctttggaaaacttcaagaacatgaaatggaacttatgagactccatcaacatgaagagaatgatataaagagaaaaggaatagcactcagagcctcatcatcttttattcaagaagaaagtgacaaagaggacttgactgaaacagaagaagatgatgatgatttcaaactctttgtgaaaaggttcaataaatttctgagaaacaaaagaaataaaagggaatcaaacatcaatacaaagaagaaagaagaagactcctccttagccccaacatgctatgaaagcaatcaacctgggcacatgagattcgattatcttgtctttgaaagaagaagtgaagaatctgacaagaggaatctcaaagaaaagaaagcataa

SEQ ID NO: 35426 - DNA, 243 bp, Glycine max
  Peptide Sequence Number=SeqID_127111
gattgggctagagctgctaaagaaggctttggggttctaatgaacctaagggtagattttttgagcccatgggcaaagctaagctctagcttctctaggaatcttctcaaggaagcttctcaagaaagtttctcaaggaagcttctcaaggaggaagcttctcaaacaagcttctcaaggaagtttctcaagaaagcttctcaaggaagcttctcaaggaagtttctcaaggaagctacctag

SEQ ID NO: 35427 - DNA, 297 bp, Glycine max
  Peptide Sequence Number=SeqID_127112
atggtggaggagcaaaatgacaagacgaccctcactcagaacgaggattttccggtaaagggtcttccggagaaaagggatggctgcggcaagaaggaagtgtcgctagaggaagcaagcgagtttctccgcattattcagcagagcgagttcaaggtcttgaacgaagctcatgtggctcaagatatctctgtagagggctttggaggactcgtcaataatatcaccgccaacaattatcttgccttcgccgaagaagaaatccctgccgaggggagagggcataacagggcttag

SEQ ID NO: 35428 - DNA, 91 bp, Glycine max
  Peptide Sequence Number=SeqID_127113
atgcatatgacacagatgcaatttacaaatacgggagcccgagaaattgtttccttcttggatacaacgtttgggcagcgtggcacccaac

SEQ ID NO: 35429 - DNA, 60 bp, Glycine max
  Peptide Sequence Number=SeqID_127114
atggctcaggccctccacgtcggtggaaggaatgatgaagcttatagaggaaatacctga

SEQ ID NO: 35430 - DNA, 257 bp, Glycine max
  Peptide Sequence Number=SeqID_127115
ttggaacttcttacgtgccgatcaacgtctcattttcgccaaaagttggccagggcttcccggtatcaacaggggacaccaggattttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 35431 - DNA, 236 bp, Glycine max
  Peptide Sequence Number=SeqID_127116
ggctttttccggaggagccctggtgcttaccaacatggatggcgaagagctaccttcacccatgaattctgatgtcgggcaggatcatcttgagctaccttttggggtagagacaaaacatgagcagcagaaaccaatcaaggaacggatgcaagtggggatggggtcacgaccgactggtcgtcgcccctttctccacgctaagcaagcggaaaacgtcgctgcaaggcagcccc

SEQ ID NO: 35432 - DNA, 234 bp, Glycine max
  Peptide Sequence Number=SeqID_127117
atgaaggtcagattgtgctccgttctctaccgaaaccgcgagacaagtttagaagattccacttcaattgaagggtttctctcgatgtggggtttcaatggagaactacggcagttcgtggtggctattggtgatttgtgggtggtgaagaagaagcttgggatgttggggaagggttttggaagaaagaaggagaaaggaatggctgttttccaaggctacacgaaaaaataa

SEQ ID NO: 35433 - DNA, 747 bp, Glycine max
  Peptide Sequence Number=SeqID_127118
atggctaagagtcataagcgagggttagattggctctccaagttgaaagttatcgatgaggagaacttcgaagctctggaggaggatgaagaagtccaagctctaaaattagagctagggatggcaagacgcgccaaagaaaaattcaagtcagccactacaaacatccggaaagagtgtgccgagttacgagaggaaaacgcgatcactgcaagagcccttgaacaagaaaccaagagggcccgcaaggaagagcatggtcgagataaatttcgaggagctttgtggggtagcaatagtgagctcaagctccggagagaggaaagagaccattcacgggtacatggcataatcttaaaggaagaattagctgcttgctcaagatccaagaggagtttggctcaacacttggaagccacagaacgaagcatgctagccatcatagggctatacaaggaagagttaaaccagtctttgacccatgaacaaaagctagtagaggattttgcgcaagcgtacgccgagaaggaagcaagagggagggtgattgatgcattgcatcaagaagcgaccatgtggatggataggttcgccttgaccttaaatggaagtcaagacctcccgcgactactagccaaagcaaaggccatcactgaagtgtgttcagcccccgaggaaattcacgggctaatcaattgctgtcaacacatgatagatttgatggcccatataattagaaaccgttag

SEQ ID NO: 35434 - DNA, 498 bp, Glycine max
  Peptide Sequence Number=SeqID_127119
atgaccatgattacgccaagctcgaaattaaccctcactaaagggaacaaaagctggtaccgggccccccctcgagtctgcgtgtgtgtgcaacgtgctgttgtcgcatatgaacaacttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35435 - DNA, 390 bp, Glycine max
  Peptide Sequence Number=SeqID_127120
atgacactcgtctttgttgtggcaaagtcaccttcacggcctctcatggtgtcgtcctggtgtcttgtgtcaagtcacctctcacaggtatcattcgtgtgttcgttgtcgcattctgtttggctcattcatgtgtcgcatttgcctctcacagaaaatcctgacccaattgttggtggttctcatcatcttctgtgctatgggtgccgcaacctacccttcggcaggagggcgaattggggctcacgggtgcatcttccaatggaggaggcgcacggagtcgccaccaacgtttattcaaggaaaacgtcagaaaatcggatcatgtggtctacgaactttaagtgtgaaaggttcaggaattgtttttacgcacagggaaggtattag

SEQ ID NO: 35436 - DNA, 360 bp, Glycine max
  Peptide Sequence Number=SeqID_127121
atggagcagctccagttgcaagcttttcgcaaagcttacggtaaaatctgggacctagccatggtagaagtctccacagaggccatttcctccctcgcccagtattatgatcagccgttgaggtgcttcacctttggggacttcgagctatcacccatggtcgaagaatttgaagagatcctaggatgtcctctagggggaaggagaccatacctcttctcagggttctatccctcattagctagaatttccaagatagtccaaatctcggcgcaggaattagaccacaggaagcaagtcaaaaatggggtggttaggaataccgagaaaatatttggagcaaaaccaagactatcttga

SEQ ID NO: 35437 - DNA, 313 bp, Glycine max
  Peptide Sequence Number=SeqID_127122
atgactagaggcaatccatctgacttgcaaccctttgatcctgagatagataggacatttcatggattagttagacatcatttagtaccttttgagcatcctgagaattctgttattggtgattttgagcataatagttttgaacattctgagaacatggcacaacctccaccccgtgagaggactttaaaggaaatggctgcacctgatttcacctacgcaagcttgtgcatccaataccctcatgaggatgtcccatatgctcttaaaactggattgatccatttgcttccaaagtttcatggccttgcag

SEQ ID NO: 35438 - DNA, 550 bp, Glycine max
  Peptide Sequence Number=SeqID_127123
acagcctcaacaccttcctggagaaacctgtggtacttgctgagggagaatccttacccgtttactccagatactacaggaagcccactgatatcagagagattgaggcagctttgtgtatacccggccgagggtttggtttaaatgatgaaggccatcatgggaagatcctcaagaaagatctgacaactcttgctcagctggacatgaatgtaggagctctcatctctagccagatcacatctatggcccaatctaactcctctagacttgggttccctgctcttatcacagctctatgtaggtccagaggggttgcttctgatagcctagtctttgaacgcttgagcctagtcattaacttggcctatattaggaagagctattggaaccatgctgatctgacagttactattagaggggctaggagagcgagggcaaggccagctgaggctccttccacttctgcagctcctcctccagcaccgtccgctaagcgcaacactcctgggctaagcgtgaggaagaatccagaagatgagttgtacag

SEQ ID NO: 35439 - DNA, 282 bp, Glycine max
  Peptide Sequence Number=SeqID_127124
atggaggcctcagtgtcaccctacaagtccacaaccctcacattccacagcggaatacgaaccctcgaatcgcaacgtgtgctagaaatgccggagaagacggaaaggcgttcagggccattgaaggcaggacaactacaaaagtgtgcaaaaagggggcacgaatctttcaaagaatacgcccaaaaggtggagggatctggcggcccaggtggtacccccaatgatggaaagggagaggatgatcgtgatggtagacacattatcgatactctactatga

SEQ ID NO: 35440 - DNA, 503 bp, Glycine max
  Peptide Sequence Number=SeqID_127125
ctaatattcgtgattcatcagaggatgagagttctgaatcaacacaaggctctgcttcagtttcttcacctgaaaatcaaaactatatgtcctcagctaatgagcctgcaattaatagagaagggtattctgatcttggtggccaactcatacatggagccactgtaatgcaaatatgtggtagcaaagttgaacttccattgttacaaaatccacctaaatatctctaccaacttttgtatgatcatgatacatctgatagtaaaaattaccaacagaacataaggacatataacatgatgtttgcctttacttctactggtattaagttcgacaaatcaattaatcattcaagaggacctcctacaataaaaattcaaggtcaaccatgtcatagaataggtagcatgttaccaatgcctgggaaagaacctaaatttgcacaattgtatatctttgacacagaaaatgaagtgcagaataggattaatgcaataaggtaa

SEQ ID NO: 35441 - DNA, 666 bp, Glycine max
  Peptide Sequence Number=SeqID_127126
atggtgaaagttggaacctcttacgtgcccgatcaacgtctcattttcgccaaaagttggcccagggcttcccggtatcaacagggacaccaggatttatttattctgcgaagtgatcttccgtcacagtggcttctgtttctatcagctgtccctccctgttcagctactgacggggtggtgcgtaaacggcaaaagcaccgccggacatcagcgctggcaagtgtagcggtcaccgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcgagatttcctggaagatgccaggaagatacttaa

SEQ ID NO: 35442 - DNA, 454 bp, Glycine max
  Peptide Sequence Number=SeqID_127127
ctgtcctcctgtcagctactgacggggtggtgcgtaacggcaaaagcacgccggacatcagcgctgccaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgtggcactgatgagggtgtcagtgaa

SEQ ID NO: 35443 - DNA, 362 bp, Glycine max
  Peptide Sequence Number=SeqID_127128
ggcgcagaagacgacattagtctatgcgtgctatcaggcttttcgtcttacagacagcaaaaaagtttatacggataaccactcgggtatttccgcccgtcagcgtgactcaaaagtcagtatgacagatcttgtgagcgtggaagatgacggcgcagaagacgacattagtctttgcgtgctatcaggcttttcgtcttacagacaacaaaaagtttatacggataaccactcgggtatttccgcccgtcagcgtgacacaaaagtcagtatgacagatcttgtgagcgtggaagatgacgtaaatcttcgcatgtcaacgggcttgtcgaacgcgattgacgaagatcgcagaagacgaa

SEQ ID NO: 35444 - DNA, 210 bp, Glycine max
  Peptide Sequence Number=SeqID_127129
atggcaggtactaatcctaatgatggagtggggctttcgcaattccaaatgcaagctttgatgcatcatttggagaggttaatgaaacaacgagatgatgcgctccatgagagaccaaaccgaattgatggtattaaactcaacattcctccctttaaaggaaagaatgatccggaggcctacttggagtgggagatgaaaatagagtga

SEQ ID NO: 35445 - DNA, 156 bp, Glycine max
  Peptide Sequence Number=SeqID_127130
atgggtgttgaggaaaaaaacccaaagtttcaagaaccttgggagttgaggtcaaatccttttcaagggggagggaataatgcaatcctactccacaagggcattggatggaaggctccaagaagattgggccagagatgcaagaaaaggccttag

SEQ ID NO: 35446 - DNA, 513 bp, Glycine max
  Peptide Sequence Number=SeqID_127131
atcaacagttgtctccggcagaaaacacagctgccttgctttcgaagtatattcttgagctaaagaaagagggaatatacattggtaggcttaatccgatttatacttcttctccgatggagagcgtttttgtcttgcccgaaaacgatatgagcattccagaagaacatgcaaattccggaagcatgatccgcaccgaagataaaacagaagcagtaggacgtgttatcactgcgcagcaattaaaaaactatcagcagttggtgaaagagatcattgtagaagcacagctgatggagtatattgctaaaatcattgtaaatacaagagaaaatcagtttttatatttaggagcctcaccaagggcaagtttagccttacttacggcatctaaagcctttgcggctttaagggggcgggattttgtaactcctgaagatatcaaagaagccagttatgcagtgttgagacacagagtaattgtttcgccggaaagagaaatggaaggattaa

SEQ ID NO: 35447 - DNA, 852 bp, Glycine max
  Peptide Sequence Number=SeqID_127132
atggccaagtttgatccagaaatagtccttgagttttatgccaatgcttggccaacagaggagggcgtgcgtgacatgagatcctgggttaggggtcagtggatcccgttcgatgccgacgctatcagccagctcctgggatatccgatggtattggaagagggccaggaatgcgagtatggccagaggaggaatcggtctgatgggttcgatgaggaggccatcgcccagctgctatgtataccggggcaggattttgcccggactgctgccggaagacgggtgcggatcatgcgcaccaacatgaccaccctgactcagatatggatgactctgctgctcagcaacatcctgcccaccgatcataattccgacctccccatgccgaagtgccagctggtatggcgcccactaggcaccctttggacccagataagtccaacagggcctgggattcccgcactgatcacaggactctgccagtcgttcgagtcccgttgcacctaccaaggcgcgccaccaccacctcatcaggctggccaggctggggcatttgacatagagcagtatttacggcatttggttcgccagcaggcggccaaccaccgagcacatgtacggacccatgactgtctgtaccagatgagccttagcatgcagagccagggcttcgcttctttttcatgccctactccagaccagttcagggcagaggtagcatggcccggagattggcccgaggcccaagcaggagaggcgcccccggaagctcccggcgatggagaagaagcccatgaggatgaggagatggccgatttgcttgacttcttgggagggagtggagacacgtga

SEQ ID NO: 35448 - DNA, 57 bp, Glycine max
  Peptide Sequence Number=SeqID_127133
gtagtaagtactctatgggttcggggctttggcgggtctctttgatagagatcaatc

SEQ ID NO: 35449 - DNA, 918 bp, Glycine max
  Peptide Sequence Number=SeqID_127134
ttttatcaagcttatcgataccgtcgaccccacctgatgttgagaaagatgttccaacatcttccggcccaaatgctgaagtactctcttcccccagcaaagagagatcaacagaggaagatgatcaagcgacaaaggagacccctgcaccaagggcaccagaacctgctccaggggacctcattgacctggaagaagtagaatctgatgaggaacccattgccaacaggttggcacctggcgttgcagaacgattacaaagccgaaaagggaaaactccccctaagaggtctggacgaatcaagactatggcccagaagaagagcactcaatcactcctaccacatcagaaagagcaagggccaagaaatctgggagaaaggtgcctggaaaatgttcctgatgcaccattggacaacatctctttccactccattggcaatgttgaaaagtggaaatatgtgtatcaacgcagacttgcggttgaaagagaactgggaagagatgccttggattgcaaggagaccatggaactcatcaaggctgctggactactgaaaacagttaccaaattgggagactgttatgaaggcctagtcagggaattcattgtcaacattccctctgacataacaaacagaaagagtgatgagtatcaaaaagtatttgtcagaggaaagtgtgttagattctcccctgctgtgatcaacaaatatctgggcagacctactgatggagtgatagatattgctgtctctgagcatcaaattgccaaggaaatcactgccaaacaagtccagctctggccaaagaaagggaagctaactgcagggaagctaagtgtgaagtatgcaattctgcacaggattggggctgcaaactgggtacccaccaatcatacttccactgttgccacag

SEQ ID NO: 35450 - DNA, 303 bp, Glycine max
  Peptide Sequence Number=SeqID_127135
atgcacacacaaagtttcacaattccacaatttcctaagataggcctaactcacaaaaatagtccccagtggagtcgccaactgtcgcaacctacccttttgcgggccagcgaggcgaggctcacgggtgcgtcttccaaaggaggaaaatgcgcggagtcgccaccaacgtttatttgtggaaaacgtcgaaaaaaccgaaggaaaccggtcatgaagaatattccagattcgggagttgtatttatgtttgaggaaggtattggcacctctcacgtttgtcccaaaggacaacagccttaa

SEQ ID NO: 35451 - DNA, 541 bp, Glycine max
  Peptide Sequence Number=SeqID_127136
gttacaggttgttccatttgtggtaaggctcatgaaacaggccaatgtattcccattgaagaaaacactcaagaaattcattatatgggaaatcaacagcgacaagggtatactcaaggaggcttttcaggcttctaggccaatccaacaagggccttacatctttcagaggactactaagttagaggagactttgactcagtttatgcacgtaacgatgtcaaatcataaaagcactgagtcaacactgaagaaccttgaggtccaagtgggacaactggccaagcagatagctgacaagtcatccaacagttttgtggcaaatatagagaagaatcctaaggaggaatgcaaagctgtgatgacaaggagtaagaggtttgtggaggctgaggacgaggagactgttgtgcacaagaagaaagctgctgaaaagaaaggtactgatggcaagaaaaatgatgtgagaggtgaaagcaatcaggaaaaagagaaacaaataatggtcaagaaaaaagaatttaatgatcaagaaaaataa

SEQ ID NO: 35452 - DNA, 178 bp, Glycine max
  Peptide Sequence Number=SeqID_127137
atggcacatcaaatgtcccggggcttctccatgacaagcatacgttgcgttcgagtcgtatcctcggaaaaatggaggttgaggaaacctaacaagggctttttgctgcaaaatccctttttggttggtgttttggtttgtgctaaagggatggcctttgtggataactgggtggtgg

SEQ ID NO: 35453 - DNA, 567 bp, Glycine max
  Peptide Sequence Number=SeqID_127138
atgagtcatcattcatctagtgttaatggcaagggaaggcataggtcacatcttagacctcactcccatagaagagaaaaggaaagaaagcctcaaaaggctaacattaaactctcatactttcatgggaaagacaatgtagaggctaacttagattgggaaataagggtagagcaacaacttaaaaagaattctacttcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagctctagaaagtgctttaaatgtcttggaagaggacacattacttctcaatgccccaccacaaaaaccatgattatgaggggccaagaaatttatagtagccaagatgaggctactacttcaccttcctctagtgaaagtgaaaaagcaaaagcggaagaatctagtgaagaaatctaccctcaagaagaaggacaaccattagtggttaaagagaagtgtaaggag

SEQ ID NO: 35454 - DNA, 177 bp, Glycine max
  Peptide Sequence Number=SeqID_127139
gggaggtggttgccgcccagctcgcccaggcgagctcagctcgcccaggcgagctcagctcgcccaggcgagctcagctcgcccaggcgagctcagctcgcccaggcgagcagggttgcttcctccagaagcaaccgccttctggaggaatcttttggagggcccaaatgggcctgg

SEQ ID NO: 35455 - DNA, 774 bp, Glycine max
  Peptide Sequence Number=SeqID_127140
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgcggcgacgtcgggggcgagcacggcctcggcgctgaccaccttgcgcagcggctgcagccggccggcgtgctcggtcgtggcggcgcgggcgagcacggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggatatattccgcttcctcgctcactgactcgctacgctcggtcgttcgactgcgggcgagcgggaatggcttacgaacggggcggagatttcctggaagatgccaggaagatacttaacagggaa

SEQ ID NO: 35456 - DNA, 234 bp, Glycine max
  Peptide Sequence Number=SeqID_127141
agtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggcacaacctgcatttgaaagatagctttaggggaggactattcacagatactcattag

SEQ ID NO: 35457 - DNA, 495 bp, Glycine max
  Peptide Sequence Number=SeqID_127142
atgaccacgcttactcagacttggagcgttctttccttgtctaccctcatccccacgtaccacacttctgatgtcactcttgacagagccaaactcatttatggcatcatcatgaagatgaacatgaatgtggggtacctcatctcccaccagatctccctcatagcaccgcatgacacatccagactaggattccctgccttgatcacaactttatgtaaggctaggggaatccttcaaggcttgggcttgccctctattatgagcatggaggagtttgatgctcaggtggcctggccaggaaaccagccctcttcttctagagggggaggagcctctacagcccaagagcctgtgattgaggagccatcagcagcagcagcagaggaggagactactcctgaggagacccaactatctacaccagttgcggagccagagcagcctatccagaattcatcagcagctccagcattggatttgaataaagactag

SEQ ID NO: 35458 - DNA, 294 bp, Glycine max
  Peptide Sequence Number=SeqID_127143
atggatcttgaagaacggttgagaatcttcgccaaaataggggagaagcttgccgcccagctcgcccaggcgagcaaggttgcttcctccagaagcaacagccttctggaggaatcttctggagggcccaaaagttacggaaactcacggattgcgcaaaaacacctctttccgacttccgccacactacggaatttcacggatcacgcaagcctgcttccttttggatttctgagacatctcgggacttcatttattgcatgtcatcaagtaataatccccggacgaaattag

SEQ ID NO: 35459 - DNA, 131 bp, Glycine max
  Peptide Sequence Number=SeqID_127144
agtttcacaacgcgatgtgtatcttggagcctacctaaatgggccagacaactaccttaaggggattattaatagtgctatcaagggtcttgatgatgctccacagcctaaatcaaaaggctcctgcctag

SEQ ID NO: 35460 - DNA, 309 bp, Glycine max
  Peptide Sequence Number=SeqID_127145
atgggtggcggcgccgccgcgtcggaaaaagaaactcctcctttttttaaaaaactacatgttttaggccgcgtgagtgagtgggttactgtgtttgcggtgttggtggttcacggtggctgtgttggctcggccgatggcggttttcggtggctgtgttggctcggccgatggctgggctcggccgatggtggttctcggaggaggaaaggggctgagtggtggctagtggtggctcttggctgttccggcgttttgactgtccgtattcccctctctctctctctctctgacatgcacagtaattaa

SEQ ID NO: 35461 - DNA, 213 bp, Glycine max
  Peptide Sequence Number=SeqID_127146
atgtgcgagacatcggggtttagtagaccaggagacaacatagaacacaggaacattgttagatctcctataggtaatttagttcctctggacttggaaattgaagccactttaagaaggaatagagccgaaaggagaaggaaattgttgcaagacaagacagtagcttctattccagaagaagaagctcaatcttttgattctacatcatga

SEQ ID NO: 35462 - DNA, 561 bp, Glycine max
  Peptide Sequence Number=SeqID_127147
atgggtgatcaagaggagacagaggaacagatgaaagctgacatgtcggctctgaaagaacaaatggcctccatgatggaggccatgttaagtatgaggcagctcatagagaagaacgcggccaccgctgccgctgtcagttcggctgccgaagcagacccgactctctgggcaactgcgcaccatcctccctcaaacatagtaggacggggaagggacacactgaggcacgatggcagccctcacctgggatacaaccgagcggcttacccttatggattgccgcacaactactcaccacccgtcttgcaagaagatgcgggccacattgcttctcccgtccttgaaagagagcctcctcaacagcccgacgaagtccacaaagaccctcaagactatgctcgaagggatgtcgagttctatcccccgatccccggaaggccggcaccaggcacgttgcctcaacccaacatcgcggcaccaccaacagttttgtccacggaaggaccgcccctagcaactgaagaaaggagaagctcgatctccttgaggaaagattga

SEQ ID NO: 35463 - DNA, 922 bp, Glycine max
  Peptide Sequence Number=SeqID_127148
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcctttgagatgcttcacattcggggacttccaattagtaccaaccattgaagaatttgaggaaattctaggatgtcctctcgggggaagaaaaccatatctttcctccgggtgtctcccctctttgagcagaattgcaactgtggtcaaggattcagcaagagactgggtcccgtttatggatgtgttagctttgctaatttttggggtcgtccctcttccaaacgtggatggtttggtagacctagcagcaatcgacgctttccttgcctaccaccatagcaaggaaaagtccggtggtgcgaaaagagtagcgcacggatcatctgttgcttacccgccctctgtgtttgattgggaccagcttttggccgggataggaggtagaacaatcagttggttcccccgatggaaggaaggaaaagaaggagtccttttctcatgcggaagatacccaaacattccgctggtaggaacgaggggttgtattaactacaatcccacgctcgctataagacaactagggtaccccatgaggggagcaccgacggaagaaagcatgtctcctttccttgtgagggatctcggagcacaaaattccaagactatacaaagaatccataaggcatgggaaaccccgttaaggaaagatcaagagcttagaggcattcgtaatggcaccattggtgggtaccacgaatggctgaaagttcatatacgag

SEQ ID NO: 35464 - DNA, 480 bp, Glycine max
  Peptide Sequence Number=SeqID_127149
atgaagaaaagtttgttagagctatcatcacatgaccctttattggcacagaacaagttgctttctaagcaacttgacattttaacagaaacactcggtaagctgccaactgagttgttacaagttgtaccatctgtggtgaggctcatgaaacaggccaatgtattcccactgaagaaaacactcaagaaattcattatatgggaaatcaacagcggcaaggtgatgacaacaaaagatgatgacaaaggtgatgaacaaaaacctcaaagatcaaagaacaaatcaagtgaatcaaagaacatctcaagtgaatcaagaacaagtcaagagttcaagaatcaagaagaattcaagactcaagaagaaaacctagaatcaagaatcaagattcaagattcaagatctcaagaatcaagatcaagattcaagactcaagattcaagaatgaagaaaagactcaatcaagataagtattaa

SEQ ID NO: 35465 - DNA, 204 bp, Glycine max
  Peptide Sequence Number=SeqID_127150
atgtcggctcttcctatcattgtgaagcagaattcaccaagtgttggattgttccccaccaatagggaacgtgagctgggtttagaccgtcgtgagacagtaattcaacctagtacgagaggaaccgttgattcgcacaattggtcatcgcgcttggttgaaaagccaggggcgcgaagctaccgtgcgttggattatgactga

SEQ ID NO: 35466 - DNA, 303 bp, Glycine max
  Peptide Sequence Number=SeqID_127151
atgcacacacaaagtttcacaattccacaatttcctaaaataggcctaactcacaaaaacagtccccagtggagtcgccaactgtcgcaacctacccttttgcgggtgagcgaggcgaggatctcgggtgcgttttccaaaggaggaaaattcgcggagttgccaccaatgtttatttgtggaaaacgtcagaaaaaccgaaggaaaccggtcataaagaatattccagaatcgggagttgtatttacgtttgaggaaggtattagcacctctcacgtttgtcccaaaggacaacagccttaa

SEQ ID NO: 35467 - DNA, 519 bp, Glycine max
  Peptide Sequence Number=SeqID_127152
atggctaagtacgatcccgagatagtcatggagttctatgccaacgcctggcccacggaggagggtgtcagagacaagcgctcctgggtgaggggccaatggatccccttcgatgaggatgccattaactacaaccataattcagacctccccctaccgaagtgtcagctggtctacaccatcctgactcatgtgagtatccatgttgcccagctgatctcagatgctatctatcagtttgcagggatcacacctcctagacacccagtggacctggagaagtccaacagggcactgggatttcctgctttgatcacgggcctgtgccaattctatggagtgacggtcacccctgtcaaacttatccgaccccccatcaacagggccttcatagagaaatattatgtgccaaggcaggcaccacaacagggtcagacacaacagcaggaggagggccagcagcagctagctacagatgcgactgaccagcaagcggctaatcattggggtcaagtgtag

SEQ ID NO: 35468 - DNA, 138 bp, Glycine max
  Peptide Sequence Number=SeqID_127153
atgcctcctttcgatttccgtcacatcacggaatattcacagatcgctctcggccagaagatgctgacaactctgggaaaggtgctgatgatgacgtttgtgactgccttgctattgggctttgagtcttacggatag

SEQ ID NO: 35469 - DNA, 597 bp, Glycine max
  Peptide Sequence Number=SeqID_127154
atgaaaagagaaaaacatgcctcctatagtagtcataactcttgcaagagcctaagtgaagaacttcatgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaagtctacttcaaaatcttatggctctcactcttatccaaagaaagaccaagttcaaggcatcttaggcgttacaccttctaagcccaaagatgataagagggagacaatagaaaagcacgcccttaaggctaaggacacattacttctgaatgccccaccaaacaaaaccatgattatgaggggccaagacatttatagtagccaagataaggctactacttcaccttcctctagtgaaagtgaagaagcaaaaggggaagaatctagtgaagaaatctacccccaagaagaaggacaaccattagtggttaaagagaagtgtaaggaggtattattaggcaccaagtccctagattag

SEQ ID NO: 35470 - DNA, 410 bp, Glycine max
  Peptide Sequence Number=SeqID_127155
atgtcattgcttgatattgttggtgttacaccaacagaaatgacattatccactgtttttgcttacttggagggagaacgtcttaataatgttgtttgggctctacagcagtttcagggtcttttcatgaaagttgatgcactccttgggaatgtgaaggcaggaaggtgcaaaatgctggtgggtaaaaaaaatgcatggaattatgtgatgaaggcttgggggagtttggttgactgtctatgtgagagttattttgatgagtaccttaaaaaatttgaaatggcttgctttccgtggcctatgtttgtcgactatgtgtgccaaacatgggtgattccgtacaaagaaaaatttgttaaagcatggactaataaagtgatgcatctaggaaacacaactactaacag

SEQ ID NO: 35471 - DNA, 468 bp, Glycine max
  Peptide Sequence Number=SeqID_127156
atgaccaatcttacgtggatatggatgaagttgctatttagcaacattctgcccagcgaccacaatgccaatctccgcctgcagatgtatcggttgggatcacgcccacaagacgcccagtggacccaaataagtccaatagggccctggggtttccagctctggttacgggcctctatagtcctacagggtgtccgttcccctggcaagggatcgcgcctacaagacacccagtggacccgaagaagtccagcagggtcttggagttgtcaagctctaattacgggtctttgtcagttctacggagtgcctatcacctccagcaagggcatcaggccccctactaatcgagctttcatcaagaagtactgcgtccccaggcaggcacagggcgaaataccacagcagcctggggatggccggcagcgggcaacaggcgcaccgccatcacctctagagttcacttag

SEQ ID NO: 35472 - DNA, 300 bp, Glycine max
  Peptide Sequence Number=SeqID_127157
atgacatccggaagcagcaaagcaaattgctgccagattgattcgttaaaggagctgacgtcacagggttcctttgttgcccatggacgtcaggatgtactgactgctaccattgggcgaccagaacaccccggttgtgtgcgtgctgctggagtcaatgtgacgatcaagcaatactttggactgactccaaggacctcttgcacgtcttcctctatggctcccgaaggcctagagcacctgactcaacaaatcagggaccaactggaggagtcgatcacagaaaaagtgactcgatag

SEQ ID NO: 35473 - DNA, 2935 bp, Glycine max
  Peptide Sequence Number=SeqID_127158
atggcgcagttttggagcgaagacagtttcggcgcggcagatcgtaaaatggtggtcgccgcaccgctggtaagcgaactggcgacgccgcgctttcttgccagcggcgatcaatcaacactggcgctggatttgaccaaccttaccgatcaacctcaaacgttgaacgtcgcggttaacgccagcggcttgattgcactcaacggccaaatcccggccagggtgcagctggcgaaaggggcgcggaccacgctggcgatcccggttaaagcgcaggacggttttggtgagggcgacgtgcaggtgaccgtttcggggctgagcctgccgaacgagacgctggcaccgagcgtgcgccgctggaagattggcgtgcgtccggcttatccggcgcaaaccctgagtttcgataacgtaatgaacagcgggcagcgctggcaggtgatggcgagcgctttcaacggcctgcaggccagcacgctgagtggccagctgtcgctgagttctcagccgccgctgaatatcgccagctacatcagccagctttacgcttatccctatggctgtctggagcagaccgccagcggcatctggccttcacttttcaccaatcacgcccagctcagcgcgatgggcatcaaaaccagcagcgatgaggcgcgccgcgcggcaattgacaccggcattgcgcgcctggccggcatgcagcgcggtaacggcagctttggcctgtggagcaaagagagcagcgaggagttctggctcaccgcttacgtcactgacttcctgctgcgcgccagcgaagcaggctacagcgtgccggagggcgtgattaatcgcgccgaccagcgcctgctgcgttatttgcaggatccggcgcaaatcgaaaccagctggagtagcgatgccgatgcgctgcgttttagcgtgcaggcctatgcggggctggtactggcgcgtcagcagcaggcgccgctcggcgcgctgcgggcgctgtatgaccaacgcgcccaggcgaagtccggactggcgctggtgcagcttggcgtggcgctacagcagatgggcgatacgcagcgcgcgcagctggcgctgatgcagggcatcgcgctgcaacgccagcctgacatgtggctgggcgattacggcagcccgctgcgtgaccgcgcgctgacgctggcgctgctgagggaaaatcagctgctgccggcgcagcaggggccattgctgattgaactggcgcaaacgctgcacgggcagcgctggttctccactcaggagaacaatgtgctgttcctcgccgcgcggacgctgcagcagcatccgggtgaagtctggcaggccacgctgcaggaccagccgctgcgcagcgatcggccgctgagtctcgggctgagcgcccagcagttgcagcaggggctgacggtgaccagcgacacgccgtcgccgctgtacggcacgctcaatgtggtcggctatccgcgcaccgcaccgtcgccggtcagcaacgtgctgagcatcagtcgcgaatacttcacgctggacggcaaaccggccgatctcaataaccttaagagcggtgagctgctggtggtgcggctgaaggtgggcgccagacagcgcgtcagcgatgcactggtggtggatctgctgccagccggactggagctggaaaatcaaaacctgagcgacagcagcgccagcctgggcgacagtgccgatgcgctgaaagagagcatgatggacatgcagcaggccaacattaaacatcttgagttccgcgacgaccgctttgtcgccgcgctggcgctggatggctacacgcccggtcacgctgctgtatctggcgcgcgcggtgacgccgggcagttatcgtctgccgccaccgcaggtggagtcgatgtatgtgcccgcgtggcgcgccatcggcaccacgccggaaaaacttcatgtgcgttaagcgcccgtgacgctgcgccaccgacgcctgtgcgggctggcgctgctgttactgctgctggtgggcgcagtatggctgctggactggctcgatccgctgccgctgcgccagttacagccggcgcgggtggtggtagcggaagatggcacgccgctgtggcgctttgccgatcgacagggtgtgtggcgctatccggtgacgctggacgagaccgctggttctggcaccatcccggcattaacccgctggcgatagtgcgcgccgtcgggcaaaacctgctgcagcacgacattgtctccggcggcagcacgctgaccatgcaggtggcgcggctgattgatccgcagccgcgtaccctgcgtggcaaagtggtgcaggcgtggcgcgcgctgcagctggagtggcatctgtcgaagcgcgagatcctgacgctgtatctcaaccgcgccccgtttggtggcacggttgagggcgtcggcgctgccagctggatgtggctgggcaaaccggcgtcgcagcttacccgcggcgaggcggcgctgctggcggtgctgccgcaggcacccagccgtgtggccggcgcagaccgtcgccgaaatcaaacaggagccggtatggctgccgccgcgtcagctgccgcaactggcgccgctgctggcacgccggctgctgtcgctgtcgcccgacagcaaaattacctccacgctggatgtgtcgctgcagcgcgaactggagaacctcgctgcgtcgctgcaaacccggctgccgccgcgcacctcgctggcactgctggttgtcgaccacagcaccatgaaggtgcgcggctacgtcggctcggatgtgccacgccgctttggcgactatcgtcccggcaatttcgacagcggctttcacggcccggtcagcgtcagcgaagcgctgcagcgttcgctcaatctgccggcggtgcagctgctgaggcgcttggaccgaaac

SEQ ID NO: 35474 - DNA, 806 bp, Glycine max
  Peptide Sequence Number=SeqID_127159
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctattggctggttattactttgaacatgtcagaattgacagatgttacactgtgaatgaattcatgcatctgtcttgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagcc

SEQ ID NO: 35475 - DNA, 296 bp, Glycine max
  Peptide Sequence Number=SeqID_127160
cccatgggccagaaatctaccctaaggctcataagaaccctagggccttctcttgcatctctggcccaatctacttggagttttctatccaatgcccttgcgggtcatttgcctcacaagttcttcaagggaaggttgcggaggagcctcaactgtttgttatttctggggctgttgctgttattgttgttgctgctggattggtggaggaacgtatggtctgcttgggccagcagcattctgaaaataaggttgttgttgttgttgctgctgttgtgaaggattcaaccatctaa

SEQ ID NO: 35476 - DNA, 579 bp, Glycine max
  Peptide Sequence Number=SeqID_127161
atgggtgaagcagaggaggtgcaagagaagatgaaggccgaaatggaggccatgaaagagcaaatggccacaatgatggaggccatgatgagcatgaagaagataatggaagccaatgcggttatagttgctgctactagcgctgtcgctaaggcaaagatttgggaagtacggatgacccatgatgtgcaaattcaaaacaagcacgccttcccgccatatggcttgcctcccaaactatacaccaccaatgtggcgtacattcccaatgaggatgtcaataactccacacccatactcattaagagccaacaacctcaatctgatcatgcacatgtctctcgacccatggaggagacacatgaaattccccaccacgatctagccgacttcgagccttgcctcggatatgccgctgaagggcaagcagttggtggtgtacccctgcaaaacactttggagggccctcagtatcatccacaaccacaaccctcacattccacagcgattaaaaaccctcatgactatggcaagaatgggaaagttggatcatctagaggaaaggctccgggccattga

SEQ ID NO: 35477 - DNA, 414 bp, Glycine max
  Peptide Sequence Number=SeqID_127162
atgacatgttcgaccggggatgtgaaaagagcggcgcaagaattgtttgttgtgcactggctctctatgtgtggctggtttcacacccttttctccaagaaggtaggcccgtctatccgctacaaggaaggaagaatcaggattctatcttcatgcaaaggatgtccaaatgttcccttgatggaacaagggggcagagagcttaggggaagcagtaatgggagcatcggcggctatcataagtggctgagagtccggacacaaggattggattggctcccaaatctaaagactatgagagatgatgaggttaaagcttcggaagaaagtcatgaggtacaagccctgaaggcagagcttgaaagagcccgggtagtcgaagagaagttcaagtccatagccatcaaagtctga

SEQ ID NO: 35478 - DNA, 801 bp, Glycine max
  Peptide Sequence Number=SeqID_127163
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgccctttccgctgctaggctgcgcccgaggctatttaaacccaccctggctggcctgtactcagatcttcgcggagccgatcagcggccggagcgtttggcggaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35479 - DNA, 447 bp, Glycine max
  Peptide Sequence Number=SeqID_127164
atgacacgcagagacaaaatttggtcattctgcacccttgtgtcatccagaggcggcgggcccgatgacacgcggagataccttacgattatccgcacccttttgtcatccagaggcggcgggcccgatgacaagcagcggccaatgtggtcattctgtacccttgtgtcatccagaggcggcgggcccgatgacacgcggagataccttacggttatccgcacccttgtgtcatccagaggcggcgggcccgatgacacgcggagataccttacggttatccgcacccttttgtcatccagaggcggcgggcccgatgacacgcggagataccttacggttatccgcacccttttgtcatccagaggcggcgggcccgatgacacgcagagacaaaatttggtcattctgcacccttgtgtcatccagaggcggtgggcccgatga

SEQ ID NO: 35480 - DNA, 700 bp, Glycine max
  Peptide Sequence Number=SeqID_127165
gctgcgcaactgttgggaagggcgatcggtgcgggcctcttcgctattacgccagctggcgaaagggggatgtgctgcaaggcgattaagttgggtaacgccagggttttcccagaattcgatctgcggattccgacagaaccggggaatcgcatccgtgtctttccggcttccgacaattccgcttcggtgcttccgttcttctgcggatgcgatggcttgcacatccgtgcttccacacgaatgcacagatacggttcgacggttctgtgctttggcacaagagcgcatccgcgcatcgtcggtttcgtgcggaggcttcccatgaccctgccgcttgtcaccgccgatgaacgcgcccgactgctggcccacggcgcggcactcgccgctggtcagcggctcgacccgctgcccgtggtgcgcctgttcacgccggacgcgcatgtaacctggctgctggtgtcgctcgatcctgcggatggcgacacggcctacggcctgatcgaccttggtatcggcctgccttcgctggggacggtcaagctgtccgacttagccggcatcgtcggcccgcgcaagctgccggtgcgacgggatcggtatttccaggcggcgcatctgttatcggaatacgtccggctggcgcaggagaacggcatcaagcttatcgataccgtcgacctcgagggggggcccg

SEQ ID NO: 35481 - DNA, 129 bp, Glycine max
  Peptide Sequence Number=SeqID_127166
atggcgccaaaaacttgttcgcggccggcaagtgcaccggaccgcacaagtagtataaaacggtatttaaactatctagcgcaaaagaaagaaaatcacgcaagagaaatactgtgtaaaaacaagtag

SEQ ID NO: 35482 - DNA, 747 bp, Glycine max
  Peptide Sequence Number=SeqID_127167
atggctgaaagtcatatacgaggtttagattggcttgccaagttaaaagtcgtcagcgaagagagttttgaagcaccggaagaggacgaagaagtccaagctctcaaaagcgagttaggaaaggcgaaacttgccaaagagaagttcaagttggccgctacacacatccggaaggaatgtgccggattacgggaagagaatgcaaccaccgcacgagcccttgaacaagagaccaagagggctcgcaaggaagagtatggccggaacaaatttcgcggagctctgtggggtagcaacaatgaactcaagctgcgaagagaagagagggaccagtcgcgagcacatagcatggttttgagagaggagttagttgcctgttcaaggtccaaaagaagcttgtctcagcgtttatgcgagacggagaccaacatgctatctatcatcgccaagtaccaagaagagttaggtctagccacggctcacgagcataggatcgcggatgagtatgcccaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcggacacctactctgcccccgaagagattcatgggcttctcggctattgtcagcatatgatagacttaatggcccacataattagaaatcgctag

SEQ ID NO: 35483 - DNA, 111 bp, Glycine max
  Peptide Sequence Number=SeqID_127168
atgggaacaaatcaaaccggcaagaggttctaccaagtcaaggtgtcataccctaatttcgtccggggacccttgcttgatgacatgcgaccattctttggtccttgtgag

SEQ ID NO: 35484 - DNA, 319 bp, Glycine max
  Peptide Sequence Number=SeqID_127169
atgcgagcacatccagagagggaggctatcacgcatctactatgcataccggggcaagatttcacccgtgccgctgcaaaaagacgagtgcggatcatgcgcaccaacatgaccactcttacatggatatggatgacgtcgctatttagccacattctgcccagcgaccacaatgccaatctccccctacagatgtatcagctgggatcgcgcccacaagacgcccagtggacccgaagaagtccaatagggccctggggtttccagctctggtggcgggcctctgtcagtcctacagggtgcccgttcccccagcgag

SEQ ID NO: 35485 - DNA, 209 bp, Glycine max
  Peptide Sequence Number=SeqID_127170
gaaaaaaaggagtagagatgagagtcgtcatcacggaaagggcaggacggacgaaatcagtgtcttatctttgctttcctcttatctccgatgagagattcttcctccagaaggctgttgcttctagaggaagcaacattgctcccctgggcgagctgagctcgcctggacgagctgggtggcaaagctcctcccctattttgctataa

SEQ ID NO: 35486 - DNA, 147 bp, Glycine max
  Peptide Sequence Number=SeqID_127171
atgatggcaaaggttatgaacaaaaagctcaaagatcaatcaaagaacaactcaagtgaatcaaagaacatctcaagtgaatcaagaacaagtcaagagttcaagataagaatcaagaagaattcaagactcaagaagaaagtctag

SEQ ID NO: 35487 - DNA, 279 bp, Glycine max
  Peptide Sequence Number=SeqID_127172
atgccaatcaccccctgcaaaagtatcagttggtctgtgtcgtcccgacatggggatcgcacccacaagacacccagtggacccggaaaagtccaacagggccctggggtttccagctctgggatcgcgcctgcaagacacccagtgggacccaaagaagtccaacagggtcttgggagttgtcaagctctaattacgggtctctggtcagttctacgggagtacctgtcacctcaagcaagggcatcaggtccccaactaatcgagcttttcatctag

SEQ ID NO: 35488 - DNA, 459 bp, Glycine max
  Peptide Sequence Number=SeqID_127173
atggcgcctactaggcaccctttggacccaggtaagtccaacagggccctgggatttcccgcactgatcacaggactctgccagtcgttcggagtccccgttgcacctaccaaggtgattcggccgcccatcacccgggcttttattgagaagtattgtacccagagacaggctcagggtgatgctccacaggccgcaggcgcgccaccaccacctcatcaggctggccaggctggggcatttgacatggagcagtatttacggcatttggttcgccagcaggcggccaaccaccgagcacataccagttcagggcagaggttgcatggcccggagattggcccgaggcccaagcaggcagaggcgcccccagaagctcccggcgatggagaagaggcccacgaagacgaggagatggccgatttgcttgacttcttgggagggagtggagatacgtga

SEQ ID NO: 35489 - DNA, 563 bp, Glycine max
  Peptide Sequence Number=SeqID_127174
atgggggataagcttcatcgtcgagagggaaacagcccggatcaccagctaaggcccctaaatgaccgctcagtgataaaggaggtaggggtgcagagacaaccaggaggttgcctagaagcagccacccttgaaagagtgcgtaatagctcactgatcgagcgctcttgcgcgaagatgacggggctagcgatctgccgaagctgtgggatgacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgtaagaccat

SEQ ID NO: 35490 - DNA, 312 bp, Glycine max
  Peptide Sequence Number=SeqID_127175
atgtctaatacccattgtcgtggaatctgtaaagttccgggatgttttggaaagaaagcagccaaaaacacaaaagtgggggtgaacttatcaaacacgggggacattggtgaaggggaagagaacaaagaggaaaatcaagtcctcaacacttcgaagaatcaaacaaggctcattttgcttcaagattcatacaagattgtttcaacaaacaaagccttgattcaagatttcttcaagatcaagccttgcctcacaatgaaaggtttcaagtcattcaaggcacatgtaatcgattaccaatacatgtaa

SEQ ID NO: 35491 - DNA, 832 bp, Glycine max
  Peptide Sequence Number=SeqID_127176
ttggcccagggcttcccggtatcaacagggacaccaggatttatttattctgcgaagtgatcttccgtcacagtggcttctgtttctatcagctgtccctccctgttcagctactgacggggtggtgcgtaacggcaaaagccccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagctctcgcccaacataaccttacacaatgttctttatatacccactttcacattcaatcttatttcgatatcaaagcttgtatcttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35492 - DNA, 307 bp, Glycine max
  Peptide Sequence Number=SeqID_127177
atgagtcatcattcatctagtgttaatggtgagggtactagtcataaggaccctctatctagaatattagacgagttaagttccctcaatagtcatgactcctgcaagagcctaagtgaagaacttagtgactattatagaggaaggcataggtcacatcctagaccccactcccataggagagaaaaggaaagaaagcctcaagaggctaacattaacctcccatacttccatgggaaggacaatgtagaggcttatttagattgggaaatgaaggttgagcaactctttgcttggcatcatacaa

SEQ ID NO: 35493 - DNA, 168 bp, Glycine max
  Peptide Sequence Number=SeqID_127178
atggacgaagatcaatgggcatattacagtgcgatgtccgaagaagttgatatggattttcaaaatgaagaagattgtggtgtgaatgaagcacatgttgattgttcaaatgcttttaatacttctcaggtctttgaaacccgagaagatgttttgaagtgggcttga

SEQ ID NO: 35494 - DNA, 585 bp, Glycine max
  Peptide Sequence Number=SeqID_127179
atgactaggggaaatccaggtgatttacaatcctttgatcctgaaatagatagaacctttcatagattagttaggcatagtgtgcatcttgatcattttgtgcattttgagcattctgagtattctgttgctggtaattctgaatattctgattttgagcattcgactactaattttcatactgagaacatggctcaacctccacctcatgagaggactcttagggagatggctgcacttgatttcacttatgaaagcttgtgcattcaatatcctgatgagggtgttccatatgttctcaagactagactaatacatttgttgcccaagtttcatggtcttgcaggtccattttcatctgggatgaccttaagagggtgttcttggagaaattcttccttgcatctaggaccactgccatcagaaaagacatttcaggcatcaggcaacttagtggagagagcttgtaggagtactgggaaagattcaagaaattgtgtgcaagctgtcctcaccaccagatttttgagcaactccttcttcaatatttctacaagggacttagcaacatggagaggagtatga

SEQ ID NO: 35495 - DNA, 441 bp, Glycine max
  Peptide Sequence Number=SeqID_127180
atggagaaaggacaagggcggtcttgcttggcgcaaaggctgctgaacttcgattcgcccggccagcaggcgggcggcgtgcttatcttgtgtgacaacactacagagcgagtggctcttctaggcgggcagctgtgtgacaacactacagagaaagcggcgctttcgtttaacatgctatggtctcaacgcccttacgagatagtgatgagtttcacgcgctctaagcccggcccgcgcgcggttaggaagattggccgcaatctgagcggtaccacccaccctaccctaccacctataggcggccgtccgttctacagccgcccgaaaaggactgcagtgatcttgaatagggatcctacagcgatagatagaatccccataaaaataccactagatcgagcaccagtgatttcgtatcccggtcaaaatcttggctaa

SEQ ID NO: 35496 - DNA, 445 bp, Glycine max
  Peptide Sequence Number=SeqID_127181
ctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagaatacctttctttaatgaaaaagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattagatccagatacgatgccgcgggataaaaagcccccctga

SEQ ID NO: 35497 - DNA, 418 bp, Glycine max
  Peptide Sequence Number=SeqID_127182
atgacatggaagagtgtcttggaagtagaggaatctgcttacgcggatgaagaccaaggtcgactagaagtcggcattaaaggaaaagaagagcagcatatatgcatgcaatctacggaggggagcggtgttgcgaagcccaaacccttggtgatatacttcactaaaagtgcagcctcgcaaaagcccgggcaccccttaatggccaaacctgttcctttcccgtaccaaaatagtcacgcggtcccgtggagatatacacctccagggaagaaggaagaagaagtcactgacgtcagctcgctgtcagctaaagtaacaaatatcacggggctgagcggtgtgacccgtagtggtcgtgtgttcgcacctccggacctaccagtccaacccgccgacgtcaaaggaaaagaaagtg

SEQ ID NO: 35498 - DNA, 423 bp, Glycine max
  Peptide Sequence Number=SeqID_127183
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaa

SEQ ID NO: 35499 - DNA, 198 bp, Glycine max
  Peptide Sequence Number=SeqID_127184
atgaagaagattcaaggcctacaagttccacatggagctacatcagttaaggtgtctgatgaagaactagatgatgcaatcctccctaggaaaggaccagtcactagagccatgagcaagaggctccaagaggattgggctatagctgttgaagaaggccctagggttctcatgaacctcaagggctccataatgtag

SEQ ID NO: 35500 - DNA, 726 bp, Glycine max
  Peptide Sequence Number=SeqID_127185
gacaatgtagaggctaacttagattgggaaataagggtagaacaacaacttaaaaagaagtctacttcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagccaagatgaggctactacttcaccttcctctagtgaaagacaaccattagtggttaaagagaagtgtaaggaggcacttgctagcattgccacacctcttgggcttgagtttattcctcaagtaaagaagttgttggatgagggtttggttcgcaagagcttaaatccttgtgctttgttggtgcccaaaataggggttcccatgaaccctaagagaataaagatcattcctgagtggctcactccaccaacaccactcattgagttggtgagaaaccatgttccttcatgggaagatgcccaggaaatgggtgttgagggaaggagcccagagtatgaagaacctcatgatttgaggtcaaatcctttccaaggcggagggaatgatgcaatcctaccccacaagggcattggatag

SEQ ID NO: 35501 - DNA, 357 bp, Glycine max
  Peptide Sequence Number=SeqID_127186
atgcttccatttgatttccggtgtgtcacggaaacttacggattgtgcatcaatattttttggttttccggcatgtcttggaatttcacaaattgcctaatgatgggtgccaagcacctcacaaggaccaaagaaaggtcgcatgtcatcaagcaaaggtccccggacgaaattaggggggagaaagagtgtggaagcaatgtcttccaaggtcattttgatgattccaaagaatcaagagtcaagcaaaacccacagattcaagaatcaagtttcaagtttcaagattcaagaataatcaagatcaagattcaagactcaagattcaagaatcaagagaagactcaatcaagataa

SEQ ID NO: 35502 - DNA, 450 bp, Glycine max
  Peptide Sequence Number=SeqID_127187
atggcatccttcagccagatgcagtcccagcttcagtcacagatgcaatcacagggacttgcactgcctctagagcctgaggttggaccctcagctgctcatgttagcacaaatgggagttgtgttgatccctcaccgaccgatccagagatgggtgactcagacaaatgcgggctgtacatcgaagaaaatccctcccgcctggttgccctaggaagagtttatgagggattcacagttgttcacaacatcactttgttgcatggccaggtgaaggttggtgttgaggaggttaaagatgcagaggctcccgttcctatacccactgacgaggcagttgtgtctccagcaaagcctccagataggccggatcctgaggtcgatgatcccctgtatcagatgacattgaccatcccacagcttttattgaagcctctccaggttatgtag

SEQ ID NO: 35503 - DNA, 111 bp, Glycine max
  Peptide Sequence Number=SeqID_127188
atggaggttgatgaaccttggttggggtttatggctaccattgaattatcaaactttgtggttgatttagggatggcctttgtcgataattgggcggtgggtaaggagaag

SEQ ID NO: 35504 - DNA, 332 bp, Glycine max
  Peptide Sequence Number=SeqID_127189
gtgctccagtggcttctgtttctatcagctgttcctcctgttcagctactgacggggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcggcctcttcgctattacgcagctgcgaaagggggatgtgctgcaaggcgattaagttgggtaacgccagggttttcccagtcacgacgttgtaaaacgacggccagtgaattttaa

SEQ ID NO: 35505 - DNA, 719 bp, Glycine max
  Peptide Sequence Number=SeqID_127190
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttaggtgtagtggtaaaggagtatgtttctcactctaaagaccatgattcttgtccttcttcatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcgaaatggcttacgaacggggcggagattcctggaagatgccaggaagatacttaacagggaag

SEQ ID NO: 35506 - DNA, 310 bp, Glycine max
  Peptide Sequence Number=SeqID_127191
tcaaacccaattagatgtaccctctacttgtaccacaaaggatgtaccctccaatgtgttaagacaaagatctcaggcggttaaacctttgatactttgtgaatggggatacaaaagaattctcagactgtgtctttttgaattctttgacaagggagaagggagacacaaaagaattcaggcgggaggagagaatgaaaagatgaatagcacaagttttcaagctttggaaaaccagaaaacttcagaaagcttctggtacaaagaagaagaagaagttcaaagagattcaaggcttgtaaaggattga

SEQ ID NO: 35507 - DNA, 336 bp, Glycine max
  Peptide Sequence Number=SeqID_127192
aacaagagagggtacatctcttgtggatcagttctagtggagggtacatccactaggttcaaagagaacaaggaaggggtagagcaacaattaaagagaaagccatcttataaaaactctacctcttactcttatacaaagaaggaccaagctccaagtgtgttaggagtaccaccttctaagccaaaggatgataatggtaaaaacataaaggaaatcactccaaaggctagttcacaagacagaactagtaacatcaatggaagtaagggtgaagccaagggtgatgagcatattgaagaggtttacccttatgaagaaggtgatcttcaaatg

SEQ ID NO: 35508 - DNA, 351 bp, Glycine max
  Peptide Sequence Number=SeqID_127193
atggtcagcgatgttgactcagccaataaatttggggatggtgttggtgacctggatgcggtgcgttttctaagccgcttagtgcacactaccacctccatctttctctttcgcatccaaattcgagtcagggagagggtcgtcgacgtcgttgtcattgttagagaagttgcagtccagggtttcaatccaagtaaagttggggactctatttgggtcaaaggaggttgggagagttatgatatggatgaggtggaggaagggacaacgtggcggaggccttggtcggcgatgctagcgaggtcgagaaaagagcatcgtggagagaagagttgcaacattgctaagtag

SEQ ID NO: 35509 - DNA, 199 bp, Glycine max
  Peptide Sequence Number=SeqID_127194
atgggggtgcaaaataagcaaccaaggccccacttgggcccctcccaggaagatttcctcccagaaagggctgttggctttctggagggaaagcaaccttgctcgcctgggcgagctgggtggcaaagcttctcccccatttttcttataaaattggggggagaaagtgaagagaaattttcgttccagcccctccctg

SEQ ID NO: 35510 - DNA, 438 bp, Glycine max
  Peptide Sequence Number=SeqID_127195
atgaccagtcaccgctttaggagcgctgtacaccagcaacgcttcgaggccatcaagggatggtcatttctccgggagcgacacatccagctcagggatgacgagtatactgatttccaggaggagataggtcgccggcggtgggcatcactggttacccccatggccaagttcgatccagaagtagtccttgagttttatgccaatgcttggccaacagaggagggcgtgcgtgacatgaggtcctggatgctatcggccagctcctgggatatccgttggtgctggaagagggccaggagtgcgagtatggccagaggaggaaccggtctaatgggtccgatgaagaggccatcgctcagttgctatgtataccggggcaggattttggccggactgctgccggaagacgggtgcggatcatgcgcaccaatatga

SEQ ID NO: 35511 - DNA, 186 bp, Glycine max
  Peptide Sequence Number=SeqID_127196
atggaagagggatatgctgcttctagtgaggttgggcaggttcatttgcggatgaggaagatgttgctggttgaggttcttgaccctgctttcccgacctcaatatgtttacagcataagcttcaggctgttcaattgcttcagattgttgcacagaagggcaaaggtctgtgtggtggtcgatag

SEQ ID NO: 35512 - DNA, 668 bp, Glycine max
  Peptide Sequence Number=SeqID_127197
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatggattcactatggaggatatgtcgctttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 35513 - DNA, 234 bp, Glycine max
  Peptide Sequence Number=SeqID_127198
atgtgtcctcaaagaactcatttccccatcaattttattcgttacagacacagacgaggtgaaatagaaaggtcaactacaccatctcctgatgaggatttccatctcaagaagcttagccacaacgctagtgaacgtgatcgccgcaagaaggtgtgtgtgtgtgtgggtctgtggcacaacctgcatttcaaagatacctttaggggaggactattcacagatactcattag

SEQ ID NO: 35514 - DNA, 296 bp, Glycine max
  Peptide Sequence Number=SeqID_127199
aatgtttatacggataaccactcgggtatttccgcccgtcagcgtgactcaaatgtcaatatgacagatcttgtgagcgtggaagatgaccaaaagaatgtttatacggataaccactcgggtatttccgcccgtcagcgtgactcaaatgtgaatatgacagatcttgtgagcgcggaagatgacggtgcagaagacgatgttagtctctgcatgctatcaggctttctgtcttacagataccaaaagaatgttttgaaagtgcggacaaccacttgggtatctccgcatgtcac

SEQ ID NO: 35515 - DNA, 321 bp, Glycine max
  Peptide Sequence Number=SeqID_127200
gacaaagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcaaagcttgaaagagcccgggtagtcgaagagaagttcaagtccatagccatcaaagggctttatatggcagaactagtgagctcaagctccgaagaggtgaaaggaatcatcatgggtcaaaggcatgatcttgaaggacgagctaaaggcttgccctag

SEQ ID NO: 35516 - DNA, 792 bp, Glycine max
  Peptide Sequence Number=SeqID_127201
atgaaaagagaaaaacatgcctcctatagtagtcataactcttgcaagagcctaagtgaagaacttcgtgactattacgaaggaaggcataggtcacatcttagacctcactcccataggagagaaaagggaagaaagcctcaagaggctaacattaacctctcatacttccacgggaaggacaatgtagaggctaacttagattgggaaataaggatagagcaacaacttaaaaggaagtctacttcaaaatcttatggctatcactcttatccaaagaaagaccaaggtcaaggcatcttaggggtgacaccttctaagcctaaagatgataaggggaagacaatagaaaaacaaccccttaaggctaaggacacattacttctcaatgccccaccagaaaaccatgatatgaggggccaagacatttatagtagccaagatgaggctactacttcaccttcctctagtgaaagtgaaaaagcaaaaggagaagaatctagtgaagaaatctacccccaagaagaaggacaaccattagtggttaaagagaagtgtaaggaggcacttgctagcattgccacacctcttgggcttgagtttattcctccattaaagaagttgttggatgagggtttggttcgcaagagcttaaatccttgtactttgttggtgcccaaaataggtattattaggtaccaagtccctaaaataggtggtatgatgaatgttttgagtggtgcaaccctcttttgtaaaatcactcgtgcacctaacatcttcatggaataa

SEQ ID NO: 35517 - DNA, 183 bp, Glycine max
  Peptide Sequence Number=SeqID_127202
atgactaaagcacgtcaaaaggaggtacgtaaagtaaatgaaacgagaataaaagtacacgaaacaaatggggaccactacggccaaataggggaggagcttgccacccagctcgcccaggcgagccaggttgcttcctccaaaaggaaccgccttctggaggaagaatctggaaggccctag

SEQ ID NO: 35518 - DNA, 142 bp, Glycine max
  Peptide Sequence Number=SeqID_127203
gttggctgagattcgaggaggagaatcactcgtgagttctgatgtcgtcaagcaatactatacaacagatacctttgagccctacattgcggcaatgagaggcaccatgcatgagcctcaagcaaacctaggggaagattag

SEQ ID NO: 35519 - DNA, 165 bp, Glycine max
  Peptide Sequence Number=SeqID_127204
atgcagacgctaagcgcgcctatggtgtctcagaaaagaaagtctcttgcttcttcatcttctcagatcagatatgatagacacaaattttcttcccctgaagcatgggatcgttacacaaacaatatcttccgcagaaagatcatacctgaaaggaatgtgtaa

SEQ ID NO: 35520 - DNA, 632 bp, Glycine max
  Peptide Sequence Number=SeqID_127205
tgcacggattgtctattgtttacccgctctctgtgtgtggttggtttcacacctattccaacaagacacaagacacccgtgtccgcttcaaagctatcgctcatgtgccgaaaaaaggaagggtcgattgggaccaacatttggctggaataggaggcaacgcaatcaattggtttcctcgttggaaggaaggcaaggaaggagttctcttctcgtgtggggactaccctaatgttccattgatagggactaggggttgtattaattataatcccgcactcgccataagacagctagggcgcgcaaagtctcaaggtgatacaaagagtccacaaggcatggagaagtccattgaagaagacaaggagcttagaggcatccgaaatggcgtcatcggtggttatcatggatggctaagagttcacacgcgagggttagattggctctccaaattgaaagttatcaatgaggagaacttcgaagctccagaggaagatgaagaagtccaagctctcaaattagagctagggaaggcgagactcgccaaggagaagttcaaatcagccgctacacacatccggaaagagcgcaccgagttacaagaaaaacgcggccactgcaagagcccttga

SEQ ID NO: 35521 - DNA, 630 bp, Glycine max
  Peptide Sequence Number=SeqID_127206
atggtgccgctaagcgcgaaccttgaaaagcttagcgcaaatccttgcggcaatggccagctaagcggaccatgtctcgctaagtcgccaatggcttctaggaaatgcaagagtattggttcaagacctacatcacaatatgatacaaggagatttcactcctttgatgcttggaaccagtacacagataatgtcctggggagaaacattttgcctgagaggaaggtggagctctactacactgagcttgagattttaagactggaattggagaggtggcctcctgggaggattctcaggaaagatttgactactttagctcaggtgtggagtgttctctcatactccaacatggcccccacatcacatacctctgatctgatagtggacagagctaggctaatctttggcctagtctctcgcatggacatgaacataggagctcttatttctggccagatgacttctatagcccagtctaacacttctagacttgggtttcctgctctgatcaccgccctatgtagagccagaggggttgtctctaacagccttacttttgagcgcctgagcccggtcattaacttggcctacatcaggaagaactgttggaatcccgaggacctaaca

SEQ ID NO: 35522 - DNA, 486 bp, Glycine max
  Peptide Sequence Number=SeqID_127207
atgggtgatcaagaggagacacaggaacagatgaaagccgacatgtcggctctgaaagaacaaatggcctccatgatggaggccatgttaggaatgagcagctcatggagaagaacgcggccactgccgccgctgtcagttcggctgccgaagcagacccactctcttggcaactacgcaccatcctcctcaaacatagtaggacggggaagggacacactggggcacgatggcaaccctcacctgggatacaaccgagcggcttacccttatggattgccgcccaactactcaccacccgtcttgcaagacgatgcgggccatattgcttctcccgtccttgagagagagcctcctcaacagcccgacgaggtccacaaagaccctcaagactatgctcgaagggatgtcgagttctatcccccgatcctcgaagggccggcacccagcacgttgcctcaacccaacatcgcgatgcaaccaata

SEQ ID NO: 35523 - DNA, 198 bp, Glycine max
  Peptide Sequence Number=SeqID_127208
atggcaacatcattaaacaatcatacaatagagacccacatgacatttaaaaggtggttatctctctcaatggcttctagagataccattccctttgacatcaatgttgtggcggtagggactaccaacaacaacatatcatcaaagagaaaaactctagatgaggtttcactgtcatcaagcaagtcggggacttag

SEQ ID NO: 35524 - DNA, 441 bp, Glycine max
  Peptide Sequence Number=SeqID_127209
ccacactgggactgagacacggcccagactcctacgggaggcagcagtggggatttttccgcaatgggcgaaagcctgacggagcaatgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaag

SEQ ID NO: 35525 - DNA, 370 bp, Glycine max
  Peptide Sequence Number=SeqID_127210
atcgtgatggcagcgcagttgatccatgatcgcgctgtgatggaatgcctagagggtgtttgggagaccctcgaaggcaatgagaggtgccgattccgtggcacaattcaactcactgctacttcgctagtgtcatcctctatcgaattcctgcagcccgggggatccactagttctagagcggccgccaccgcgggtggagctccaattcgccctatagtgagtcgtattaaaattcactggccgtcgttttacaacgtcgtgactgggaaaaccctggcgttacccaacttaatcgccttgcagcacatccccctttcgccagctggcgtaatagcgaagaggcccgcaccgatcgcccttcccaaca

SEQ ID NO: 35526 - DNA, 612 bp, Glycine max
  Peptide Sequence Number=SeqID_127211
atggcttcctgtaagagaaaagctgcaactttagtgtctcaggccggttatgatagatcaagatttgtatcacaggaggcctgggaccattactcagataatatgcttgccaggaacattctgccagaaagaaatgtcaaaatgtatatcaatgagtttgatgatttcagaagagaattgattagaagaaactggcataaacagctgaccaacttgactgagggaagcattgatgtggcaattgtaaaggaattctatgcaaatctatatgtccctaaggacaagtctcccaagcaagttagggttcgacggcacctaataaaatttgatgttgattctctcaacacctttttggagactccagtggtcatggagcaaggggagagcttgccctcttactccaggtttgctagactgaggcctaatcctcaggagcttgcagcctggctgtgtatccctgggaggggatttgtacttaatgtcgaggatttcactcattgctcagtccaactcctcgcggcttggatttccagccctgattactgccttgtgcaaggcccgaggagtcacctcagattctcttaccttcgagtcactcagcccagccattaa

SEQ ID NO: 35527 - DNA, 714 bp, Glycine max
  Peptide Sequence Number=SeqID_127212
atggagttcttctctaatgagaattttgaatgcttccaagcatttgaaaactccaatcttattccattcatgtctctgaaattacctgtctattctgagttagttaaagctttttattccaatttagaaattcatgaagatgttctaatgtctgaaatctatgggattaagatggtcattgaccaatccctattctatgatttaacaaaattgcctagtgaaggtgtgccttttgaggctgcactgattgatgaatggaaattcgatttctctgtgcatgatgcccgccggttggtttgcaccaaccaagcggatatgaccggaagacttcttgtcggttcattggcttttgaaagccgcatcctccattaccttatagttcacattttgcttcctagatcttcaaacctttctcaggtttctgaaaaagatctcattgtcatgtgggcctttcataaagggttacagattgattggtcacatcttgttagatatcgcacggataagggattgcgattgaatgccccattggcttatcctcaccttgttaccctcttccttccacatttcaacatccctcttgattctcaaccttatgttcccatcaagagatcattccctataggcgcttcagtcatagcatcctttggttatattaaggagcatgatggatcatgggtaaagaaaggtgctagaaatattggtgaagaatga

SEQ ID NO: 35528 - DNA, 594 bp, Glycine max
  Peptide Sequence Number=SeqID_127213
atgacatatggggaactcttgccatctctcatcgccaaccaattggtcgtggtggtcccgggaaagatcttccagtgcccattcccaaagtggtcacatgggcccaagcttttggaggacgtaaagacccccagaaggtttatctacaaggccttgcaaaaggtgggcatgattccctgcggcgggcgcagagaagactcttgcctaatgcatccgggtgtactccatgacatggaaacatgttcggcagtaagagatctattacaacggatgatagaccaaggccggcttgaggtcagcagtgagagggaggaggaacaacatgtatacatgcagtcgacaaatgaagaaggacctaaaaagcctaaacccttggtaatacacttcaccaggaacacggctcccctaatacctcaacacccctcggcagtgtcgggcggtagatctattccatttccttacgagaacagccacgcagttccgtggaggtatgcccctctgggcggtaggaaggaagaagctaccgatatcagctcactatcgaccaaagtgaccaatatcaccgagctgagcggcataacccgcagcggtcac

SEQ ID NO: 35529 - DNA, 261 bp, Glycine max
  Peptide Sequence Number=SeqID_127214
atgaagaggaaaagcttgaagtctccagatcaaaagatctctttcgacctctttgaggccatgaaatactcagatatgggtgatgcctgtttcgaagaagaagaggtggagcaggaaatagcattgttagcctcaaccatggtactacagtctcctttggaaaaagaacctggctacaggagagattgcttagcttgtgatgaagagctcgatgattcaaaagacagtggtgttgaccaggtggtttttgaagaattgtaa

SEQ ID NO: 35530 - DNA, 474 bp, Glycine max
  Peptide Sequence Number=SeqID_127215
atggaaccaattgcatcccttgcccagtattatgaccagcccctaaggtgcttcacatttgaggacttccagctagtgccgactgtggaagagtttgaggaaatcctgggatgcccactgggaggaaggaagccatatcttttctttgggttctatccctccacgacaagagttgccaaggagttgtcctctttccgaaatatggaagggttagtggacctagcagtgattgacgctttcctcacctttcatcatggcaaggaaagcccggtcgtcgccattttggccatgtatgacacgttcgaccggggatgtgaaaagagcagcgcaagaattgtttgttatgcactggctctctatgtgtggctggtttcacacctttttctccaagaaggtaggcccgtctatccgctacaaggtcaccgctcgtgcgtcgaaaagaggaaaggcgaattgggaccaactcttggctag

SEQ ID NO: 35531 - DNA, 512 bp, Glycine max
  Peptide Sequence Number=SeqID_127216
atgaaggccgatctatcagccttaaaagatcaaatggcttccatctcggaggtcatgttaaaactccagaaaaccatagaggataaagccacggcaaccgcttccagtacggttagggaagcggagccggtactgcaacccactttaaatccgggccgagacagaaacacggccgtgtttggtcgaaggtatagtccgcaagcttatccttatggcttgcctccggacttcactccccgtgccgccccagaagattttagccaagcccctacttttgaggggcaactcccgccgtatgacgactatcctgggcaagacgatgaggaaggagatacccatcttggccccctgctccacctcaaagatccagcagtcgagggccttgacaattacccattctcggacttagcggatttatgtctcgtgcccaatatcgtcattcctcccaagttcaaagtaccggactttgataagtacaaagggacgacatgtccgaaggggcatcttcggat

SEQ ID NO: 35532 - DNA, 291 bp, Glycine max
  Peptide Sequence Number=SeqID_127217
atgactaggggcaatccaggtgatttacaaccctttaatcctaaaatagatagaacatttcatagattagttaggcatagtgtgcatcctggtcattctatgcattttgagcattctgagcattctgttgagggtgattctgaatattctgattttgaacattccactactaatttttatactgagaacatggctcaacctccacctcgtgagaggactcttagggagatggctgatcctgatttcacttatgcccaagtttcatggtcttgcaggagaagatcctcataa

SEQ ID NO: 35533 - DNA, 466 bp, Glycine max
  Peptide Sequence Number=SeqID_127218
atgggggataagcttcatcgtcgagagggaaacagcccggatcaccagctaaggcccctaaatgaccgctcagtgataaaggaggtagggtgcagagacaccaggagcgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacag

SEQ ID NO: 35534 - DNA, 270 bp, Glycine max
  Peptide Sequence Number=SeqID_127219
atgcatcctccaccaacgagtttgcagccccgcgaattgattgcctatcgcactgttcgcctatcctctattctccacttttattcggagcccaatgaattcattgtcattcatgcatcctccaccaacgagtctagagccccgcgaattgatttcctagcactgttcgcctatcctccattctccactttgatcttcgagccccatgaattgattttcattcatgcatcctccaccaacgagtctagagccccgcgaattgattgctag

SEQ ID NO: 35535 - DNA, 339 bp, Glycine max
  Peptide Sequence Number=SeqID_127220
atggtccatgacatctttgtcaaggtgaaactgaaagtaacaaggacatcaacagtcctaaatgtgtttggcagtagacgaagcagcgatgtttatgatcccaacatggttggctcatggtacctaatacatgaaactaagaatgcaaggaaaatgcaaggatcatgcatgagtaaacatgaaaataaaaggaacgatacgtccattacgatgccatggagagatgcttatgcgatgcatgatatgaatgcatttacggacacgagagcccggaaaatcctctcttcttacttgtgcatttgggggcgcagtgccccatatgtgcaattaagaaggtga

SEQ ID NO: 35536 - DNA, 363 bp, Glycine max
  Peptide Sequence Number=SeqID_127221
atggcagccaccagtgggttgtgggttgtgggtagccgaggatgtgatgacccgcctcgtcgctatgatatcactactctaaaccaccctagctctcccagactagcatctggctcgcctaggccatgtaatggcttcgtgcctaagcaaccagctcgcctaggcgagctcattccttcaaagctaagcattagctcgcctgggaaagtggatgaccataatttgtctctgtgtgccaacggacttgattgtctctggaaggttaggaaagcagatgaccatgatttgtctccgcgtgccaacagacttgattgtctctggaaggcaaaggagactttaatagtctcggtcgaaagacactga

SEQ ID NO: 35537 - DNA, 288 bp, Glycine max
  Peptide Sequence Number=SeqID_127222
atgatcactagtatattaggaagggaattcctaattgaattagcaaaaggtttggccaaaacttgtaaaaggaatttacaagatagtggaactctcaagcgggttgcttggggactggacgtaggcacaagggttagtacaacagattataggacccaactttgtgggatgctgatgagaatcctgaaactggccaaatacaagctaaaggcccaagtggagaaagacaaagcccccgagtggagaaggatgaaggcccagaggcagagacattatcaagactattaa

SEQ ID NO: 35538 - DNA, 627 bp, Glycine max
  Peptide Sequence Number=SeqID_127223
atggctccattgccgtcactccaaaatggtcaagtgactaaatcaaaaagaacatacactttgagggagttcccggagagatttgcaaaagataggataagtccgcatttaccaaatttcacgacaaaggttgcatgcatcaacatccctaaaaatcatggtggacccttgggtactagtaccctcgccttcggaggactacacgtcctcccctccagaggactacacgccctcgccttcagaggactacacgccctcgccttcagagggttgcacatggtcaccttcagaggactacacgtccttgccttcagagagttgcacgccctcaccttcagaggactacacgtcctcgtcttcagaggactacacgtcttcaccttcagagggttgcacgcccttgccttcagagggttgcacaccctcaccttcagaggactacacgtcctcgccatcagagggctgcacgccctcacctttagaggactacacgtcctcgccttcagaggactacacgtccttgccttcagaggactacacatcctcgcctttagagggctacgcgtccttactttcagtggactccatagccacaccttaagagaatttaagttcctctgcccttaa

SEQ ID NO: 35539 - DNA, 360 bp, Glycine max
  Peptide Sequence Number=SeqID_127224
atgtgggggtgccaagccaatttgggtttgttttggttccgaaggcgaaccattgcggctcctgaggtgcctgaactttcccaaggacccatttcaaattcagaaaattacctccgtctttgccacgttgggtgggggggtggacgtaaaaaacaaacgagtaaaaagtccaaaaacaaaataagcttcaaaaggacaacctcttcccttgtgttcaagaatcctctaaaaacaagagacccacggtctcttaatcccttttcagaaataagaagaagagaagaagagatctttcttaaaagagatagattgtacaatgaagatgaatcgaaattccttattgaatatgcaagtggttga

SEQ ID NO: 35540 - DNA, 342 bp, Glycine max
  Peptide Sequence Number=SeqID_127225
atgagtcttcattcttcatctagtgttaatggtgagggatcaactcctaaggacccctttagtcataactcttgcaagagcctatgtgaagaacttcgtgactattatgaaggaaggcataggtcacatcttagacctcactcccataggagagaaaaggaaagaaagcctcaagaggctaacattaacctcccatacttccatgggaaggacaatgtagaggctaacttagattgggaaataagggtagagcaacaacgtaaaagaaaatcaagcttatcgataccgtcgacctcgagggggggcccggtaccagcttttgttccctttagtgagggttaa

SEQ ID NO: 35541 - DNA, 307 bp, Glycine max
  Peptide Sequence Number=SeqID_127226
aggggatcaagacagaacccatgtgcgatgcatatgcgaaaggcgcaacacgggaatgtatcattctcttcgaaaaacatattgcagcagtagggactactagcaacaataagttttcaaagaaaaaagctctagatgaggtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttcaagtgaaag

SEQ ID NO: 35542 - DNA, 420 bp, Glycine max
  Peptide Sequence Number=SeqID_127227
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcacaccccgtcagtagctga

SEQ ID NO: 35543 - DNA, 333 bp, Glycine max
  Peptide Sequence Number=SeqID_127228
gggcaggatcaccttgggctaccttctggagtaaagacaaaacatgaatggcagaaaccaatcaaggtacttaaggatgaacgcaagcggggatggggtcacgaccgaccgatcgttgctcttctctgtgcgaaacaagcagggaatgtcgctgcaaggcagctccgaggaaatagggcgccggcgatgggcatcactggttactcccatggccaatggatcccgtttgatgccgacgctatcggccaactcctaggatatccgttggtgttggaagagggccaggaatgtgagtatggccagaggaggaaccggtctgatggcgttcgatga

SEQ ID NO: 35544 - DNA, 309 bp, Glycine max
  Peptide Sequence Number=SeqID_127229
atgaccaaacttggtctctgcttgtcatctgctctgaatggcaaaggggtgcggataaccgtaagaatgaccaaacttggtctctgcttgtcatctgctctggatgacaaaagggtgcggataaccgtaagaatgaccaaacttggtctctgcttgtcatctgctctggatgacaaaagggtgcggataaccgtaaggggtgtgcgtcacatgacctcagagtcagtatggcaaagattatggggcggccgacaaaagcaaagctcttgctcctacgtatcctccaatgaggaactcagacctacgtag

SEQ ID NO: 35545 - DNA, 392 bp, Glycine max
  Peptide Sequence Number=SeqID_127230
gaaaaacttttggcattttcataaaattgggtgagagtttctctctgggttccttgttgaaccaatatcagacttatcaaggtaatccttgtggcgtctatcctgacttatcttccttcacccaaagtggcgtctacccagacttatcttccttcaccggaagtggcgtctacccagacttatcttccttcatcggaagtggtgtctacccggacttatcttccttcatcagaagtggcgtctaccctgacttatcttccttcactggaagtggcgtcatccaaaacctccgtagcctgtatcaaacgatccgctcctactcaggttcacatcatttggtatcagagcttcggctcttgatacaggttctatcctattttttttctttgtaa

SEQ ID NO: 35546 - DNA, 207 bp, Glycine max
  Peptide Sequence Number=SeqID_127231
atgacgtgggacatgtcccttcccctatccttgaaggggagcttccttgacagtcggacgaggttcacgaggattgtagagagtatgcccaaggagacatcgatttctacgccccggtccccgtcgaggggccggcacccaacacactacctcagcccaacctcacgggagaacctcgaaacctcccagcatagccaatattcttga

SEQ ID NO: 35547 - DNA, 81 bp, Glycine max
  Peptide Sequence Number=SeqID_127232
atggagaaaaatgaagaaacaacaatggaagagaagcggaaggcaaaggagaagaggagaggggaggcgaccatccactag

SEQ ID NO: 35548 - DNA, 126 bp, Glycine max
  Peptide Sequence Number=SeqID_127233
atggctcaacctccaatcttgaggacttatcagatgaatacgatacttgttgggtcaaaaaccatgatagtgatactgactcctcttccgagcccgaaggatctatcactttacgtattgaaataa

SEQ ID NO: 35549 - DNA, 215 bp, Glycine max
  Peptide Sequence Number=SeqID_127234
ttacagcacaaggccaaggggatggttgcttgtcagttccagaaacgaaagccaccaggagagggcaaaatggtcattttctaaaccctagcttgccaaggctagcatttggctcgcctggccatgaaatacgcttcaaccttaagcaaccaactcgcctgggcgagcaaccactaccccaaatggctttttctataaatagtcatgcacggtaa

SEQ ID NO: 35550 - DNA, 323 bp, Glycine max
  Peptide Sequence Number=SeqID_127235
gcccacttgggccttctaggatgttcctccagaaggcggttgcttctggaggaagcaacctagctcgcctgggcgagctggaaaattcaagccgaggcgcttccgtaacgtttccgtgggtgatttcgcgaagactttcaaccgttcttcgacgttcttcgacgttcttcgttcgttcttcgtcgttcttcggtcttcaaccgggcgtcatagttcacatactaaacatcactcccaaagaagagaaaaggatagaaggcctcaagaggttaacattagcctcccacatttccacggaaaagataatgttgaggcctacttag

SEQ ID NO: 35551 - DNA, 411 bp, Glycine max
  Peptide Sequence Number=SeqID_127236
atgaagatcaagagttgcaagaacatgggtgttgaagtattggtcatcaaaatttctattcttgcgaacatagggtcgaaccaagcgtggtcttttaagaaaaggttctatcatgtcaaagtaaaaaatctggaagtagccagcttacgaaagctggggcagcagatggatcaagttcaacgtcaggcttttagcaagatatatgggaagatctgggatctagcgatgatagaagtgtcaattcaagccatcacatctctgactcaatactatgaccaatcactcagatgcttcacttttggggactttcaattagcaccaatcatagaggagttcgaagggatcttaggatgcccgataggaggaagccatacctcttttctgggtactatccttctatggcgagaatag

SEQ ID NO: 35552 - DNA, 303 bp, Glycine max
  Peptide Sequence Number=SeqID_127237
atggggcttgggttatccgaacaacaaacaccaagatatagtcacatgacgaccaacctctcagaatgtgtaaataagtggcctcttgggaatgaagtggctattcctctttctgatgagtcatggacacttatccctgatccaagtacaattcgtgcgaaagttcggccaaaatcaacaaggataaggagtgagatggattggctggaaccatctgagcaccaacaaaaatgtagtagatgtggaagagaaggacacaacatacatcaatgtccaatgcaatctgaatgtggaagttgttaa

SEQ ID NO: 35553 - DNA, 255 bp, Glycine max
  Peptide Sequence Number=SeqID_127238
atgacaagcagagaccaagtttggtcattctgcacccttgtatcatccagaggcggcgggcccgatgatacgcggaaatacccgagtggttatccgtataaacattcttttgctatctcaaccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 35554 - DNA, 231 bp, Glycine max
  Peptide Sequence Number=SeqID_127239
atggacttgagaaggttccaagttagtgtaccaggtgtaactgggggtgatactgagggccctccaaagtgttttgcaagggtataccaccaactacttacccttcagtggcatatccgagccaaggctcgaagtcggctagattgtggtggggaatttcatgtgtctcccccacggtttaagagacatgtgcatgatcagtttggggtagttggctctcaatgggtatag

SEQ ID NO: 35555 - DNA, 357 bp, Glycine max
  Peptide Sequence Number=SeqID_127240
ggcgaattggagctccacccggtggcggccgctctagaactagtggatcccccgggctgcaggaattcgatatctctttgggccttcagtttgagcctcatacacattattctgtgtccgtggctagcacgtcttgggacatggcttcatttggtcatggttattgggatgtttgggatgaacctctaaatcagcctaatcatttttcttctaagttcattgtcatcaagcttatcgataccgtcgacctcgagggggggcccgtcggggaaactgtcgtgccagctgcattaaatggatcgcccaacgcgcggggagaggcggtttgcgtattggtcgctagcggagggtatactg

SEQ ID NO: 35556 - DNA, 267 bp, Glycine max
  Peptide Sequence Number=SeqID_127241
atggcacaacctccacctcgtgagaggactctaagggaaatggttgcacctgatttcacctacgaaagcttgtgcatccaataccctgatgaggatgtcccatatgttcttaaaactggactgattcattttgcttccaaagtttcatggccttgcagagggagtggcaaaggactagctgtataccttgctccaaggaccacagccatcaggaaggatatctcaggtattagacaactcagtggagagagcctgtatgagtactag

SEQ ID NO: 35557 - DNA, 258 bp, Glycine max
  Peptide Sequence Number=SeqID_127242
atggacatagactatgctataaggaaagacgaaccacctgcaatcactaataaaagtagcccaactattgttatgctatatgagcggtgggagcgatccaaccaactcaaggtgatgttcattaagaccaaaatctcgacttggataggtggttttgtcgaccagcatgaaaaggaagaagaaaggcttgtaatggagatgggtgagagtgcattgctaacaactgcttgtgggaaaaacaaagcaactaagtcttaa

SEQ ID NO: 35558 - DNA, 113 bp, Glycine max
  Peptide Sequence Number=SeqID_127243
atgatggatacctcagagccctacactggggcaatgaaaggaatcatgcataaacctcatgcaaacctaggggcagatcagaagttctcacctaataggttccctgctacaag

SEQ ID NO: 35559 - DNA, 400 bp, Glycine max
  Peptide Sequence Number=SeqID_127244
gtttgctggatttacggatgttgtggctggccaatttgaacttggcctattggttgatgttattggtgttgtggaggaggttttcttttgccatgtttcaggaaaaggtagaagggtagtctttaaactaaaggacttgagccagcaattgctatcttgcactttgtgggacgattattgcttgcagtttttaaagttcttagatgatcatgaaggtcatggcccaattacagttctatcgacccatggtagaataaaggaagctcagggatcttatctgccatcggtcagcaattctttcaaggcttcaaagttagttattaaccaaccggtgatggagattcaagaattcaatgaagggcttgcagagttgggcattgaggcccgggtcagtttttaa

SEQ ID NO: 35560 - DNA, 696 bp, Glycine max
  Peptide Sequence Number=SeqID_127245
atgattcctggtccagcccctgttcctgagaaactggtccccaaaagacaacagggagtgaagatttctgaaaaccctagccttgcaacaagtcctagggaagtagactctgagatggataagaagatccgcagttatgttccaacatcttccaccccaaatgctgaagtcctctcttcatccagtgaagaggaatcaacagaggaagaggatcaagccacagaggagacccctgcaccaagggcaccagaaccttgctccggaaagattacaaagcagaaagggaaaacccccattactaggtctggacgaatcaaaactactgcacagaagaagagcacatcaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgcctttgattgcaaggagatcatggacctcatcaaggctgctggactgctgaaaactgtcaccaagttgggagattgctatgaaagtcta

SEQ ID NO: 35561 - DNA, 255 bp, Glycine max
  Peptide Sequence Number=SeqID_127246
atgagtattgaagcatccactcatgtttcttttgatgaatctaccgctattctatcaagaaagaatatactagatgatattgtagaatctttagaacaaattcatattcatggacaagattctaaaggaaaagggaaaggaagcaatgaagatcctcaagaagaagcaaaatcaaatgatgaacttccaaaagaatggaaagcctcaaaagatcatccctacgacagcattatcgtcctatctcaaaaggggtaa

SEQ ID NO: 35562 - DNA, 231 bp, Glycine max
  Peptide Sequence Number=SeqID_127247
atggtcattcccaagttcaaggtgccggactttggcaagtacaaggggactactcgctccaagaaccatctaaagatgatgcaactacaaaaagtgtgcaaaaagggggacggatctttcaaagaacacgcccaaaaggtggagggatctggcggcccaggtggtacccccaataatggaaagggagacgataatcgtgatggtagacacattatcggtactccactatga

SEQ ID NO: 35563 - DNA, 354 bp, Glycine max
  Peptide Sequence Number=SeqID_127248
atggaatctcaacctccacagggagtactgcttccataccatacaccaaagagaagggggttgcccctgttgaagtacgcactgaagtgcgatacccatgcaaagatacgcttcaactgcgccattcatctgaggtctgtaaggagaagaattgtgatgctcaatcttgaactcttcgcacaaatctttcatcatcttgttattcaagttcgttccattatctgtgatgattctgttgggcacaccataacggcagatgatctgattcttgataaagcggaccacaacttgcttagtcacatttgcataagatgctgcttcaacccacttggtgaagtaaccaatagccactag

SEQ ID NO: 35564 - DNA, 213 bp, Glycine max
  Peptide Sequence Number=SeqID_127249
atggtccatgacatctttgtcaaggtgaaactggaagtaacaaggacatcaacaatcctaaatatgtttggcagtagacgaagcagtgatatagttacttccatacttcaacttgacttgatgaacttttttcgaaaaagcatgagcttggttcaaccccataacccagggaatggcaattttgatcgccaatacttcaacaacatttcatag

SEQ ID NO: 35565 - DNA, 580 bp, Glycine max
  Peptide Sequence Number=SeqID_127250
atgtgtaaggaaagtccagtggtggctatcttcgcatatcactatagcaaggaaagtccagtggtggctatcttggcagatttgttcgacacctttgaccggaggtgcgagaaaaacagtgcacggattgtctgttgtttacccgctctctgtgtatggttggtttcacacctattccaacaagacacgagacacccgtgtccgcttcaaagttatcgctcatgcaccgaaaaaggaagagtcgtttggggccaacatttggctgggatagggggcagcgcgatcaattggtttcctcgttggaaggaaggcaaggaaggagttcttttctcgtatggggactaccctaatattccattgatagggactagggggtgtattaattataatcccgtactcgccataagacaactagggtatcccatgaggggagcgccaaccgaagaaagtctctcgcctttccttgtgagggatctaggcgcgcaaggtctcaaggttatacaaagaatccacaaggcgtggaggagtctattgaggaaagacaaggagcttaggggcatccgaaacggcgtcattggag

SEQ ID NO: 35566 - DNA, 306 bp, Glycine max
  Peptide Sequence Number=SeqID_127251
aaatgggtttatgatcccaacatggttggctcatggtgcctaacacatgcaactaagaaggcgacacggaccctccgtcggtttgctaaagtgaggggatcaaagacgaaacccacgcatgatgcatatgcgaaaaggcacaacacggggatgtacatagtagtcatatctctcttgatggtttctagaggtatcatcctcttcgaagaacataatgcagcagtagggactactagcaacaatatgtcttcaaagagaaaaactctagatgagggttcactgcaatcaagcaagtcggagacctag

SEQ ID NO: 35567 - DNA, 480 bp, Glycine max
  Peptide Sequence Number=SeqID_127252
gccaaatttgatattcctgaaggtttaactgcgaagaagaaggttatgtccacggttgcaacaagatggaggcaatttaagtcctccctaacctccagatatctatacactgacaaagacgatcaacaaaacattgatccatctgctaagtatggtttcgatcgagaaacatgggaagcattttcaaagacacgacagacaccaacttggaagggaatccgcaaaaaagcacaggaaattcaaaaattcaatgactgtccccacgtactatctcgtggagggtacgacgtgcttgaaaaaaaattgatggccgagaaaacaaactcaagagtgaatcaaggtgatggtactgacaatacagatgtggtcgtcgaccctccatcccctattgcaagacatgtgaagtggaagaaggctagaactaacaaatttgggcaaatgacatctgctgcagctcagaaatcgcagacaaaattgtaa

SEQ ID NO: 35568 - DNA, 327 bp, Glycine max
  Peptide Sequence Number=SeqID_127253
atgctccaaaggcttagacaagggagtatgagtgttgaagagtataggcaacaaatggagctactccttttgagagctggacttatggaggaggaaataacaagtattgctaggttctttagtggacttaatatggaaggacctagtgatgtagctccatgtggagcttgtaggccttggatcttcttcattaatggagtcctttgcttcttgaagatcatggcagcagaacagagaaggaagaaagatgattggagaagccacttcaaggagaagatgagtcaagcacaagctcaccaccataggaagccatggataagagcttga

SEQ ID NO: 35569 - DNA, 483 bp, Glycine max
  Peptide Sequence Number=SeqID_127254
gcacttgctagcattgccacacctcttaggcttgagtttattcctcaagtaaagaagttgttggatgagggtttggttcgcaagagcttaaatccttgtgctttgttggagcccaaaataggtattattatgcaccaagttcctaaaatagctggtatgatgaatgttttgagtggtgcaaccctcttttgtaaaatcactcgtacacctaacatcttcatggtgtgtgtacatagggacccattaggtagtgatcaaggggttcccatgaaccctaagagaataaaggttattgtcgcaacctacccttcggcgggagggcgatgcgagacttgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 35570 - DNA, 281 bp, Glycine max
  Peptide Sequence Number=SeqID_127255
atggatgcatttcaagcatttagaaaacttgcaaaaatcattcaaaataagaaaaatctcaagattatatctattaggagtgatcatgggggtgagttgaaaataaagaatttgaattattttgtatggattgaggaaaaagtggtacatagattttcagccaagatgctcaaaaatatgacaggagacgaatcaaaattcacacatatctctcccaagaaaagcggacatgtaacttatggtgacaacaacaaaggtagattcttggagttggaaaatag

SEQ ID NO: 35571 - DNA, 746 bp, Glycine max
  Peptide Sequence Number=SeqID_127256
atggataagaagatccgcagtattgtgagtagcattctgaaaaatgcttctgtccctgatgctgataaagatgttccaacatcttccaccccaaatgctgaagtcctctcttcatccagtaaagaggaatcaacagaggaagaggatcaagccacagaggagacccctgcaccaagggcaccagaacctgctccagaaagattacaaagcagaaagggaaaaacccccattactaggtctggacgaatcaatactactgcacagaagaagtgcacaccaatcactcctaccacatccagatggagcaaagttgcaatcccttccaagaagaggaaagaaatttcctcatctgattctgatgatgatgtcgtactagatgttcctgacatcaagagagccaagaaatcggggaaaacggtgcctggaaatgtccatgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaatactgtcaccaagttgggagattgctatgaaagtctagtcagagaattcattgtcaacattccctctgacataacaaacagaaagagtgatgagtatcagaaagtgtttgtcagaggaaaatgtattagattctcccctgctgtaatcaacaa

SEQ ID NO: 35572 - DNA, 480 bp, Glycine max
  Peptide Sequence Number=SeqID_127257
atgcagctggcacgacagcctgaagaagcaactgtcattgagatgaatgagcccgtgtccttgacatttgctttgcgatatatgaactcttttacaaaggcaacgccattgtctaacacagttaccattagtctttcaaatgagttgccagttgttgttgagtacaagattgctgagatgggttatcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcgggtgtggtggttacgcgcagcgtgaccgctacacttgccagcgctga

SEQ ID NO: 35573 - DNA, 1470 bp, Glycine max
  Peptide Sequence Number=SeqID_127258
atggcactagcaagcaccaacaccgatcaatccacaaccaccactgcttcaaagaaaccctcaaaaaaatctgagaatctgaaccctaacgtgcctcatcatcgaagcccttcttcaaagtcccctgctttgcaatcttccaagtccagtaccagcaacccaattgcgcaatccacgcagaacaatatccggcagaagaagtttgtggtggcgaagaagaagaagaatcagaagggtactcaaaacgacgccttttcgtgcaagtgcaaacacaacggtggtgccaagtgtgtttgtgtggcgtaccagactctgagggcttctcaggaagagtttttcctcaaagagaagaaggattgtgattatgattttgacgaagaagaagaaagagaagcaaaagctgagaatgctattgaaatcaatggaacaaaaagtgaaacagtggcagatgaagaaaatgaagaaatggagggtggttctactgtgaaacgaaggagagagagggataggttgttggaagaggcaaggaatagtgttcctgaaaatgggtttgggagggttatgcatttggtcaaggcttttgagaagcttctcactatacctaagagttcaaaggagaaagatcacaaggaggagcatgataatgagcatgaagagaaagagaataagagcaaggtgatgaaatgggcattgccagggttgcaatttcaacaacatactaaggcacttaaagcaagtactgaagatgcttccggttctggttcttcttctttttgttgtacttctgatttgggccaagggatttcagtttcttcgtcttgggattttagccgtgcaagtgtgtctagtaggaattctgggggtagaaggagcaggagaaatagctcggagtcatctgggacttttggtgggaggaggtggaagcagaaggagaagctaaaagttaccaggcaaaaaccattcaagttaaggactgagcataggggaaagttgaaagaggaagagttggtgaagaaagtacaagagatgatggctgaagaagagaagatgaggataccaattgcacagggtattccgtggacaacagatgaacctgagtgcttgttaaaacctacagttaaagaaagcacaaggcctattgacctaaagcttcatagtgatattcgggcaattgatcgtgctgaatttgaccaacaggtggcagaaaaaatgaacttcacagaacaactcaagttggaaaaggaaagacaacataagttagaagaagaagaagaaatcaagaggttgaggaaggaactcattcctaaagctcaaccaatgccttattttgacagaccatttgtcccaaggaggtcaatgaagcatccaaccatacctagagaacccaagttccacataccccaacataagaagatcaagtgtttggtgtcaaggaatgacatgaacccctactcctcctatctcaactaa

SEQ ID NO: 35574 - DNA, 1635 bp, Glycine max
  Peptide Sequence Number=SeqID_127259
atgcggtgttggaggagaccctccttgaagaaggaacatcgcggatctgatgatggtggggacatgggtgatgaagatggtttcagcatcacgatatcgagcaacaatgggtttattgacttgatgaagatcaaggtcgcagcttgccacatttcctatcgaaccctcttccacaccatcctcatccttgcttttttgttgccctttgtcttcatactcactgctcttgttacccttgaagattgtttaggtaggcggttgggaccaaagcttcttggtagggttgatgatccagcgcagagactagttagagatctttacaatattcttaacgaagtaaagactggggaaattccatctgctctagagctgccagattcatttgatcaactggtttctgatatgaagaacaatcaatatgatgcgaaaacgtttgcattcatgttaaggggaatgatgcagaaatttgagagagaaatcagagaatctaaattttcagagctgatgaataaacactttgcagcaagttcagtccctaaagggattcattgtctgtctttgcgattgactgatgaatattcgtcaaatgccaatgcacgcaaacaactgcctcctccagagttactacctacactgtctgacaactcttaccatcattttattgtttcaactgataacatcttggctgcttctgtagttgttacttctactgtgcagtcatctcagaaacctgagaatatagtcttccatgtcatcaccgacaaaaaaacttatgctggtatgcactcatggtttgcactaaatccagtcactcctgctatagttgaagtcagaggcattcaccaatttgactggttgacgagagaaaatgttccagtacttgaagctgtagaaaatcaaaatgggatcaggaattactaccatgggaatcattttactggaaccaatctcagtgataccaatccatataaatttgcctcaaaattgcaggcaagaagtccaaagtatatatctttgctcaaccatctccgcatttacatacctgagcttttcccaaaccttgacaaggtggtttttctggatgatgatgttgtggttcaacgtgacttgtctccactctgggaaattgatatgaatggaaaagttaatggagctgtggaaacttgcagaggggacgatcagtgggtaatgtctaagcattttaggaactacttcaatttttcccatcctcttgttgcacaacatttggatcctgatgagtgtgcttgggcttatgggatgaatgtatttgatctgcgtgcatggagaacaacaaacataagagagacatatcatacctggctgaaagagaatctaaggtcaaacctgacgatgtggaagcttggaaccctaccccctgctttgattgcattcaaaggtcatgttcacccgattggcccctcttggcacatgcttggcttgggttatcagaacaaaactgacattgagagtgtgaggaaggctgctgttattcatttcaatggccagtcaaaaccgtggttgcaaattggctttgatcatcttaggccattttggaacaagtatgtcaattatacaaatgattttgttaggaactgtcacatcttggattcatag

SEQ ID NO: 35575 - DNA, 654 bp, Glycine max
  Peptide Sequence Number=SeqID_127260
atgattctcacaaagcagtatcgatgcgtacattcagctagctgtcaatgcaccaagggtcatttaagtgaagatgtgatattcttggtgtttcagcatttgaattggaacccgaagctaattgctgctctgtcatgtgtgtgcaaatggtttgacgatctttcaaagcaagttctatggaaagaattttgtaaaacgagagctccgaagatgatgcttgatctgcaatctagtggaagccacagtgttgatgggaactggagggctctggggaagcttcttatattctgttcaggttgcaggcaaggcagtttgttcaataacgttcaggttcctggccattttgttaacaagactcgattttctagaacatcaggaaagagctttctcatgccacaatgcataaatgatgttttgtatgtgtctgatccttgtgagcatattggccaaagtgaagagggcgatttaggattcttccgaggaattttcaagtcttttgcatcctcaaatgctaatatgattccacaaactgctagttgcaggttgggttcctatgaagattatactgagtattacgtgtgccttaatggtcacttgcttggggtctgcacattgttaccattgtccgattcagaagatgtgtctgaggagtaa

SEQ ID NO: 35576 - DNA, 948 bp, Glycine max
  Peptide Sequence Number=SeqID_127261
atggagttatcttttacacaaggtcgatggaactatgatagatggggtggatttgattcaatatcaagctgcaatgcaaagcctccaggtgttgaattgtgggcagttcttgatgtcccttcttctaccacttattctgctcctgaattggcatttcaatcagctttgggctgtttaagatatggtacactaccacgtgaagctagaccatctatttacagaagcttttaccactctcagaggttgcacttgacaatgtccacagatcattcaaatgggtcaagattaggaattaatctagaacaaacagttacagttgtactccagcctaatgaacagaaagcaggtcctaaggattttagaaggaatgctggctttgaattatctgttactcccaaaagggtgcatgcagaaatggaaacgagctcctcaattctgtatgaatatccaatcaaagaatacacggagactgaacaatttgatttaggcctaacaaggaagcatccaattgtttggtctagcccacatgcacctttatatgccagtagattttcgatgggaagtgggaatgaaaggggtgctattgcaatatccttgaaatcgatccagggacttgttgcaatcaataatatgttaaagagagttgatgaaaggcctcaagcactcacagattttgttgagagaatgcgtgtttcaccttccgaagacaaagtatcacccgaggtgatggagatggttcttcaatttccttgtgaaatgaagtcagctatattgagtatagtgtttgataagggcttcttacacattgatgaataccctccagatgttaatcaaggatttgacattccatcagcaataataagctttcctgacttccatgctggtttgcaattttctgataaatctcgaagcaagtcaccactgttgtctaagttacaggttatttga

SEQ ID NO: 35577 - DNA, 192 bp, Glycine max
  Peptide Sequence Number=SeqID_127262
atggatcccaaagctgtcataactacctatgagggaaaacataatcatgatgtgcctgccactagaaacagaagccacaatattgctacttacaatttgatgcctttaaagccacataaagtagtgcttgaaaagcatcctttgcttaaagggttgttgagtgaacggtataaattaaactgtgatgcctag

SEQ ID NO: 35578 - DNA, 1557 bp, Glycine max
  Peptide Sequence Number=SeqID_127263
atggacagatcaactggccgtggtggtggtggaagtgtggacatgtttctccgaaattataagttgggaaaaacactcggcattgggtcctttggcaaggtgaaaattgctgagcatgtacggactggtcataaagttgctataaagatccttaaccgccacaagattaaaaacatggaaatggaagaaaaagaaaccccaacagacatatatgttgttatggagtatgtgaaatctggagagctctttgattacatagtagagaagggtcggctgcaagaggatgaagcccgtcatttttttcagcagtactgtcacaggaatatggtggttcatagagacctgaagcctgagaatttactcttggactcaaaatttaacatcaagattgctgattttgggttgagcaacatcatgcgtgatggtcactttcttaagacaagttgtggaagccctaattatgcggctccagaggttatctctggaaaattgtatgctggaccagaagtagatgtctggagctgtggtgtaattttatatgctcttctctgtggcactcttccttttgatgatgaaaacattcccaatctcttcaaaaaaataaagaagattcctgatttgatgggatgggtccaggttccaaaggatagactattggtcatagggacattagagaggaaatcaatatctctagacaaagagggtgggatatacactcttcctagtcatctatcacctggtgctagagatttgataccaaggatgcttgtggtggatcccatgaagaggatgaccatacctgagatacgccaacacccatggttccaagttcatctaccgcgttatttagcagtgccaccaccagatacactgcaacaagccaaaaagattgatgaggagattcttcaggaagtggttaatatgggatttgacaggaatcaattggttgaatctcttagcaacaggatacaaaatgagggtactgtaacatactatttgttattggacaaccggtttcgtgtttctagtggttatcttggagctgaatttcaagagacaatggattctggttttaaccgtatgcattccggcgaagttgcttctccagttgttggacaccacagcacagggtatatggattatcaaggggtaggaatgcggcaacagttccctgttgagagaaaatgggcccttgggcttcagtctcgagcccaaccacgtgaaataatgactgaggtccttaaagctctacaagaattaaatgtttgttggaagaagattggacactataacatgaagtgcagatgggttgctggcactgctggtcatcatgaaggaatgattaacaattctctgcatagtaatcattactttggaaatgattccggcattattgaaaatgaagctgtttctaagtcaaatgtggtcaagtttgaagtgcagctttacaaaactcgtgaggagaaatatctgcttgatcttcaaagggtccagggcccacagtttcttttcttggatctgtgcgctgctttcctttcacagctacgtgttctctag

SEQ ID NO: 35579 - DNA, 597 bp, Glycine max
  Peptide Sequence Number=SeqID_127264
atggaagaaaaatggcttgaaacatattgtccagagcttcggaaaaggattttccttgcactggctgcttgttttcctttacttccttgttcctctgcttccttgcacgacactcatgctgagcgtgcatgtccaattggatcaagtgcccgtgcgctaagcgcacttgctcgtgacagttgtcttcaaatgtatctccttgcgctaagtggcttgcttgggctgagtggtcctaactcactgagtaaagaggaactagatgaaacaagtggcaccattagatgtaggaaggggtgctttttttgcacgtaccctacatgggaagcgccagttgaactggcgacttcatgcatgtgcgacaagtggcaagctctggacgaaagcgcagacatggttggcgatttcacgttgcaagtcgccattcccgttagcgctttgactgcagcagggtcaggcagcagcagcagcagcagtgcagggctagccataggtgcagggaaacgccattgccattggcgtttcctgcctcctgaaggcgctgcttccattggcgcgtcgttcttcttctataaaatccgtttggccttcaaattgtag

SEQ ID NO: 35580 - DNA, 951 bp, Glycine max
  Peptide Sequence Number=SeqID_127265
atggcagctcttgtaataactgtgtcacaagatggaaccggacagtacaggacggtgcaggaagccatagatgctgtgccactcggcaacactcgccggacggtgattagggtgtccccgggaacctaccggcagcccctctacgtggcaaagactaagaacttcatcaccctcgttggtctgcgccccgaggacactgttctcacttggaacaacactgccacctcaatccaccaccaccaggatgctagggtgatagggactggaacctttggttgtggcaccatcattgtggaagggggggactttattgctgagaatattaccttcgagaattcttcccctcagggtgcagggcaagcagtagcagttagagtaacagtagatcgttgtgctttctataattgcaggttccttggatggcaggacacactatatttacattatggaatacaatatttgaaagattgttatattgaaggaagtgtggacttcatatttggcaatagtactgcactcttggaacattgtcacatccattgcaagtccgcagggttcataactgctcaaagcagaaactctccacaggaaaaaactggttatgtattcctcagatgtgttgtcacaggtaatgggggaacttcatatgcatatcttggaagaccatggagacctttcgcaagagtggtctttgcattcacttacatggatcaatgtataaagcctgctggctggaataattgggggaaaattgagaatgaaaaaactgcttgcttctatgaatacaggtgttttggacctggttggtgtccatcccaacgagtaaaatgggctagagaattacaagctgaagcagcagagcagtttctcatgcatagcttcattgacccagaatcagagagaccttggcttgctcaaagaatggctctgaagattccatattctgcttaa

SEQ ID NO: 35581 - DNA, 552 bp, Glycine max
  Peptide Sequence Number=SeqID_127266
atgttcctcaagtatgttgaagaagggggagaaaaagattttgtgttctttaagaagcttgatagtgagtttaacaaggtcaatgccttctacagaaagaagggttcaagagttcagctaccaccaacgattcatttgctagcacaacttcagcttcatataaatgatgccaggcctcgtcgctcaagtttactgatggatttgattcatgaaattgagatgagcagtgaaagtcatttgaaagatggaagtggtactgtgatcaatgtggtcacacttgaaactccagtatcaacattaagaggcttgctcttggcttcaaatcatgatcacttgtctttcagcaagaaagagctgtggaagcttcttgaacttgatggcattctcaaaaatcatgaggaagtcactgcaagaaatgcatcaaaggagtacttaaaggtggttggtatttcatactttggcaacacagatgaggttaatagactcatggataaggtggaatcagccttcattaagcactttggaaatggaaatcgcagaaaaggaatgtaa

SEQ ID NO: 35582 - DNA, 1017 bp, Glycine max
  Peptide Sequence Number=SeqID_127267
atgttggataagagagttgcaattctattttatgccacatggacatgtgtgctatttaggaaaggtggtatgatgtctatgactattaagtctaagactgaggattctgtgaaatgtgacattgttgatggaggagagctcaagtcaaggagacttttgaatgttagagaaaaaagtgcaacattgtcttcaatcactaagaaggattgggatgatatcacatttgaagtggataacaaagtttacttctatgttgcttcctttgttaaggatgctgaatttgttcatgaactaaagaattatttgaagagttgtggtgttgatatacatgtcatcgtaaaaattgaaagtgcaaactctataccaaatttgcatacaattatcactgcatctggtggcactatggttgtcagaggagatcttagcgttgagctccctattgaagaggttccacttttgcaggaagagataatcaacttgtgtcgtaacataggaaaggctattattgtggcaacaaatatgctaggcagcatgattgttcacccaactccaaccagaacaaaggtatcaaatataacaactgttgttcgagaaggttctgatggaataatgttgtcaggagaaacaactcatggaaagttcctactaaaagttgtgcaagtaatgcacacagtagcattgcagacaaaagcaactatactaggtggtaaaattccacctaacattggtcaagtgttgaagaactacatgagtgagatgtttgcctaccacgcaaccatgatgtctatcacccttggaacctcaattattgtcttcattggaacggtgaggggtttgaacttggtgctcatttggcagcttgaccataactatcatcttgaggacaaagtgtttttcgatggcataggggatgttaggaagggaataatggctcgacaagatactacaagaataggcacgaatgagaggcccaaaaggaagatcaatccaccaaggcatctaaaagatttcatttaa

SEQ ID NO: 35583 - DNA, 192 bp, Glycine max
  Peptide Sequence Number=SeqID_127268
atgaaggatatacaagatgaagaagaagaagatgaactaggaagaagaagaagaaccagaggaagcagcaacgaccgtgagaagaaccacgtgaagggtattttagtcctttcacctaagttgctgggtgtcccagtaaaaatgttaggtgtccaaagcaaccgccgagaaataattgatcaaagactctga

SEQ ID NO: 35584 - DNA, 309 bp, Glycine max
  Peptide Sequence Number=SeqID_127269
atgctacaatgcgaagggttttcctctaaggtcagatatgattttgaaattcccaacggtgggtttgttcggagtgtaggctctgctccatggccatcacggttaagcaccctcaacaaggaaccggaaatggttcttgcgactctgcctgcaaggaaatataaggctttgggaccgaccgcatgcaccattgaaggatggaaatggattgttagactttggtatatgacaagtgaaactttcctcccttcccttgtcaaggacctgcctgtatctgaatttgataaggtcttcaatcttgtcttttaa

SEQ ID NO: 35585 - DNA, 732 bp, Glycine max
  Peptide Sequence Number=SeqID_127270
atggtgtgtggaacggggttggggatacccgatgggtacggggatgggacaataaactcaaacccgtcgggtatcgggtacgggtatgaggatatattgaggagtcggggagaactcacaactgtgagaggccaaccacaactgaaacctaaaggtgacccacttgtgggagcaaaggcaaagttgacggcgtgtcaaatttcaaaggccaccaaagcttgtgtgcaacaagaccacacccacagcctcatcatggaagccactctcccttccaattggaagaaccttaacattgaaaagtacgatggcactactgacccagacaaacaccttgattacaagagagagtcacttcgaacgttcaaggaacattttggaaaaattgcattgaatatccgaaacttggattcgacagtttccatgcaccacctcataatgacactcgggctaggtccttttgtgaacagtctatgcaaaaagtctacgtctaacatggatgagctgcttaggagagcatccaagtacatgcaaatggaggaattggctaagtacaagaaccaggcacgaactgaggctacctcaaccaaaaagaaagccgacaagccaaacatcgatcctggatcaagctctggccaacaagatcctcgttatgccaaaaagggaaaacaccccaccctaggccgacttttcccaacatcgttgataccattgcaaacgaggaaactgcactga

SEQ ID NO: 35586 - DNA, 132 bp, Glycine max
  Peptide Sequence Number=SeqID_127271
atggcggatggttgtgatccctttgtgaggccaactgaagaacaaacagtgaggttaaagattcaccatggtaggatgttcatttatcagtcatttattgtgtatatcaatggtcagatcgttgaagaataa

SEQ ID NO: 35587 - DNA, 2112 bp, Glycine max
  Peptide Sequence Number=SeqID_127272
atgcttgttctgaaactgccacgtgtcacccctgcattttctatgtatctgccacatccttgttccctcaaagaagttgttaacctcttgaaattctctgccactgcaaagagcttgagatttggcaaaaccatccatgcccagttggttgttcgcaaccaaacttcaaaggacagtgacatcactcaaataaattcactgatcaatctatattccaaatgtggtcaatcgaaatgtgccagaaagctgtttgacagaatgcttcagagaaacgtagtttcttggagtgccttgatgatggggtatttgcacaagggtgaggtgttggaagtacttgggctgttcaggaacctggtttcattggacagtgcataccccaatgagtatatatttactattgttctttcttgttgtgcagacagtgggagagtcaaagaggggaagcagtgtcatgggtatttgttgaagtccgggttgttgttgcatcaatatgtgaagaatgctcttattcacatgtactcaaggtgctttcatgtggattcagcaatgcagattttggatactgtgcccggggatgatgtattttcttataattccatcttgagtgcacttgtggaatctgggtgtcgaggagaagctgcacaagttttgaagaggatggtggatgaatgtgtaatctgggatagtgttacatatgtcagtgttttaggcctttgtgctcagattagagatttgcaattgggtttgcagatccatgcccagttgttgaaaactggtttggtatttgatgtctttgttagtagcacactgatagacacgtatgggaaatgtggtgaagttctaaatgcaagaaaacaattcgatggcttgcgagatcggaatgtggttgcatggactgccgtcttgactgcttatttgcaaaatggacactttgaggaaactttgaatctatttacgaagatggagcttgaggatacacgtccaaatgagttcacttttgcagttctgctaaatgcttgtgcgagtttggtggcactggcatatggtgatttattacatggtcgtatagtgatgtcaggatttaagaatcatctcattgttggaaatgctttgataaatatgtattccaaaagtggcaatattgattcttcatacaatgtgttctcaaacatgatgaatagagatgtgattacttggaatgctatgatatgtggctattcccatcatggacttggtaaacaagctttactagtgttccaagacatgatgtctgctggagaatgtccaaactatgtaaccttcattggggtactttctgcttgtgttcatttagctcttgtacaagaaggattctactattttgatcagataatgaagaaatttgacgttgagcctggactggagcactacacatgtatggttgcacttttgggtagggctggtttacttgatgaggctgaaaactttatgaagacaacaacacaggtcaaatgggatgttgttgcgtggcgtactttgcttaacgcgtgccacattcatcgaaattacaatttagggaaacaaattacagaaactgtgatacagatggaccctcatgatgtgggaacatatacattgctatcaaacatgcatgccaaggcaaggaagtgggatggagtggtgaagattagaaaactgatgaaggaaaggaacattaagaaggaacctggtgcgagttggctagatataagaaacaatacgcatgtctttgtttcagaaggaagcaatcatccagagtctactcaaatttttgagaaagttcaacagttgttggcaatgattaagccactagggtatgcgcctgatgttggtgttgtgctgcatgatgtggaagatgaacaaaaagaaggttatcttagccatcatagtgagaagctagccttagcatatggcctcatgaaaatacctccaccggggccaatccgcataattaaaaaccttaggatgtgtgatgattgccacattgctgtaaaattgatttcaaaggccacaaataggttgataattgtaagagatgctaaccgttttcatcattttagagaaggattgtgtacgtgcaatgaccactggtag

SEQ ID NO: 35588 - DNA, 1419 bp, Glycine max
  Peptide Sequence Number=SeqID_127273
atgttggaggcaaaagactcaacgatgatgaagctcttcgggaatacgatcccggcaccggagatccccgccggagctccggcattttcttctggtgatgtttttggtgacagtgttggtcagaaccgtggttcttcaagtgtcaatggggatggtgaagaacacgagattcagcaggacataatgggagaggaaacaactgagagtaagaaggaagatgaagtgaccaatcttgatactgtctcaagatcaggggaagggtctattaacccctctaccgagaaggaggatcttacattgaaaacttcaaaaaagactgagcaagaacaaggtgaaaattcacaaaataaaacactgagaaagccggacaaaatactgccttgcccccgctgcaatagcatggacaccaagttctgctactacaataattacaatgtcaaccaaccccgtcatttctgcaagaattgccagagatactggactgctggtggagtgatgaggaatgttcctgtgggtgctggtcgcagaaagaacaagaattttgcttcgcagtatcgtcatataactgttcctgaagcagcactctcgagttcccagccggacttgtcaaatggagtcagtaatccttccttgaactgtaatgccacactccttgcatatgggtctgatagacccttgtgtgaatcaatgacatctgttttgaaccttgctgataaagcagtgaacaattccacaacaaatggatttaatggctctgaagaactagaaattcctgttacttatgttggtggagagaaagtgaatgatgattccaataaatcttctgacacgtcaacgaagccaatgaaaggtgaaaccaccaataggtcccaagaacaagtcatagagaattgtcatcccttcccacctcatgttccctactttcctggtgccccttggcctttcccttggaatccagcaccgtggaactccccggtaccattaccacctccttttttcccacaaggatttaccatgcctctctatcctgcagcagcttattggagtcttactataccgggtgcacggagcatcccatggctagcgcaaccatcattactgaatagtacagtgtctaactctggtcctaactcactaaccttgggcaaacattcaagggaagaaaacatgcataaatcaaatggggtagcagttgaggatgaacatagcaaggaaaataataaagaaaagtgtctatgggttccgaaaacattgaggattgatgacctaggagaagcagcaaaaacctctatatggacaacactaggtattaaaaataataaagcagacttatttcctgggggaggactcttcaaatcactcccatcacagggtgcagtagatgagccaactgacatggcagtatttcactgtacttga

SEQ ID NO: 35589 - DNA, 1683 bp, Glycine max
  Peptide Sequence Number=SeqID_127274
atggtgtcatgcatgcttcaatctcacctatcaatagagttggctcgaatgataaattcacagcaacatggccactctgagcaaagacagtctcgtgaacaaaggcagtctcgtgatgtctggctttggtatgtgcatattctgaaacagctaaatatgtgttgttcatcatcatggaagtcctccaccacatgtgaggcggaagctgatgctgttttggaagctttatcatggattggccagctcaacatgcaacatgttactatagagcttgattgtaaaattgttgtgcgtgggaggaaatccaaatacaacatgggcattccaactgtgctagctttaccttatccagcacaaggtcatgtcaatcccctgatgactctctcacagaagttggttgagcatggatgcaaagtcttttttgtgaacacagactttgaccacaagcgagtggtgagttccatggtggagcaactagatagccttgacgaatcactactgaagttggtctcaatccctgatggtttaggacctgatgatgatagaaacgatttgagcaagttatgtgattctttgctgaacaacatgcctgctatgcttgagaagctcatagaggatattcacttaaaaggtgacaatagaatcagccttattgttgcggatgtgtgcatgggatgggcgttggatgttgggagtaaattgggaatcaaaggagccctgttgtgcccttcatcagcagctttttttgccctgctgtacaacgtccctaggcttattgatgatgggatcatagattctgatggtggattaagaataactactaaaaggacaattcagatatcacaaggtatgcctgagatggacccgggagagcttttttggttgaatatgggtgacaccataaatggtaagatagtactcaattatctgatgcagtgtacacagagattgaatatgacagaatggtggctttgcaacaccacatatgaacttgaacatgcgccattatcatctattcctaagcttgtaccaattggtcctttgttgagaagttatgatgatacaattgcaactgcaaaaacaatcggacaatattgggaagaagatctatcctgcatgagttggcttgatcaacaacctcatggttctgtcttgtatgttgcctttggtagtttcactcattttgaccaaaaccaattcaatgaactagctcttggacttgacctcaccaatagaccttttctttgggttgtgcgtcaagacaacaagagggtataccctaatgaattcttggggtgtaaaggtaagattgtgagttgggctcctcaacaaaaggtgctaagccaccctgctatagcatgttttgtcacccattgtggttggaattctaccatagaaggtgtgtccaatgggttgcctctcttgtgttggccatattttggagaccaaatatgtaacaaaacgtacatttgtgatgagttgaaggttgggttgggttttgactcggataaaaatggactcgtgtcacgaatggagttagaaaggaaagtggaccaaatccttaatgatgagaacataaaatcaaggtctctggaattgaaggataaagtcatgaacaacatagccaaagcaggtcgttcgttagagaaccttaataggtttgtcaagtggcttaaagaataa

SEQ ID NO: 35590 - DNA, 807 bp, Glycine max
  Peptide Sequence Number=SeqID_127275
atggccttcttgaattatgagagcaagagaggaagtggtaagaaactaaaagtgcattttgatcttcctgaggatgatgattatcccaatcacaagcattcaagttcttcagtttcatctgaatgctcattagattcagatgatactgacaatgacaatagcatagacaatgttgattccaagtatggttcctatggctctcctgtgtggagctttcaaggaggatcagtaacccaatctcccccagttcagtttttgagttctcctgagtatgatccaaacagaatcccctcttctatatttaataaacctacaagtcctatggaatggagtgtagcctcaaatgaatcagtattcagcatacacttaggaaacaacagtttctcgagggattatgcttttccattcaacaacaaatctggggaattgcctaggactagtgatttgcccagcatgcctgcaacactgccacctgttcaagaggtgcctgctaaagacaaaaatgtggacatggaaagacactctgtgtcatcggattcatcaagtgaaaccgcggattcggttagggggcatgaccataagaaaacatcacatgaaactgctggttcagttggggaggttgttgacctcgtgaaaatagaaaattcagaagacattggcactaatgaagtagtgttggacaaaactccagatgatcattccaatgaagcaaagatccctaatggggaagccaataactatacaagtgtcttataccgttcggtggaaagcgatatgagcacacattcgtttcaatttcctatatga

SEQ ID NO: 35591 - DNA, 141 bp, Glycine max
  Peptide Sequence Number=SeqID_127276
aaaaacgatgatctcggcctcaattaccgttggatcgtcgtgaaatttgagtaccaggttcgaaactcattttcgaacattctcactgttgggaattatgaaaacatgtcggagcagagagaaataccctttgcatcgtag

SEQ ID NO: 35592 - DNA, 240 bp, Glycine max
  Peptide Sequence Number=SeqID_127277
atgcatgagcttgaagagagcaaatttgcagctcttcaaaatatgcgagaaaaccaaggtcttgataaagggaatatgactgaaattgatggctatcaaaacttgtttggtttgatgaagcagaggtttctgagtttcaagaacccaaaatatataaaagagttggagcattttcaagcccttgctgaagctcaatttccaaaggtgataacagatttacctagtccatttggcatttaa

SEQ ID NO: 35593 - DNA, 129 bp, Glycine max
  Peptide Sequence Number=SeqID_127278
atgtggcaagaatatggagatcagtggggtcctaatccgagaagaagaaagattgcaaaagaaaaagaaggcgccaacttccagaagtcaggtggtcaatcccgacttctcaaaacacttgaaaactaa

SEQ ID NO: 35594 - DNA, 1146 bp, Glycine max
  Peptide Sequence Number=SeqID_127279
atggagattaagtatcagcaaccattaatcttggggatggagattaagtatcttcctaataggtctattttgatatctcaaagcaagtttgtcagagatttacttcataaaactcaaatggctgagacacactctatctctactcctatggttacaaactgcaaattgtccatccaactctctatagtatctatagatgaggaagagataatccatttaccagcaagacattctcttcctacttcagaatcattgcctgaacatgaaatggagaacacttctcttgatcttttggataggttgatttgctgcttgtcagattcattatatgaagcaaaaactaaccttaacagaacattggtgaagattttggcatcagagaagaaccacaaatgtaaatataacattccgaggacccttgtagcttggaatttgctgcagtttgataacgctggccatgacaagtgcactgatataaatgctgggctccttggttcctttgtttttaattaccagattcccttgggcacttcatcttcttgttttgtgaaaaatgaagctgtgaatttatatgctcatcaggtactagatgcatggttctcatgcatcaagcttttggaagatgaagatgactcagttagattgaggctttccttcgatgttcagaagtgttttacaacagagaaaactagaagcaatcttactcctggatcggttccaatccaatgggtattacgagttgaaagcagtgtagcaccccaaggagatcttgtaggacgggtatttgacaaggagattgacaatcattatgaagagaagctgttgatcagccaaatttgttgctccaatatggaaaagctacttattttgaagtcctgggctgacaaagatgaattcaggagctatttacatggatggagagctagattttcccatcaattggtgtcatatgatgaagaccatcttgggaaacaagaaggaaatgattggataggaggcatggttgttcttggaagagccatcaatccttttaagttagtcctacaatcacatgagaaaatggctggtgatgttgctaacggctcgttccctgagatgggaaatttctctagctgggatagttttaattcgtattttctcggctag

SEQ ID NO: 35595 - DNA, 699 bp, Glycine max
  Peptide Sequence Number=SeqID_127280
atgcctaacctctttaatattctgatgacactttcagagtttaaagtcaaaatcaaaccgcttgtgacggctaaaaaccgtcactttctggtttgctcatcattcttctcccaccatcgtaaatctccacccaatggctctcaaactacagctaccgagaaaaccatcaccactaccaacagtaacatcaaaaccacaaacatatggttcagtaagattatgtgcgtcatggatctgggtttatgggtattggtcgtggagtttggctatggttttggtgctctttctctttctcccctaccgcgcgtgaatttggccggggttcggtgctatgatgttttggtggtgtggtgtgttggagatatgggtttcggtgatggcgtttggggtttcggaagagatggtgttgggcaagtcgatctccgtgatgagccgacgacggtgagggcgaagacgatgacgtcaaccatggcatcaaagggaccaaagtgcgttggtgtcactgcgaagttgttcttcagtggtgtttttgtttgggagagtgcagtcgcgactatgacaatgcatgtgagtttgactagaggtgaaagaaggggatttagggtttggagcactaatgctttcaagataagcatatttggccatggacagattgtcggagaaccaaaacagatatgtagtttttcttataatttttaa

SEQ ID NO: 35596 - DNA, 594 bp, Glycine max
  Peptide Sequence Number=SeqID_127281
atgaaggaaggaatttgctcaatccaacactttttcaacacttggaaagcaatacccttccaagccaggaccaatgtgaggcggtcagttttggtaaggataggagaaaaggagagacaaccatgcaaatcgccactgccattggcgatacaaccctgggtgcaacacgtggcttttcgccactgccactggcgaaatagccagtggtttcgccactggagttggcgacatagccatgcagtggttttcgccactttgactagcgaattacgtgcaggcgctttgggttttgccattcccactggcgaaacagcctatgctatgttggttttcctatttaacacgtccttggtgatctgcatgatgaaaaaatttcctccttccttccttgcttgttttgccaaaagttatagcgaaatcgttgaggctgctggaaccctcttccttcaagtggtgagagagagagagagaaagtgttggtgttgttatgcgtgtggtggtggcggaaaagcttgtgcaagtggcaaatcgcttgtagtgttacattgtggtggtcattctagtccagtgatttggttatcaaattctggttaa

SEQ ID NO: 35597 - DNA, 588 bp, Glycine max
  Peptide Sequence Number=SeqID_127282
atgcctactgtatctgcccgtaggcagcgacaacaggaacatcctgagctgaagctatcttcccatggaaggaagatgactaagttcaataaaggcgatcgaggacttatgcctgcttttgtggaaccttggcataaggagactagtagtttcaatttgcccgtaagagaggtgactattaccttggatgacatggcttccttgctatattttcctatttgttggatctacgagcatttcccatctgttggtttcgtcctagctgtcgaggattatgacgagcagagaccgcatgcatgccgatggacctctggcgaggcattacccgtgtcgacatatcataggcgtctggacagactgacccctgatgttgtccatctcagatggggtcccttgacggtcattcaccgactggagagggttatactacagtttgggtacatccagaccattctgccacatcctgttgcgccttcggcttctattgaagaaatagatgctagatggatgcaattatgtgactatattgcacctgtagagaaaatttttgtagtgtctgaccagtgttcttcagattacatggagtag

SEQ ID NO: 35598 - DNA, 309 bp, Glycine max
  Peptide Sequence Number=SeqID_127283
atgaggaagcgccaagtagttgtgagaagagaggagcctcaaaggagcgctaggacggtgaaatacggcgagtgccagaagaatcacgccgcgaatgtgggagggtatgctgttgatggctgcagggagttcatggcgagtggcgccaccggagaaggaacaagtgctgctctcacttgtgccgcctgtggttgccacaggaacttccacaagagacaggaaaccgaagtgctacacaatgtagcagttgtgatcagtttgaaatttgatgaggaaaattggtattggttttggttttgccttaattaa

SEQ ID NO: 35599 - DNA, 2580 bp, Glycine max
  Peptide Sequence Number=SeqID_127284
atggctgaagcttctgagcctaaagcattgcctgaggcagagaagaagaaggagcagactctgcccttttacaagctcttctcatttgcagacaagtgtgattggatgctcatgatctctggcagcataggagccattgttcatggctcatccatgccagttttcttccttctctttggtgaaatggttaatggctttggcaaaaaccaaatggacttgaagaaaatgacagaagaagtatcaaagtatgctctctatttcgtgtaccttggtcttgtcgtttgcatatcatcctatgcagaaattgcatgttggatgtacactggggagaggcaagtgagtacactgagaaagaagtacttggaggcagtgcttaaacaagacgttggtttctttgacacggatgcaagaacaggagatatagtttttagtgtctccacagatacacttctagttcaagatgctataagcgagaaggtggggaacttcatccactatctatcaacgtttctggcgggtctagtggttggctttgtttcagcatggaggcttgcacttctgagtgttgcagtgattcctgggattgcttttgctggtggattgtatgcttacacactcactggcctcacatcaaagagtcgtgaatcttatgcaaatgcgggcatcatcgccgagcaggccattgctcaagttagaactgtttactcttatgttggtgagagcaaggcattgaattcttattctgatgcgatacaaaacacattgaagcttggatacaaggcagggatggccaaaggattaggtctaggatgcacatatggaatagcttgcatgtcttgggcactagttttctggtatgctggagttttcatcaggaatggacaaacagatggtggcaaggcattcaccgctattttctcggccattgttggtggcatgagtttgggacagtcattttcaaacttaggcgctttcagcaaaggcaaagcagctggatacaaattgatggaaatcatcaatcagaaacccaccatagtggaagatccatcggaaggaaagtgcttagccgaggttaatggcaacattgaatttaaggatgtcactttcagctacccttcgaggccggacatgtttatctttcgcaatttctcaatctttttccctgctggtaaaactgttgccgttgttggtggtagtggatctggaaagagcacagttgtttccttgatagaaaggttctatgatccaaatgaaggtcaggttctgctggataatgtggacattaagacactgcaactaaaatggttgcgcgatcaaattgggttggtgaatcaagaacctgcactctttgcaactactattcttgagaatatactctatggaaaacctgatgcaacaatggctgaagtggaagctgctacttctgctgcaaatgctcatagctttattaccttgcttcctaatggctataacactcaggtaggagagcgaggagttcaattatctgggggccaaaagcagagaattgctattgccagagctatgttgaagaatccaaagattcttctgctagatgaagcaactagtgctcttgatgcaggatctgaaagcattgttcaagaggcactagataggctcatggttggaagaacaaccgtggtagttgcgcatcgtctatcaaccataaggaatgttgataccattgcagttatacaacaaggacaagttgttgagacaggtacacatgaagaactcattgccaaggcaggcacctatgcctcactcattcggttccaagaaatggttggaaatagagacttctccaacccatcaactcgccggactcggtcatcacgcctgagccattcgctgtcaacaaagtccttgagcctccggtccggaagcttgaggaacttgagctaccagtacagcaccggagctgatggccgcattgagatgatatcaaatgctgaaacagacaagaaaaatcctgccccagatggatatttcttcaggttgctgaagatgaatgctcctgagtggccttactcaatcatgggagctgtgggttctgtcctttctggattcattggccctacttttgccattgttatgagcaacatgattgaggtcttttacttcagaaattatgcatccatggagaggaagactaaggagtatgtcttcatctacattggtgctggtctctatgcagttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccacagatgcagctgatgtcaagtctgccattgctgagagaatatcagtgattctacagaacatgacatctctccttacttctttcatagttgctttcatagtggaatggagggtttccttgctcatcttggcaaccttccctctccttgttctagccaattttgctcagattccatacctgaccatcaacttcgatgtcacacactga

SEQ ID NO: 35600 - DNA, 1368 bp, Glycine max
  Peptide Sequence Number=SeqID_127285
atgagcattccaactgtgctagctttaccatatccagctcaagggcatgtcaatcccttgatgaccctctcagaaaagttggttgagcatggttgcaaagtcatttttgtgaacacggacttcgaccacaagcgagtggtaggttccatgggcgagcaacaagatagccttgacgaatcacttctaaagttggtttctatccccgatggtttaggacctgatgatgaccgaaacgatgcgggcaagttatgtgatgctatgcaaaacaccatgccaactatgcttgagaagctcatagaggatgttcatttgaatggtgacaacagaatcagcttaattgttgcagatttctgcatgggatgggctttggatgttgggagtaaactgggaatcaaaggagccctgttgtgggcttcaccagcagctttatttggccttctatacaacatccccaagcttatcgatgatgggatcatagattctgatggtggactaacactaaccacgaaaaagacaattcacatatcacaaggtatacctgagatggacccacgagactttttttggttgaatatgggcgacacaataaacggtaaaatagtaattaaatatttgattcagtgtacacgaagtttgaatctgactgaatggtggctttgcaacaccacaaatgaacttgaacctgggccattatcctctattcctaagcttgtgccaattggtccattgttgagaagttatggtgacacaattgcaactgcaaaatcaatcggacaatactgggaagaagatctctcttgtatgagttggctcgaccaacaacctcatggttctgtcttgtatgttgcctttggtagtttcactcattttgatcaaaaccaattcaatgaactagctcttggaattgacctcaccaatagaccttttctttgggttgtgcgtcaagacaataaaagggtataccctaatgaattcttgggaagtaaaggtaagattgttggttgggctcctcaacagaaggtgctaaaccaccctaccatagcttgttttcttacccattgtggttggaattctaccatggaaggtttgtctaatggggttcctttattgtgctggccatattttggagaccaactttataacaaagcatatatttgtgatgagttgaaggtcgggctgggagttgacaaagataaaaatggactcgtgtcacgcatggagttaaaaagaaaagtagaccaactctttaatgatgagaacataaattcaaggtctctggaattgaaggacaaagttatgaaaaacataaccaatggaggtcgatcattagagaatcttaataggcttgtcaactggcttaaagaataa

SEQ ID NO: 35601 - DNA, 639 bp, Glycine max
  Peptide Sequence Number=SeqID_127286
atgaatggcatatcttttttggaagtgatcaagtcaagaaagtttaagaaactactggcctctggaatacagtccacacaaacatgcaaggagcacaatcagcaaagaatgcatggtccaaggcccgagagtcagcaacagcttcaacactcaaacatgatcacaacatcacctcacgaggggtcaaaccagtgcataatgcatttgaagtcaattttgatgcagcaatttttcaatacagaggtatatatggagctgggaagagatcacaatggagcttttgttcgcgcgaagacggtagcaacaagtggaagtccgaacccgagggaggcgaaagcatgggctcttctccaagcattaaaatggatacctcaactagatctcaccgaaattgtcattgaattcgaatctgactacaaaactgttgtggatgtcctacacactcgtttcaagggagcttcagagttttttattctatacatgaaaactgttaaccaactctctttttatccgagcattggatgggcagttaagatttcagagaaaaagagaattagaagggcagccttctgtcctgcatcagcagcacagttggtattgggatctagcatcccaaagatgattgatactgcatcatag

SEQ ID NO: 35602 - DNA, 528 bp, Glycine max
  Peptide Sequence Number=SeqID_127287
atgaatatgaacgaagagagtggtgaaggaagcgcgaggagggtccaagtgcgcttcgtgacgaagttaggcgagccgtacaaagttccgaccactgccatcgccatccccgccgacctcgctcgattaggcctctcctcactcgtcaacgcactccttcaatccaacgacgctgaccatcagccggagccgtttgattttttaatcgatggcgagttcgtccggatgtcgctcgagcagtttcttttggccaagggaatctctgcgcatcaatgtgtgtatatcagtgaagcaaataaatgctatgcttgttatggtgatagtgtcaaatgggatgatgcagtggaatggggggtgcttgtgaaggaagttgcggctgtagaaaggatattggaaattgagtacgcaagggctgtggctccgcggaaggaggaggacccttctctacatgatgattgggtcagtgctgttgatggttcttcttctcgcagtagccaaagaacacaacctaaccctctttgtgaatag

SEQ ID NO: 35603 - DNA, 204 bp, Glycine max
  Peptide Sequence Number=SeqID_127288
atgccacattcagatgaatttatcaccactcattcctatttacattcgcggcaaatttctccatttggggttcttttaaaaagtatttctccagatgaggctaggttgcaggaacttttttcagagaaaggggagttgcaactgccattggcgagttggctgcaagttgcaactcccattggcgatttagggcacaaaaaatag

SEQ ID NO: 35604 - DNA, 120 bp, Glycine max
  Peptide Sequence Number=SeqID_127289
atgactaccatgcaacctccaaccagaaccctacgacaagaccttgtcaccggagtttttccaagaactgcccctactcctccaaacaccaacaatgccaagcttttctataagcactaa

SEQ ID NO: 35605 - DNA, 460 bp, Glycine max
  Peptide Sequence Number=SeqID_127290
ggtacaactacttgggtttgactgagaacaagagagagtacatatcttgtggattagttctagtggaaggtacatccactaggttcaaagagaacaagggagggtacatcccttgtggatctttgcttgtaaaaggatttttacaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35606 - DNA, 197 bp, Glycine max
  Peptide Sequence Number=SeqID_127291
gtcgactctagaggatcccctccgagacgtttccgtgggcgatttcgtgaaggttttccaccattcttcatcgttcttcgttcgttcttcgtcgttcttcggtcttcaactgacgtttccatgagcgatttcgtgaagattcttcaccgttcttcatcgtttttcgttcgttcttcgtcgttcttggtcttcaaccg

SEQ ID NO: 35607 - DNA, 693 bp, Glycine max
  Peptide Sequence Number=SeqID_127292
attcaacaaggaattgggccaggttgcattaagggcccaatttcgactcaaggagggtgtaataaagaagacatccacccagttgagcttttggggattgaggaaaagcatcctcaacttcaagatggcatccaggctctagcagatcaacttgccaatcaggataaggtcaaaaatcagagttacgtggactcagaaaggaggttaaaaagcataattgagtgcagtgataaggtgttgcaagaggctcaacaattatggcatctcggagaaaacttaggcatggagacagttacagataacctacatttccttcacagttatgcttctatggagtgtagagacagaaaagaagctaaggagaatttggttgggaagcataagatagatcttctttgtttgcaagaaacaaagagggattccgttgacaaggcactttgtcaggctctgtggggtcactcagactttgattggaaatggtttcctgcggtcaatacagctggggggcttctctgtgtcaggaataacaataacttccaggttgatattaaaatagctgaaaggggtttcatcatgttggagggggtatggctggtagaaagtcagagggggacttcaactgcattatacacccagctgaaagaatgggaagcactctttgtaatgcagacactaatctttaaactgaattag

SEQ ID NO: 35608 - DNA, 213 bp, Glycine max
  Peptide Sequence Number=SeqID_127293
atgtcacaggctgagccgattaatgtaaacattggaaatcctatagaagaaatgatttgcgatcttgggcaagaggggtttgaacaggcacatgcacccttagatgagtttgccgaaatgcattgttaccctatttgcggggtatcacggtacagagtgaacgacggggaatacagtgttgatgcaaccgcaaacaaccgacgtctagcaaag

SEQ ID NO: 35609 - DNA, 174 bp, Glycine max
  Peptide Sequence Number=SeqID_127294
atgggtgccaagcacctcacaaggaccaaagaaaggtcgcatgtcatcaagcaaagatccccggacgaaattaggggtcagtatgacaaagattatggggcggccgacaaaagcaaggctcttgctcctacgtatcctccaatgaggaactcagacctacgtagttctagataa

SEQ ID NO: 35610 - DNA, 174 bp, Glycine max
  Peptide Sequence Number=SeqID_127295
atggctggccccctagcgaaggtgttgtggtatctaccgatcgttccaaggtttaagcgtctttttgctaatgcagacgttgctaaagaccttacatggcatgcaaatgggagcaactacgatggaatgcaaaaatacacgatgttgtctatgatgatatcgggcccaagatag

SEQ ID NO: 35611 - DNA, 282 bp, Glycine max
  Peptide Sequence Number=SeqID_127296
atggcggcgaccaggctttccttgccatgccgaaaggcgaggaaagcgtcaatcaccgctaggtccactaacccttccatattcggaatgaggacaactccaaagatcaaaagcgccaagatgtcaataaaagaaagcccattggggggtgatttgccagggccttgcttttacctccaaatattttctcggtattccgaccaccccatttttcgacttgcctttggcggtctaattcctgcgccgagatttggactttttttagaaattctggaccaatga

SEQ ID NO: 35612 - DNA, 351 bp, Glycine max
  Peptide Sequence Number=SeqID_127297
atgagtcttcattcttcatctagtgttaatggtgagggttctactcctaaggaccccttgtataagatattagatgagttgagatcccttaagttgtggaaagaaaaacaagagagaaaagaaaaaggaaaaaaaagagtggaagaaataagtcaagatgaagaagaaatagagaggaagaaagaagaaaatatgaaagaaatgaaaagagaaaacatgcctcctatagacaatgtagaggctaacttagtttgggaaataagggtagagcaacaaattaaaaataagtctatgtcaaaatcttatggctctcactcttatccaatgaaataccaaggtcaaggcatttag

SEQ ID NO: 35613 - DNA, 264 bp, Glycine max
  Peptide Sequence Number=SeqID_127298
atggtttctagaggtatcatccccttcgaaaaacatattgcggtagtagggactaccaacaacaatatgttatcaaagagaaaaactctagatgagggttcactgttatcaagcaagtcggagacccaacatgaccacaaattcacctctactccttatgttcccatggacctggctatagggccccttttcaactcatcgtgtgtgcaaaaaggttacaacgtgaacgatcagttggattttattttaatagtgattaaatga

SEQ ID NO: 35614 - DNA, 540 bp, Glycine max
  Peptide Sequence Number=SeqID_127299
atgtggtatgatgaaagaatttcaaaagatagaaataaaacaagtccaaaattcaccttatgttgtggagatgggaaagttgagcttccgttattacaaagtccaccgaaatatcttgaacgacttctgtttgatggtaaagcaagtgatagtaaaaattatcagtgtaacatacagacatacaacatgatgtttgcctttacgtatgctggtattaagctagacaaatcaattaatgaaagtagaggacctcctacaattagaattcagggtcaaccatgccatcgaatagacagcttattaccaatgcctggaaagcaaccaaaattttcacaatttcaacatgttggaattcaaccagagattgtttcaactttaagtcaaatgctggatgagtacaatgtccatgcaaaaagttttagaatggccagggacagattgacagatactcaagtcgataatactcaagaagggatattatttttgaaacccaaaatggagaattacaaagaatccatgaattacactctagctatctag

SEQ ID NO: 35615 - DNA, 885 bp, Glycine max
  Peptide Sequence Number=SeqID_127300
atgatagaagtctccatagaggccatttcctccctcgcccagtattatgatcaaccgttgagaagctttacatttggggacttccagctgtcacccatggtggaagaatttgaagagatcctaggatgtcctctagggggaaggagaccatacctcttctcagggttttatccctcattagctagaacttcaaagatagtccaaatctcggcgcaggaattagaccatggaaagcaagtcagaaatggggtggttggaataccgagaaaatgtttggaggcaaaagcaagatccttggcaggtagaggcgaatgggccccgttcatagacattctcgcactattgatcttcggaggagtcctctttccaaatgtggatgggttggtggatctagcagtgatcgacgcttttctcgcctatcatgaccacaaggaaagcccggttgtcgctatgctagccgacctatatgacaccttcgaccggagatgtgagaagagcagtacgaggattgtttgctgtactccagctctttatgtatggttggtttcacacctttttcgccaagaggtgagacatgcttgcccgctagaaagccatcgttcatgcacagagaaaggaggggcaaattgggaccaactcttagcaaacaaagaaggagtgtctatcaactggttccctcgatggaaagaaggaagaaccagggttcttatttcatgcagaggatttccgaatgttcccttgatggggacaaggggttgcatcagttacaatcctattcttgctataaggcaacttggctaccctatgagaggggcaccgctagaggaagagctcgcgcctgttatttcacgaggtttcaataagaccaacggggagacactttag

SEQ ID NO: 35616 - DNA, 528 bp, Glycine max
  Peptide Sequence Number=SeqID_127301
atgccaatctccccttgcagatgtatcgggatcgcgcccacaagacgcccagtgggcccgaagaagtccaacagggccctggggtttccagctctggttaccggcttttgtcagtcctacagggtgcccgttcccccagcaaggaatcgcacccacaaagacacccagtggacccggagaagtccaacagggccctggggtttccagctctggttacgggcctctgtagtcttacagggtgcccgttccccccggcaaggtcacgtcatcatagggatcatgcctgcaagacacccagtggacccgaagaagtccaataggctctacggagtacctgtcacctccagcaagggcatcaggccccctactaatcgagctttcatcaagaagtactgtgcccccaggcaggcacagggcgaaacaccacagcagcctggggatggccagcagcgggcaacagacgcaccaccatcacttctagagttcacctcagctcatccacaaaaaggtaagagggggatcctctag

SEQ ID NO: 35617 - DNA, 213 bp, Glycine max
  Peptide Sequence Number=SeqID_127302
atggcttcttatggtggtgagcttcttcttgactcatcttctccttcaagtggtgtctccaatcatctttcttccttctccattctgctgccattaaacatcaagaagcaaaggaatccattgatgaagaagatcctaaggcctacaagctccacaatggagctacatcatggatcaaatgatgcaatccttgtaccccctaagggattgtaa

SEQ ID NO: 35618 - DNA, 306 bp, Glycine max
  Peptide Sequence Number=SeqID_127303
ggtatgttcgttatacctttcatgactcgtttaggaataaccaattcgtggggcggttggaatatcacaggagggactataacgaatccgggtatttggagttacgaaggattgtatggtcctgggaatatgggtgtccgatccttatggactaactgggaaggatacaatccccttttgtcgttgctggaactatgtggtatggttcagcaacaacccctattgaattattcggtcctactcgttatcaatgggatcagggatactttcagcaagaaatatatcgaagagttggtgctggactag

SEQ ID NO: 35619 - DNA, 471 bp, Glycine max
  Peptide Sequence Number=SeqID_127304
atggcaaggaaagcccggtcgtcgccattttggccatgtatgacacgttcgaccggggatgtgaaaagagcagcgcaagaattgtttgttgtgcactggctctctatgtgtggctggtttcacacctttttctccaagaaggtaggcccgtctatccgctacaaggaaggaagaatcaggattctatcttcatgcgaaggatgtcccatgagaggagtgccatcagacgaaagcatcacgcctttcatcgcacggggtttcagtgaccacaacgcgaggttactccaaggagttcgcaaggcatgggatgcggctgatgaggtacaagccctaaaggcaaagcttgaaagagcccgggtagtcaaagagaagttcaaggcagcaataatgagctcaaactccgaagaggtgaaaggaatcatcacgggtcaaaggcatgatctggaaggacgagctaaaggcttgccttag

SEQ ID NO: 35620 - DNA, 216 bp, Glycine max
  Peptide Sequence Number=SeqID_127305
atgtattgtcggaagatgggggcatacgcaaaagatgaggaactgctgatacatttcttccaagaaagtcttactggggtagctgttacctgtacaactctgatatggctccggataggatgcaactacagagcatatgcaagagggggcatggatctttcaaagaatacgcccaaagggggagggatctggcagcccaagtggttccctcgatga

SEQ ID NO: 35621 - DNA, 270 bp, Glycine max
  Peptide Sequence Number=SeqID_127306
atgaacggtgatgaaacacacccatgtttgttaagcaatcagcaatttaagcactctcttaatcggtttggcttcaaagttcctgcatgggaatatcatgccgcaaatgaatgggaacgtgcctatatgagtaactcggaagggtttaccatactcaaagaacaggtctactcccactgccctgacatcgaaccacgctccgaccgatttcctggaattcctcgcctatgcaaacgatggtgggatcggtccttcatcaagaatgcgtaa

SEQ ID NO: 35622 - DNA, 273 bp, Glycine max
  Peptide Sequence Number=SeqID_127307
atggaagaatcaaaagaattcccagactatgtcgttttgatttctttgacaagggagaagggagacacaaaagaattcaggcggttagtccttcgttgttttggaaaaagggagaagagagacacaaaaagaattcaggcggagaagagaataaaagatatagcacacttctattttcaaggtttggaaaaccagaaaactttagaaagacttttgcaaaggaaaaagaagaagaagaagaagaagatgttcgaagagattcaaaggtcgtaa

SEQ ID NO: 35623 - DNA, 579 bp, Glycine max
  Peptide Sequence Number=SeqID_127308
gcatgcttgctcgctagaaagccaccgttcaagcacagagaaaggaggggcaaattgggaccaactcttagcaagcaaagaaggagcatctgtcaactggttccctcgatggaaggaaggaagaaccagagttcttatttcaagcggaggatttccaaatgttcccttgatggggatgagcggttgcatcagctacaatctcgttcttgttataagacaacttggctaccctatgagaggggaaccactagaggaagagatcgtgcctgtcatttcacgaggtttcaataagaccaacgtggagacacttcagaaggtccgcaaggcatggggaggtggtgcaaaagaaggacaaagaactcaggggcaggaggaagttgaggcaccggaggaagacgaagaggtgcaggcccttagggtagaactcgagcaagcccaagcagtcaaagaaaggttcaaattagcagctcttaaaatccgaaaggagaatgccgaactaagagatataaatatagctaccaccaaggccttggaacaagagaccaagagggctcgtagggaagagcacagccggaacaa

SEQ ID NO: 35624 - DNA, 173 bp, Glycine max
  Peptide Sequence Number=SeqID_127309
atgaggagatttttggttgatagagcaagtattgagaatgtgaatgttgtacaacaagaagccgaattagaaccgccacctaatgtggttaatgagtttaacccaaatgagattgtgcgtgatccagtcataggaaacaaattaatgagtatgctccggatattcaagatcaa

SEQ ID NO: 35625 - DNA, 234 bp, Glycine max
  Peptide Sequence Number=SeqID_127310
atgcccttttgcgagcgtgcgaggcgagggtcacgggtgcgctttccaaaggaggaaagatgcgtggagtcgccaccaatgtttatttgtggaaaacgtcagaaaaaccgaaggaaactggtcaaaatgaaaattctaagttcgggagttgtatttacatttgaggaaggtcgacaaaagcggggcttttgctcctacgtaccctcctttggagaggaaatcagacctacgtag

SEQ ID NO: 35626 - DNA, 381 bp, Glycine max
  Peptide Sequence Number=SeqID_127311
agggtacatgccctcgccttcagagggctacacgccctcgccttcagagggctacatgccctcgccttcaaaggactactgtcctcgccttttagggactacacgtcctcaccttcagagggctactacaccctcgccttgagggctagcacgcccttacctcagaggacacacgtcctcgtcttcagagggctgcacaccctcaccttcagaaggactacatgccctcgccttcagaggagtacacgtcctcaccttcagagggctacacgccctccccttcaaaggaccacacatcctccccttcagaggactacacgtcctcgccatcagagggctacacgtcctcaccctcagagggctacacgcccttacctttag

SEQ ID NO: 35627 - DNA, 387 bp, Glycine max
  Peptide Sequence Number=SeqID_127312
atggtgaaagttggaacctcttacgtgccgatcaacgtctcattttcgccaaaagttggccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgaaaaggtcgtgcggacgaggccgcacactacctacttacgtctaa

SEQ ID NO: 35628 - DNA, 336 bp, Glycine max
  Peptide Sequence Number=SeqID_127313
atgaaacaaaaaggaaaaagaaagaaagaccgcgaaggtcgacatgttatagttaagaagtataaatcattcgtaaagagcaaacgtatcttctggaaacaagggactgacactaagagtttattttccggaataaccgagataagaatggatgaattcattgaactgatgaaagaacataacttggaaacgttggccatgactaattttgcacgttgtttccaaatcatcattgtcgcgcgtgccttatggaataatatggaggttcagcccaagaccgacaccttgacacccaaatttgtttgcccagatatcaagattggtttcccacaataa

SEQ ID NO: 35629 - DNA, 306 bp, Glycine max
  Peptide Sequence Number=SeqID_127314
atggagaattggcgaagcagcgctacgcaatgtaattcgcggggctccagactcgaagttggaggacacatgaacagcgctaggcaatgcaattcatggggctccgaaaaaatgtggagaatggagaattggcgaacaacactaggcaatgacattcgcggggctccagactcgaaggcaatgacattcatggggctccgaaaaaatgtggagaatggagaattggcgaacaacaggctaggcaatgacattcgcgagggctccagactcgaaggtggaggacacatgaacagcgctaggcaatga

SEQ ID NO: 35630 - DNA, 288 bp, Glycine max
  Peptide Sequence Number=SeqID_127315
atgcagtttcagcaagagacgagagcctccattcagagcttaaccaatcagatgggacaattagctacccaattgaatcaacaacagtcccagaattctgacaagctgccttctcaagctatccaaaatcccaaaaatgtcagtgcaatttcattgaggcccacttgggccctccaaaatattcctccagaaggctgttgcttctggaggaagcaacctggctcgcctgggcgagctgagctcgcctgggcgagctgggcggcaaccacctcccctattttgctataa

SEQ ID NO: 35631 - DNA, 351 bp, Glycine max
  Peptide Sequence Number=SeqID_127316
atgtggaccaccacggcaatttcaagagagagagaagtgcctaaggggctgaacccttttcttcttcacttctcccctatttatagcaaaataggggagaagcttgccacccagctcgcccaggcgagcaaggttgcttcctccagaagcaacagccttctggaggaaggatctggaaggcccaagtgggtcagattgctatttgcacccccctttttactaaatgcacccccttctatttttttgctttcgaagaagttacggaaactcacggattgcgcaaaaacacctcttttcgatttccgccacattacggaatttcacggatcgcgcaagcctgcttccttttga

SEQ ID NO: 35632 - DNA, 240 bp, Glycine max
  Peptide Sequence Number=SeqID_127317
atggttcaactgatttctgatatcatctattgtttgcatgaatcgcacccacaaagacacccagtggacccggagaagtccaacagggccctggggtttctagctctggttacgggcctctgtagtcctacagggtgcccgttccccccggcaaggtcacgtcatcatagggatcgcgcctgcaagacatccagtggacccgaagaagtccaacagggtcttggagttgtcaagctctaa

SEQ ID NO: 35633 - DNA, 684 bp, Glycine max
  Peptide Sequence Number=SeqID_127318
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtagtcggaataccgagaaaatatttggaggtaaaagcaagaatcttggcagataaaggcgagtggaccccattcatagatattctcacactcttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaagatgtccaaatgttcccttgatgggaaaaaggggttgtattaattataatcccgtcctcgccataagacagcttggctaccccatgagaggagtgccatcaaacgaaagcatcacgcctttcatcgcacggggttttagtgaccacaacgcgagggtactccaaggagttcgcaaggcatgggatgcggcgtga

SEQ ID NO: 35634 - DNA, 399 bp, Glycine max
  Peptide Sequence Number=SeqID_127319
atgaaggtcgatatggaggccatgaaagggcaaatggccacaatgatggaaggcatgatgagtatgaaaacaaatgatggaggtcaatgcgactacagttgttgctgcaagtatcgccacagaagtggacccaactcactcatcgagcctcaatcaagtaaatcctccagtctcggatatggtaggtcagggaggagaagcattgggaagtacagtgccaacgagaatatcaatgactccactcccatactcattgagagccaacaaccccaatctggtcatgcacatgtctctcaacccatgggggaggcacatgaggcaccccaagaccataatctagtcgactttgagcctcacctcggatatgccgctgaggggaaaacattttgcggcatacct

SEQ ID NO: 35635 - DNA, 227 bp, Glycine max
  Peptide Sequence Number=SeqID_127320
gaagaggttccaatttggatactttgttaaggcaattcaaggatacagttggatctattcaacgagcatttaaaagtgcagaaattcaggttggtaagctggtagaagaagagactcaagttatgggcagaagagaagaagaatttgtagaggttgaagctcaagaggaaagccctgtaaatgagcatgatttagaagaagaagaggaggagaaagcgcaaaaatga

SEQ ID NO: 35636 - DNA, 285 bp, Glycine max
  Peptide Sequence Number=SeqID_127321
atgttggaagagaagtttgttattattattgatgctagtagcaatgaagagaaagcccaatttaaagcttgggaaagatctgatagactcagcctaatgttaatgagaatgactgttgcaaacagtattaagacaactctccctaaaattgaaagtactaaaaagtttatgggattagtgggagagcgttctcaatcagctgataagtctgttgctgggacattaatgggtacattgaccaccatgaaatttgatggttcacatatgaacatgtcattgagatga

SEQ ID NO: 35637 - DNA, 720 bp, Glycine max
  Peptide Sequence Number=SeqID_127322
ctactgacggggtggggggtaacggcaaaagcaccgcccggacatcagcgctggcaaggcgcgtcccattcgccattcaggctgcgcaactgttgggaagggcgatcggtgcgggcctcttcgctattacgccagctggcgaaagggggatgtgctgcaaggcgattaagttgggaattcgatatgtttatgtggttggtgtcacgaatgttggtaaatcaacattgattaatgcgattattaaatcagcttcaggttctgaggatgtgattacaacttcacgtttccctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagccgtttttccataggctccgcccccctgacagcatcacgaaatctgacgctcaaatca

SEQ ID NO: 35638 - DNA, 728 bp, Glycine max
  Peptide Sequence Number=SeqID_127323
ctgtccctcctgttcagctactgacgggggtggtgcgtaacgggcaaaagcaccgccggacatcagcgctggcaagtgtagcggtccccgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgccagtatttgttgatagtgataaaattcaagcttctaagcaaaaattcagattttgggaaacttggatatgccaccatgagcttgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatgggcttacgaacggggcggagatttcctggaagatgccaggaagatacttaacagggaagtgagagggccgcgcaagccgtttttccattag

SEQ ID NO: 35639 - DNA, 138 bp, Glycine max
  Peptide Sequence Number=SeqID_127324
atggaggagttacatggagtagatgttgaagaacaaggaattaaacagaatggagaaggaggaaaggtgattggagacaccacttcaaggagaagatgggttaagaacaagttcaccacaataggaagtcatggctaa

SEQ ID NO: 35640 - DNA, 254 bp, Glycine max
  Peptide Sequence Number=SeqID_127325
cgaggcgaggctcacgggtgcggcttttcaaggaggaaaggtgcgcggagtcgcaccaacgtttatttgtggaaaacgtcggaaaaaccgaaggaaacccggtcaaaatgaaaattctaagttcaggagttgtatttatgcttgaggaaggtattagcacctcttacgtcgacaaaagcggggcttttgctcctacgtaccctcctttggagaggaaatcagacctacgtagttctttcttaagcgtgaatcaa

SEQ ID NO: 35641 - DNA, 399 bp, Glycine max
  Peptide Sequence Number=SeqID_127326
atggccaagttcgatccagaaatagtcctcgaattttatgccaatgcttggccaacagaggagggcgtgcgtgacatgaggtcctgggtaaggggtcagtggatcccgtttgatgccgatgctatcgtccagttcctgggatatccgttagtgctggaagagggccaggagtgcgagtatggccagaggaggaaccggactgatgggatcggtgaggaggccatcgcccagttgctatgtataacggggcaggattttgcccggactgctgccggaagacgggtgcggatcatgcgcaccaacatgaccaccctgactcaaatatggatgactttgttgctcagcaacatcctgcccacctatcataattccgacctccccctgccgaagtgtcagctg

SEQ ID NO: 35642 - DNA, 447 bp, Glycine max
  Peptide Sequence Number=SeqID_127327
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcagggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgagatcctgggttaggggattttgcccggactgctgcagggaggcgagtgcgaatcatgcgcaccaatatgaccaccctgacccagatatggatgacgttgctcctcagcaacatcctgcccaccgatcataa

SEQ ID NO: 35643 - DNA, 198 bp, Glycine max
  Peptide Sequence Number=SeqID_127328
atgactcccgaatccgacgacgaatccctcgaaggtactaatacccgggacccggccattgatttcaagcaagaagcgggccagacggagagtgaagagaatgaggatgtgggacttcccccagagttggagaggatagtcgctcaggaggaccgaaagatggggcctgatgtgccatcattttcttctattttctaa

SEQ ID NO: 35644 - DNA, 627 bp, Glycine max
  Peptide Sequence Number=SeqID_127329
atggctaatgcaaactgttcgcaagagtcattgcattcagtctcaaacgggaatctaagattatggaaatctatccactattgctttattgaaatctatcttgtaaatgaggaaattagagtaagattttctggtgcggttagagttcctagtgcctctgctattgtgtttaatacttttgatgaacttgagagagatgcaatgaatggtctctcctctatgctcccttttctttataccattggtcctttccctttacttttaaatcaaagtccacaaaacaacttcgcatctttaggttccaatctttggaaggaagatccaaagtgtcttgaatggctagaatccaaggaatcgggatccgttgtttatgtgaattttggcagcatcacagttatgtcaacagaacaactcttggagtttgcttggggtttggccaacaacaagaaaccctttttgtggatcattaggcctaaccttgtcattggaggtttagtgattttgtcatctgagtttgtgaatgaaactaaagatagaagcctaatagcaagttggtgtccacaggagcaagtgctgaaccatccttggtggattcttgactcattgtggattgaactcaaccactga

SEQ ID NO: 35645 - DNA, 297 bp, Glycine max
  Peptide Sequence Number=SeqID_127330
ggtcattcaacaatggaaactggtctgactctaaagtccttgatagtgcagggttgagttgtcgtgctttcacgtggaatcgggccgaacaagttcttggtgccgttgctggggaacttctttttatttgggaagttagctcgtttttagtaaatattttgcagatgattcagttccatgagattgagagctttttaaagggtggaatgaatatcttgacggcacacagtcaagagtgggaacaagaattaagttctaactatcaatatgaagaagaaagaactcctaatcttgaaa

SEQ ID NO: 35646 - DNA, 252 bp, Glycine max
  Peptide Sequence Number=SeqID_127331
atgtatattgttgtggtaaaacaggggcaggatcaccttgggctaccttttggagtgaagacaaaacatgaacggcagaaaccagtcaaggtacttaaggatgaacgcaagcggggatggggtcacgaccgaccgatcgttacccttctctgtgcgaaacaagcagggaatgtcgctgcaaggcagccccgtatcctttgtattttgcagctttcttttactatttgtttgttttcaaaaggaaaagagtaa

SEQ ID NO: 35647 - DNA, 461 bp, Glycine max
  Peptide Sequence Number=SeqID_127332
atggaagccaatgcggttatagttgccgctactagcgctgtcgctaagtacggacgaccccatgatgtgcaaattcaaaacgagcacgccttcccatcatatggcttgcctcccaactatacaccacccaatgtgtcatacactctcaatgaaaatctcaataactccacacccatactcattaagagccaacaacctcaatctgatcatgcacatgtctctcgacccatggaggagacacatgaaattccccaccacaatctagccgacttcgagccttggcttggatatgccactgaacccgcaagcaattggtgggccattgaaggaggtgaagattatgcctttgctaacctaaaagagttgttcctagaacccaatatcatcacccctcccaagttcaaggtgctggactttgacaagtacaaggggattacttgtcctaagaaccatctaaagat

SEQ ID NO: 35648 - DNA, 405 bp, Glycine max
  Peptide Sequence Number=SeqID_127333
atgggatgctacagcaacactcaatggttaagcgcgaggaagaatccaaaagaagatgagctgtacaggttcgctgagcgtatcactccaggtcatcaagcgcactgcttcagctcatccgctaagcgagagatgcgcgctacgtcaaaaatcactaacagtttggactgggattcagagctttgcatgtctagggtttctagagagagaaaggtccaagttccagagagttttgagagattttgttgtgtgaagatctgcagagaccagagcttgaagcaggagccggcttcttggtatggaaagctaaatcctctattggatcttccctgtagtggaaactggtctgactctaaagtccttgatagtgcagggttgagttgtcgtgctttcacgaggaatcgg

SEQ ID NO: 35649 - DNA, 339 bp, Glycine max
  Peptide Sequence Number=SeqID_127334
atggacaacaagaaaaggaggcccattatttgtagaaccaagccaaaccttaacaaaactttcaaggaagataccaaggctatagaggtggttcaggtatccatctcaaaccagaagaaaactaatgcttttatcaaaattctagaagttcatgttggacaaccggcaaaacagttgtctgagcatagaagtggatctttctcagcaaccacccgggtcaacccaaaggaacattgtaatttaattacaacaaggtggaggagtgtggttggtttgaaggataatgatgagaaaaagaatatagaaggagttgaaaaagaaaaccagaaaaaaagatga

SEQ ID NO: 35650 - DNA, 183 bp, Glycine max
  Peptide Sequence Number=SeqID_127335
atgtggaccaccacgggggagatggttgccgcccagctcgcccaggcgagctcagctcgcccaggcgagctcagctcgcccaggcgagccaggttgcttcctccagaagcaacgaccttctggaggaatcttctggagggcccaagtgggcctggttgctatttgcacccccatttttactaa

SEQ ID NO: 35651 - DNA, 753 bp, Glycine max
  Peptide Sequence Number=SeqID_127336
gaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcg

SEQ ID NO: 35652 - DNA, 609 bp, Glycine max
  Peptide Sequence Number=SeqID_127337
atgaccagtagattgctggtcggatcattgacatttgataatcaaatcatgcactatataattgttagaattttgcttcccgggtcttcaaatttggcacaagcctccgaggaggatttgattctgatgtgggctttccttaccggtcgtcagatcgactgggctcacttggttcggtaccaaatgcataaggcattacgggccaatgcacctctcccttaccctcaattgataactttgtttctgcgtcattttcaaattccgctagatgatgaaccatttgttcaagtcaagcgttcctttgcaattggtgctggtgcagtgacttcttttggataccgtaaggatcggaagggtcaatggctgaagaaagacacactccctcctcaagatgagcgtactccttctcctcctccttggcgagatgattcagccctcatgactgaagttctttccgagttacggggtcttcgttcttatgttggtgaacatttcgacttgttggatactcgctttgccggaatggatatccgtctcactcaacttgaagaagatgtgggttatattcgtcagagtttcgatcttccaccaccacctccaccttcttag

SEQ ID NO: 35653 - DNA, 462 bp, Glycine max
  Peptide Sequence Number=SeqID_127338
atgactagtatatatgtgaggggtagagggtgtcacaccctcaagttatggaaagaaaaactagaaagaaaagaaaaagaaaaagggagggtaaatataaatcaagatgagagggaacaaataaaggaagaagaaagaaggaaaatactaaaagagttaagaaaagaaaaacatgtctcctatagtagtcataactcttgcaagagtctaagtgaagaacttcgtgactattatgaaggaagacataggtcacatcttagaccttactcccataggagagaaaaggaaagaaagcctcaagaggctaacattaacctcccatacttccacgggaaggacaatgtagaggctaacttagattgggaaataagggtagagcaacaacttaaaaagaagtctacttcaaaatgttatggctctcactcttatccaaagaaagaccaaggtcaaggcatcttaggg

SEQ ID NO: 35654 - DNA, 255 bp, Glycine max
  Peptide Sequence Number=SeqID_127339
atgggtgccaaataccttgaagtggtcaaacgagggccgcatcccaacaatggatggttcccggacgaaattaggaatgaccataatttgtctctgcgttttgttggacacgatcgagcctgggcggcgagacacaaaatgaccataatttgtctctgcgtgtcactagacacgattgcctctggatggcgaaaaggtgcgcgaaatgaccataatttgtctccgcccacctctcgacttactgtccccgaatga

SEQ ID NO: 35655 - DNA, 585 bp, Glycine max
  misc_feature (177)..(177): n is a, c, g, or t
  Peptide Sequence Number=SeqID_127340
atgacattgctacttagcaacattctgcccagcgaccgcaatgccaatctctccctgcaaaagtatcagttggtctgtgtcgtcccgacatggggatcgcacccacaagacacccagtggacccggaaaagtccaacagggccctggggtttccagctctggttacgggcctctatncaatcctacagggtgcccgtacccccccggcaaggttatgtcatcataggtaaggatcgcacctgccaagacacccagtggacccgaagaagtccaacagggtcttggagttgtcaagctctaattacgggtctctgtcagttctacggagtacctgtaacctccagcaagggcatcaggccccctactaatcgagctttcatcaagaagtactgcgtctccaggcaggcgcagggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggatgcacctagttgctcatga

SEQ ID NO: 35656 - DNA, 163 bp, Glycine max
  Peptide Sequence Number=SeqID_127341
atgaccaggagtaggaccaaacagtcagtggataccctccaacaaatggtagcaggcatacttagcaaggcccaagtggagaaggacaaaagcccaagtggagaaggacaaaagcccaaatggagaaggacgaaggccgaagtggaaaaggatgaagccccaa

SEQ ID NO: 35657 - DNA, 216 bp, Glycine max
  Peptide Sequence Number=SeqID_127342
atggtggctggtaatacaacaattgagaaacctagagaagagtggtctgaagaagaaagaagattagtgcagtacaaattaaaggctaaaaatatcattacttcttccctaggaatggatgaatattttagggtgtcaaattgtaagagtgctaaggatatgtgggacactctacaagaatatgagatggagttgcaaagacataaatcaacatga

SEQ ID NO: 35658 - DNA, 465 bp, Glycine max
  Peptide Sequence Number=SeqID_127343
atggctttggaatggtggtcccagaggaagcgttttgtacctgtcaaggttcctgggttgtgggaccttcatcttccctatgaagagaaggttgggccccaggccaggctaccctctccaaaaactgctcaatggaaagcatggatcctggaggcgccaccacctgtaaactctgaagtcaaattaatgctcgggctcaagcgctcaaaagtgaggttgtttgagacaacccttccggctcgacatagggcaatgatcagagcaggaaacccaagtcaagaagagttagattgggctatagaagttgtctggccagaaatgagcactcctatgttcatgtccatgcaagagactaagccaaagattagcctagctctatccattgtcagtatcctcccaggatggccctcagtgttcaagatgaaccctcgacctggtatcatagggcagcctcaatctccctag

SEQ ID NO: 35659 - DNA, 222 bp, Glycine max
  Peptide Sequence Number=SeqID_127344
atgaggaagatgttgctggttgaggtccttgacactgcattcccgacctcaatgattcgaccatctaaggttgggatgattcctccaccctggattgtacctgttgctggagagcataagcttcaagctattcaattgcttcagattgttgcacaaaagggcaaaggtctgtgtggtggtcggcagaggagcataaaccatagagtctggcgacaggtgtag

SEQ ID NO: 35660 - DNA, 147 bp, Glycine max
  Peptide Sequence Number=SeqID_127345
atggcttgcacccacattccagtggaagcaaagatgattcacaagcgattctcctcaaatttcagccagcctgcattaattagacttttcaccttacgcttcaaggtcatacagtgctcaatggaatgtcctgaaactcctccatga

SEQ ID NO: 35661 - DNA, 423 bp, Glycine max
  Peptide Sequence Number=SeqID_127346
ttaccctcaccgttgagaggactacacatcctcgccttgagaggactacacgtcctcaccatcagagggctgcacgccctcaccttcagaggactacacgtcctcgccttgagagggctacacgccctcaccttgggactacacgtcctcaccatcagagggctgcacgtccctcaccttcagaggactacacgtcctcgcctgagagggctacacgccttcaccttgggtactacgttaccctcaccgttgagaggactacacgtcctcgccttgagaggactacacgtcctcaccatcagagggctgcacgccctcacctccagaggactacatgttcctcgccttagagagggctacatcgccctcacctttagggtactagttaccctcaccgtcagaggactacactccctcgcttga

SEQ ID NO: 35662 - DNA, 863 bp, Glycine max
  Peptide Sequence Number=SeqID_127347
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggctccggattatggtgctattactgcagccattttagcatctgttccaccacagccgcaacttgctttaggaaatatgaatccgtcacagcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35663 - DNA, 265 bp, Glycine max
  Peptide Sequence Number=SeqID_127348
gcggaatttgaaatcccagaggcttttgacagtaggacgaaaaggaagttacttcagaccgtgggcgagagatggaggcagtttaaatcagacctcacgaggaaataggcccttacaaccgatcaggacggatgtgcgcaaaaaggcacagaccatccagaaacagaacactgccccccacgttttgtctcgtgggggttatggatatttggagcagaagctcctggctgagaagatgaagaagaagttggaagaagctgcataa

SEQ ID NO: 35664 - DNA, 171 bp, Glycine max
  Peptide Sequence Number=SeqID_127349
atggtaaacaatactagtgagttcaacatacataggaaggttgaaaggaataggaaaggaggattggtgccatcccttgaagaatttgagtcaagaagcaagagggcaaccaccttaagagctattgggactaagaagcacttcaaattgagtggatcaccaaagagataa

SEQ ID NO: 35665 - DNA, 78 bp, Glycine max
  Peptide Sequence Number=SeqID_127350
atggctaagcgcgccctgtgcgctaagcctgagtgtccttctggtgaggctgagctaagcgccagtatgctgtgctaa

SEQ ID NO: 35666 - DNA, 659 bp, Glycine max
  Peptide Sequence Number=SeqID_127351
ccgccattgatgctttcctcgcatatcaccatagcaaggagagtccagtggtggctatcttggcagatttgtttgacacctttgactggaggtgtgagaaaaatagtgcacggattgtctgttgtttacccgctctctgtgtgtggttggtttcacacctattccaacaagacacaagacacccgtgtccgcttcaaagttatcgctcatgcgccgaaaaaggaagagttgattgggaccaacatttgactgggataggaggcaacacaatcaattggtttcctcgttggaaggaaggcaaggaaggagttcttttctcgtgtggggactaccctaatgttccattgatagggactaggggttgtattaattataatcccgcactcgccacaagacagctagggtaccccatgaggggagcgccaacagaagaaagtctcttgcctttccttgtgagggatctaggcgcgcaaagtctcaaggtgatacaaagagtccacaaggcgtggagaagtccattgaggaaagacaaggagcttagaggcatccgaaatggcgtcatcggtggttatcatggatggctaagagttcacacgcgagggttagattggctctccaaattgaaagttatcaatgaggagaacttcgaagctccgtag

SEQ ID NO: 35667 - DNA, 237 bp, Glycine max
  Peptide Sequence Number=SeqID_127352
atgactgctttaccaatagttgaaactcaatcgggagatgtttcagcttatattcctactaaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 35668 - DNA, 318 bp, Glycine max
  Peptide Sequence Number=SeqID_127353
atgtggagacaaaattttgtcattccgcacccctttgccattcagacacagtcgtgtccgatggcacgcagagacaaaatttggtcattctgcaccctttgtcatccagaggcggcgggcccggatgacatgcggagacaaaatttggtcattccgcacccctttgccattcagacacagtcgtgtccgatggcacgcagagacaaaatttggtcattctgcaccctttgtcatccagaggcggtgggcccgatgacaagcagagcaatgtggtcattcctgcacccctttcgtcaatcgcgccgacaagcccgttga

SEQ ID NO: 35669 - DNA, 273 bp, Glycine max
  Peptide Sequence Number=SeqID_127354
atgattattggagcatcaaatgaagcaaacatctattcagcagaagcagaatacatgactgcaacaagcgtggatgtagaagcgaatggctccagaaacaattctgcaaggactccaagactccaacagttattcattgatcaatatttagctactgaaatgactaagaatccagtattccacagccgtacaaagccattaagattaagataccttatccaagagagctcgtggaacatggagaaaatcaaaggaggttctgggcaagactga

SEQ ID NO: 35670 - DNA, 369 bp, Glycine max
  Peptide Sequence Number=SeqID_127355
atgtcaggatttacacgcgattctcctcaaatttcagccaacccgcatcaattagaccttgcaccttacgcttcagagccctacaatgctcaatggaatgccccggggcttctccgtgacaagcacacgttgcgttcgagtcgtattctcggagaaatggagctttctcgctgcaaaattcacttcttggttggtgtttttggctttgtggttgatttagggatggcctttgtggataactgggtggtgggtaaggagaaagtttgttattggctgagtaaagatattgttgggatgattaaatttgcctcttttcagatccacttcgatcctttcactggcgaagaccaaatccgcaaagctttgagg

SEQ ID NO: 35671 - DNA, 816 bp, Glycine max
  Peptide Sequence Number=SeqID_127356
atgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccatagaagccgttgcatcacttacccaatactacgaccagcctttgaggtgcttcacattcggagacttccaattagtaccaaccattgaagaatttgaggaaattctaggatgtcctctcgggggaagaaaaccatatctttcctccgggtgtctctcctctttgagcagaattgcaactgtggtcaaggattcagcaagaggtttggaccgcataaaacagactcggaacggcatagcgggcctaccacagaagtacctagaagacaaggcgagggacctagcagcaatcgacgctttccttgcctaccaccatagcaaggaaagtccggtggtagctgtcttggcagatctatttgacacatttgaccgaaggtgcgagaagagtagcgcacggatcatcggttgcttacccgccctctgtgtttggttggtttcgcacttgttccaacaaaacacaagacatccatgtccgctcctgagccatcgctcgtgtactgaaaagaggagaatggattgggaccagctcttggccgggataggaggtagaacaatcagttggttcccccgatggaaggaaggaaaagaaggagtccttttctcatgtggaagatacccaaacattccgttggtcgcccccgaggggttgtattaa

SEQ ID NO: 35672 - DNA, 723 bp, Glycine max
  Peptide Sequence Number=SeqID_127357
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaagccagccctgctagtgaggaaatttaaaggttcaagcataccagcaatcccaaggggggcccggtaccagcttttgttccctttagtgagggttaatttcgagcttggcgtaatcatggtcatagctgtttccttcgggaaacctgtcctgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcgggaatggcttacgaacggggcggagatttcctggaagatgccaggaagatacttaacagggaa

SEQ ID NO: 35673 - DNA, 830 bp, Glycine max
  Peptide Sequence Number=SeqID_127358
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttctgtcgtggcagaaagtacatttaggaggaacattagtcctgcggtcgaaacttataacattaaaggggcaattggcagcacagtaattacaacctatacatctgtcaaaatcaacattaacagtacccgattcagttcgataaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35674 - DNA, 375 bp, Glycine max
  Peptide Sequence Number=SeqID_127359
atgaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaagatggagctggaatggctgatcaaaaggctctccgaaagtggcattgatgatggtgaagcagctgaggaagaagaagaagcagctgagcaagaagatgaagcagctgaggaagaggtagaagctgctaaggaagaggaagatgcagcagagcatactgaatcagatgatgattctgaagccaccccatga

SEQ ID NO: 35675 - DNA, 1153 bp, Glycine max
  Peptide Sequence Number=SeqID_127360
gcctggcgggcctgtcgatccgcgcggtggcgctgggcatcgtggtgacggccgtggtgcagtcggcgctgggcggcctgggcctgtggatcgccggcgtgccggcggcaggcatcatcacggccttgatgctgatgctgtgcctggcgcaactggggcctttcctgcccctgcttggcggtgtgatctggctgttccagaacgacatgaaagtggcggcggtcctgctgctggtatgggcggtgctggtcaccatgctcgacaacctgctgcggccgctgctgatcaagcgcggcgtgaacctgtcgatgctgctgatcctggccggggtgctgggcggcatgttcgccttcggcattgtcggcctgttcatcggcccggtgatcctggcggtgacctccacactgctcaaggcctgggtcgacgaagtgccgccgccggccgccgacgcgtcgctggcggctcgcccgtccgtcgagccctgagccgcgcaaactgtcccgcacgggccgccgtgggaaaaccgcgtaacatccgcgccaggccccatgcctgcgccgagagcgccgcgcggggccggtctgttcccgcctttcacgctgtattcgagatgacgatatttccgccgatttcccgacccatccatttcccgcgtccgcctggccaagcggctggccgccgagcaatcctgttcccgtggcgacgccgaacgctacatcgagggcggctgggtcgccgtggacggcaaggtcgtcgaggaacccggtttccgcgtcagccctggccaggttgtcgtcctgctgccgggcgcgcggctggaagagatgcggccggtgagcatactggtgcacaagccggcgggcctgtcggcgtcggacccggcgcattcggcgctgggcctggtcgtgcccgaaaacctgatgccgggcgaccgttcgggccagcgctatctcaagcgcatgttcaacggcctcaagctggccacgccgctggagcgcgcggccagcgggctggtggtgtacacgcaggaatacgcggtcgcgcgcaagctggtggaagaggggcgccacgtcgagcaggaatacattgcgcaggtgcgcggcacgctggatgcggccgggctggcgcgactgcagcgcggcctggcctatga

SEQ ID NO: 35676 - DNA, 663 bp, Glycine max
  Peptide Sequence Number=SeqID_127361
atggtgaggacgcgtagtcctctaaaggcgagggcgtgtagccatcggaaggcgaggatgtgtagtgttctgatggcgagggcgtgtagccctctaaaggcgaggacgtgcaatcctctgatggcgaggacgtgtagtcctctgaaggcgagggcgtgtagccctctgaaggcgaggacgtgtgctcttctgatggcgtgggcatgtagtcctatgaaggcgagggtgcgtagtcctcttaaggtaaggaagtgtagtcctctaaaggcaaggacgtgcagtcctctgaaggcgaggatgtctagccctctgaaggtgactacgtgtagtcctctaaaggcgatagtgtgtatccctgtgaaggcgaggacgtgtgctcctctgatggcgagggcgtgtagtcctatgaaggcaaggacgtctcgtcctatgaaggcgagggcatgtagtcctctgaaggcgaggccgtgtagccctatgaaggcgaggacgtgttgtcctctgaaggcgaggacatgcaagaggacatgtagtcctcaaaaggcgagggcatgcaaccctctaacggcgaggacgtgtagtcctctgaaggttaggacgtgtagtcctctgaaggcaaggacgtgtagtgctctcaaggcgaggacgtctagcctaatttag

SEQ ID NO: 35677 - DNA, 724 bp, Glycine max
  Peptide Sequence Number=SeqID_127362
atgtgtcaggtggcaggcggatatacccaagtgattatccgtacaaagacaacatctggtgatcctgacctatgcgtcagggggcaggtgccaagcggatatacccaagtgattatccgtacaaagacaacatctgctgatcctgacccatgcgtcagatatacccaagtgattatccgtacaaagacaacatctgttgatcctgacccatgcgtcaggtggcaggcggatatacccaagcggatatacccagcggttatccgtacaagcacaacatttgctgatcctgacccatgtgtcagaaataccccaagtggttatccgtacaaacacaattctgttactctgactagtgagaggtccgaaacgatcgagtccgatagcatcgaagacgtcatggttttcactaacagagctattggtcggtcagggggtgcgctcaagaaacttcatctagaacgctctggaaggtgcggtgaactaatcaaatggggggtgttctcaggaaacttaatcagaaacttcttcaggaagcctctggagggggtgaacttatcaaaagagggtgcgctcaaaaatcttcctcaggaagctctgggcacgaaaaaagtgaaaaaggaaggaaatccaagccgagttgctttcgtaacgcttccgagacgtttttgtgagcgaatcattgaggattttccgccgttcttcgtcgttcttcgttcttcaaccg

SEQ ID NO: 35678 - DNA, 96 bp, Glycine max
  Peptide Sequence Number=SeqID_127363
atgtggatgatgctctcctacaacctaagacaagatggttgggaattctcaagaatgggtgctggagagattggaactggagaagtaggctcctga

SEQ ID NO: 35679 - DNA, 590 bp, Glycine max
  Peptide Sequence Number=SeqID_127364
atgggtgatcaagaggagacacaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcatctacgcaccatcctccctcaaacatagtaggacggggaaggggcacattggggcacgatggcagccctcacctgggatacaaccgagcggcttacccttatggattgccgcccaactattcaccacccatcttgcaagaagatgcgggccacattgcttctcccgtccatgaaaaggaacctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatggaagggccgcccccggcaactgaagaaaggaggaagctcgatctccttgaggaaagattgagggctgtggaaggatttggggactatcc

SEQ ID NO: 35680 - DNA, 377 bp, Glycine max
  Peptide Sequence Number=SeqID_127365
atggacctccctcaacaatcttctgcttctttagcattcacgcaggatagcaaagccatgcaggtggtatttgctttcaacatgtattgtcttagagtatgcaaaataccaagctaccgtcccgttctttccaccgacaacaagtggagtagttcatctcacagccggaaattttactcaagtatacaagatggaaggagatctctcacggcagccgaattccggcatatagcagcggagggtatcatcgaggcatctagtttgcccttccaatgcctcttgacagcccgtcaattgctgcctggacaggccagcggtgcagctgtcataatctcagccatgttgttggtgccagcgaaccctcagcctggcttccg

SEQ ID NO: 35681 - DNA, 348 bp, Glycine max
  Peptide Sequence Number=SeqID_127366
atgggacagatcccttcccgcctagtagttctcactggtaggctaccggggaaactcggtggagccgctggtggttctttgtctctttggcccttagttggcgccctagtcgacctcttcttctctttatccattccacattccactttctgtaaaccccttactctgtgtctcgcgcttttcagcctgaattccattcccagtcttactagtggccctttcggggactcttgggtgagactggaaagcaagactgattaccttcgtgcccctcacccgaggtcaccagttgtccattccgatcggggaataagccaaaggacagccaagaccatggggatcctctag

SEQ ID NO: 35682 - DNA, 255 bp, Glycine max
  Peptide Sequence Number=SeqID_127367
atggtcagtgtacttgatgatgccatgtttcatacgttggatgttgtgtacattcatggagggtgttttgaccttgtcggatgtgatgcaatcctccctaggaagggaccagtcactagagccatgagcaagaggctccaagaggattgggctagagctgctgaagaaggccctagggttctcatgaacctcagggtagggtaccctagaaatataggatttttcagcccttgtattttagggcacatagactag

SEQ ID NO: 35683 - DNA, 486 bp, Glycine max
  Peptide Sequence Number=SeqID_127368
atgtgggcttttctcaccggtcatcaaatcgactgggcccatttggttcggtaccaaatgcataaggcattacgggccaatgcacctctaccttatccacagttgataactttgtttctgcgtcattttcaaatttcgcttgatgatgagccatttattcaagtcaagcgttcctttgcaattggtgttggtgctgtgacttcctttggttaccgtaaggatcggaatggtcaatggctaaagaaagacgcactccctcctcaagatgagcgtactccttcacctcctcctcagcatgaagattcagcactcctgaatgaagtcctttccaaattacgaggtcttcgttcttatgttggtgaacgttttgactcattggatacacgctttgccggcatggatatttgcctcacacaagttgaagaagatgtctccttcatccgtacttgctttgatccaccaccaccgcctccatcatcctcttag

SEQ ID NO: 35684 - DNA, 204 bp, Glycine max
  Peptide Sequence Number=SeqID_127369
atgaagaagcagctgaggaagaaggagaagcagctgaagaagaagaagaagctgctgaggaagaggaagatgcagcagaagagacagaatcagatgatgattctgaagccaccccatgatcatcagacctttatgtttttgcttttactgttattagctaaaggggcatgtccctttgaacaattgtttactatgggtctgtaa

SEQ ID NO: 35685 - DNA, 192 bp, Glycine max
  Peptide Sequence Number=SeqID_127370
atggtgaaagttggaacctcttacgtgccgatcaacgtctcattttcgccaaaagttggcccagggcttcccgctgtccctcctgttcagctactgacggggtggtgcgtaacggcaaaagcacccccggacatcagcgctggcaagtgtagcggtcaccctgcgcgtaaccaccacaccccccgcgcttaa

SEQ ID NO: 35686 - DNA, 385 bp, Glycine max
  Peptide Sequence Number=SeqID_127371
ggacctagatgagctagtccaactttgtataagagtggagcaacaacttaaaagaaagccttcttcaaaatcttatggctctcactcttattcaaggaaggaccatgcccatggaattttagaggctgcaccttcaaaacccaaggaagataagggtcacattgcctctcaatgccccacaaagaaaaccatgattatgaggggtcaagacatttatagtagtgaagaggagactacttcttccccttcctctagtggaagtgaagatgaagtaaggggtgaagagtctagtgaggaagtctacacccatgaagaaggtgacctcttaatggttagaaggctccttggagtggatcttgttgcaattgttgtagcacaagattag

SEQ ID NO: 35687 - DNA, 255 bp, Glycine max
  Peptide Sequence Number=SeqID_127372
atggcttctatggacactctgctatggtcaactctaagatctttccgaatgcatatgacacagatgcaatctaggaatgcaggggcccgaggaattgtctccttcttagatacaacgtctaggggtagcaaagtgccccgacatacgtttttaagaaggcgacacagaccctccattggtttgtttacagaggggatcaagacagaacccatatgcgatgcatatgcaaaagacgcaatgcgggaatgtacatag

SEQ ID NO: 35688 - DNA, 136 bp, Glycine max
  Peptide Sequence Number=SeqID_127373
ttggtggcgactccgtgcgtattcctttcgtggaacacgcatcccgcgagtctcgcgtcgccctcccgccggagggggagcaagtcaccgacgcacaggattttggttggccatcaaagggggaagaccattttag

SEQ ID NO: 35689 - DNA, 756 bp, Glycine max
  Peptide Sequence Number=SeqID_127374
atgaaggatggcgcgcagcaagaggccacagctgggctacacttggtggtgctggattcccagatacccggcgaaagagctggccaacgtgcaggatctgatggtgcgcgcgcccaagctgctgctgatcaacccgaccgactccgatgcggtgggcaacgcgatcaagatggcccaaccaggctaagatccccggtcatcacgctggatcgcgtggcgagcaagggcgaggtggtaagccacatcgcttcggacaaccgcgtgggcggtaaaatggccggcgacttcatcgccaagaaagtgggcgccgatgccaaggtgattcagctggaaggcatcgccggcacttccgccgcgcgtgaacgcggtgaaggcttcaagcagtcgctggatcagaataaattcaaactgttggccagccagccggccgatttcgatcgcaccaagggcctgaacgtgatgcagaacctgctgaccgcgcacccggacgtgcaggcggtgttcgcccagaacgatgaaatggcgctgggtgcgctgcgcgcgctgcaaaccgccggtaaaaccgacgtgatcgtggtaggcttcgacggcaccgccgacggcgtgaaagcggttgaaggcggcaagctggcggcgaccgtggcgcagcgtcccgatcagatcggcgtgatcggtgtggaaaccgccgataaagtgctgaaaggcgaaaaagtgccggcgaccatcccggtcgatttgaaactggtcactaaataa

SEQ ID NO: 35690 - DNA, 864 bp, Glycine max
  Peptide Sequence Number=SeqID_127375
atggccaagttcgatccagaaatagtccttgagttttatgccaatgcttggccaacagaggagggcgtgcgtgacatgaggtcctgggtaaggggtcagtggatcccgttcgatgcagatgctatcggccagctcctgggatatccgttagtgctggaagagggccaggagtgcgagtatggccagaggaggaaccggtctgatgggttcgatgaggaggccatcgcccagctgctatgtataccggggcaagattttgcccggactgctgcagggaggcgagtgcgaattatgcgcaccaatatgaccaccctgactcagatatggatgactttgctcctcagcaacatcctgcccagcgatcataattccgacctccctctgccgaagtgtcagctggtatggtgcctactaggcaccctttgggacccagataagtccaacagggccctgggatttccagcactgatcacaggactctgccagtcgtttgggagtccccgttgcacctaccaaggccgcaggcgcgcccccaccacctcatcaggctggcaggctggggcatttgacatggagcagtatttacggcatttggttcgccagcaggcagccaaccaccgagcacatgtacggacccatgactgtctgtaccagatgagccttagcatgcagagccagggcttcgcttctttttcatgccctactccagaccagttcagggcagaggtagcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 35691 - DNA, 557 bp, Glycine max
  Peptide Sequence Number=SeqID_127376
ggaggcatcgacaagggattacccatgctgcatccgcgcgccaatgccatgttggcctttgctttgcctgcgctgattatcggttccgcttccagtctggtgctgctgctggtgatgaaagtcgccgccgcgctgcagcaattactgtgggtgacgctgcccgatgcgctgagcctggatgcccagtcgccctggtggccggtcgcgatgctgacgctgaccggcgtggcggtgggccttatcgtgcgctatatgccgggccacgccgggccggacccggcgacggaatcgctgatcggcatgccgctgccgctctccgccctgccggggctggggttggcgctgatcgtcggcctggccggcggcgtcagcctggggccggagaacccgatcaccgccatcaatatcgcgctggtagcggccgccggtgcacgcctgctgccgaaggtgccgcgcatggactggatcatcctggcggctgcgggcaccatcggcgcgatgttcggcacgccggtcgccgccgcgctgatcttctcgcaaaccctggcgggcaataa

SEQ ID NO: 35692 - DNA, 297 bp, Glycine max
  Peptide Sequence Number=SeqID_127377
atgtcacgaaactttacggattacgcaaccatcccccctttgacttccggaatgttacagaactttatggattgcgcaataatgcttcctttcgactcccgacatgtcgcagaacttcacggattgcctaacgatgggtgtcaagtacctcgaagcggtcaagtgaaggtagcatcccaccaaacagatggtccccggatgaaattagggtatgacaccaagtcactggtagtcgattaccataaaggtgtaatcgattatacatcaacagatgtgactcttcattttgaattttga

SEQ ID NO: 35693 - DNA, 240 bp, Glycine max
  Peptide Sequence Number=SeqID_127378
atgcatgccaatgctagagtgatgagtgaaatagaggtggtacaggaacagatgaaggccaacatggaggccatgaaagagcaaatgaccacaatgatggaagccatgatcagtatgagaaaaatgatggaggtcaatacggctacagccgttgccgcaagtacctccactaaggtggacctaactcacccacctggcctcaatcaagtaaattgtctagtctcggatatggtaggttag

SEQ ID NO: 35694 - DNA, 1062 bp, Glycine max
  Peptide Sequence Number=SeqID_127379
atggcccccaacaacaacagaagagccccagtagtgggcgcgaggaaaaaggaaggagatgcccacgcggtcaccaccgccccaacatggatgaaagcaccccaaaatatcgaaagctcataccagcccaatcccccaaattttttaatccgagccgggaattccctcccgactcaagtaaaaggaccacccgcagcagaaagagcgccggcccaacgcacagctccagccgcaccccggccagttaataatacagcccccggcacgacctataaatatgcacagcacccgcccccgaaagacaactttcctcctattcccatggcatactccgagttatggccttcattattggagaatcatttggtggtggccatacccgggaaggttctccccgccccccctaccccaagtggtatgacccgagtgccaagtgaggaaggcccaaatgttaaaaccaacccactagctagtcatggaggggctagcgtgaacgccatcaaagaggatggtccatcgcgggcaaagagattaggagacatagctacttctagacgcttcatctatcaatcactgcaagcggcgtgcatggtctcccgtggtggaggcgaaagggacgaatgtttatttcacctcggggagtcgcacgacatggaaacccgtcccgcggtagaagaattgcttcaacggctcatggactgggggcaacttgaagtgtccataggagggagggaagaaccacaagtttgcatgcagtcggaagagaagaaggttcctctaacccccaaggccctagtgatatgttttactaggaaagggaccggctccacacccacatacccccggacggcgcccaagccaacgccatttgcatatcaaagtaataaggtcgttccgtggaagtatacccctcccgcgtccagcgaaagagttgcaaccgaagttgactccctatcagctaaggtaaccaacatcaccggcctcagtggcgtaacccgcagtggtcgggtgttcgcttcccctcacccggcggaattgccctctaaagggaaagcacccatg

SEQ ID NO: 35695 - DNA, 147 bp, Glycine max
  Peptide Sequence Number=SeqID_127380
atggctgtcaagaagggatatcggtttacaaacgggaaatatgattattcattttacccaagccttaaaggcgacaacctttgggattatattgtgacctaccaagataaggttattgctcaggatattggggcgagattcaagtag

SEQ ID NO: 35696 - DNA, 701 bp, Glycine max
  Peptide Sequence Number=SeqID_127381
cattccccaacagctctcagaaattgcgaaaccattccaaacgctctgcttttccatggctactcaccaaaagaaacttcagctctggttcaccctctgtaccatcatccccatcatccaccaaagcgccatcaatccaggaacaacctgaattccatatccaacccatacagatgattcctggtcaagcccctgttcctgaaaaactgagatgggataagaagatccgcagtattgtgagtacgattctgaaaaatgcctctgtgggtattcctgatgctgattgggctggaagatgcaaacagatttccaccccaaatgacttctggtgcctgatgttctatctggagcaaagatcttccaatttcatggcttccgcccacagaatgcagaatgtcctctctatctactccagcaaagagagtatcaatgcagaggaagagctgattccaagctgtttgcagagaagcagactcctgcaccacggagacaacaacaagaacctgctccagaacgattacaaagccgaaaaggaaaaacccccattaagcaggtcaggacgaatcaagactatgcatcagaagaagagcggactccgatcaactcctaccacatccagactggagcaaagttgcaatcccttcaagaagaggaaaagaaatttctcatcactcgaaggattggatgtcgaaacagtttga

SEQ ID NO: 35697 - DNA, 663 bp, Glycine max
  Peptide Sequence Number=SeqID_127382
ttggaacctcttacgtgccgatcaacgtctcattttcgcaaaagttggcccagggcttcccggtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttccttggagatgccaggaagatacttaacagggaa

SEQ ID NO: 35698 - DNA, 381 bp, Glycine max
  Peptide Sequence Number=SeqID_127383
atgatggaggccatgaggagcatgaagaagataatggaagccaacacggttgcaattgccgctaccaacgctgttgctaaggtgaacccaatgcccccatctggcctcaaccaaataaatcatccaaccccagatatggtaggtctggaaggcaaagagttgggaggtacgagcaaccctcatttagtgcgaaaaacaagcatgccttcctaccatatggcttgcctcccaactatacgccacccaatgtggcgtacactcccaatgagaatgtcaataactccgcttctatactcattcagagccaacaacctcaatctgatcatgcacatgtctcttgacccatgggagagacacatgaaatgtctcaccacaatctag

SEQ ID NO: 35699 - DNA, 1200 bp, Glycine max
  Peptide Sequence Number=SeqID_127384
atgtcgcaagggcaatcagttccgtttgctgggaagtggcaacattttacagtcaggaatgatggagaaaaggtggttccagaaccacatggtgacgcagaacagacagaaacctgggaatcagaggtgatgatcccttgggcagtggaaagaacggtttacgcttttggtggacccctgccagaccaagcatcactttcgagtaaaatgagtaaggtatttccctgctaccaaacttgcgaacctaggattttttatagtgagccttacaactttaattgtttaagcaaacccaacaaactctttcgatccgccccgtcaatagcccatagggattacctgccttggcttgatcgagtcgaacaagcgtatgaggatttctggaagacatatggcatctttgatttgatacaattctctcgatctggtcctgaatatcgaccagagatgctgatagcagctatgcacttcttcgaatcttctaccaacacctttcagtttaagtgtggtatgatgacccctactctcttagatgtggccgcccttacaggccttaggcctagcggagaaacttacgaccccactaattctagtgataatatcaagctagtatataaggagaacaccttttccaaatatatagctgaacacaaaggaccagtcgaagaggaggtctctgatgaagagcacgtagccttcttaaccctgtggctatctcactatgtcttctgcacgaaatccttgcaagtagccaaaagatttattccaatggcattacaaattcatgaaggtcagaactttggatttggacgcctcttgttagcagtgctatacgaatcacttggtgaggcatgcgatgatctgaagaaatcgaaggatggatcttccttcttagtgtctgggcctatgtggcttctccagttgtggcttaatgccacttttgaacaggaaatgggattaataatcccacaagattatgctgaagaagttgcaaatcgctcgattgaaggccagagagcacttcgactaacgcccaagaccttggatccaagctcacaaaaactgttcctaaagtatatgagtatttttctgagctttgacaagtttcttccccaacatgctccattcatcagtcgagaggttggcccggcctggttcactgactatttccctactgtcgatccggacaatgaagaagag

SEQ ID NO: 35700 - DNA, 246 bp, Glycine max
  Peptide Sequence Number=SeqID_127385
atgaggtttcactgttatcaagcaagtcagaaacttagcatgaccacaaattcacctccacttcctatgttcccatggacctggtccccaatggagtcgccaactgttgcaacctaccctttggcaggaaggcgatgcggggctcataggtgcgtcttccaagggaggaaggcatgcagagttgccaccaacgtttattcgtggaaaacgtcggaaaaactggaacgtgtggtctacgaactttaa

SEQ ID NO: 35701 - DNA, 810 bp, Glycine max
  Peptide Sequence Number=SeqID_127386
atgtctttcgttgatctgtataattgtgttcctgtaactcaggatgctagcgctagcgcatatcaactgatggcttatttcctcctggataagaattttgcgaaactaacaaatctttttgataccggcagcggtgagatatttgacatctattctcacatgagaattgaattaatttcattcatcaaagactctcttagtgaggagaatcctgagctatgcgcaattttggatagggtcctaactaggagtatagttaagcaaatatatatgccaattatatatggtaaaacagctaatagcacaactaaggatcttatagtgagtctttgccaagatctcttgccaaaagaatgtactatactgtcggttctatgcttcaaattttggcaagaaaaatacagttttatgtattcgtttatccagctgatcagcctggtaggtcgggtatgctcttacctagatcgaccagtcttgtacagcacagaatattttagcacatcccaggattataaaaagatggaaaaacactcagttagagtcttcaactcttacttgaaaaaggcccataatgtcacactctcgtttccctcaaaagagcgggataagaggaaaagtggggtatccacattcgttaacttcattcatcaaaaggacgcgcaaattgctatgtctattgccttctatgagaactcatataatatacctctgtacacagttcacgacaacttcataacaaatatacattattgtaaatatatatctaaaatctatctacatgtcataaaggaaatggggcccccctcttaa

SEQ ID NO: 35702 - DNA, 228 bp, Glycine max
  Peptide Sequence Number=SeqID_127387
atgcatcttcagaggccaccatccctaagccattcattttttaggcaagcagtggtggatcaatcttctcttcagcagccagcagacccgtctactccagtacttgagattccaaaggaccctgccacaccagtcctgggactgactaccactcttccagccactcctatgctacatttgacagatgaggagggcactcaggatcaggagacccagcaggatgattag

SEQ ID NO: 35703 - DNA, 508 bp, Glycine max
  Peptide Sequence Number=SeqID_127388
atgttggtgcgcatgacccgcactcgtctctttgcagcggcacgggtgaaatcttgccccggtatgcatagtagttgtgtgatagcctccctctctggttgtgctcgcacagttggccctcctccaatatcagggggtggcccaggaaccgtgtggatgtggagcacactgaaaatgaggacacgtagccctctaaaggtgagggcgtgcagccctctcaaggcaaggatgtgtagtcctctggaggtgagggcgtgcagccctctattggcgaggacgtgtagtcctcttcaagggcgtacagccctctgttggcgaggacgtgtagtcctctcaaagcagagcgcgtgcagccctctattggcgaggacgtgtagtcctctaaaggtgagggcgtgtagccctctgaaggtgaggacatgcagtcctctgatggcgagggcgtgtagccctctgaaggtaaggacatgcaggtcttctgatgcgagggcgtgtagcccttctgaag

SEQ ID NO: 35704 - DNA, 327 bp, Glycine max
  Peptide Sequence Number=SeqID_127389
atgtaccctccactaggactgatccacaagagatgtaccctctcttattctcagtcagcaacccaagtagatgtatcctttacttgtaccacaaaggatgtaccctccaatgtgttaagacaaagttctcaggcggttaaacctttgaaactttgtgaatggggaaacaaaagtattctcaggcgggagaagggagacacaaaagaatttaggcagttagtcctttgttcttttggaaaagggagaagagagacacaaaaggaattcaggcggttagtccttgacgaattctttttggcaaagggagaagagaatgaaaaagattaa

SEQ ID NO: 35705 - DNA, 384 bp, Glycine max
  Peptide Sequence Number=SeqID_127390
atggggacgaggggttgcattaattacaatcccgtcctcgccataagacaacttggctaccctaagagaggaggaccattagaggaagtcctcacaccctttattgcacgaggtttcaatagcaccaacacggggatgcttcaaagggtccgcaaggcatgggaaatggtgcaaaagaaggacaaggaacttagaggaagtagcaacgggcccatcagcggctaccataggtggttgaaagcctacgcacaaggtctggattggctctcgaatttgagaaccactaaagaggcggagggtgaagcttcggaagaagatgaagagatacaagccctcaaaacagagcttgagaaagcccaaacagccaaagaaaagttcaagtaa

SEQ ID NO: 35706 - DNA, 222 bp, Glycine max
  Peptide Sequence Number=SeqID_127391
atgggaccaccacggctatttcgagagagagagaagtgcctaaggggcttaacccttttcttcttcacttctccccctatttatagcaaaatagtggagaagcttgccgcccagctcgcccaggcgagcaaggttgcttcctccagaagaacagccttctggaggaatcttctggagggcccaagtgggcctggttgctatttgcacccccatttttactaa

SEQ ID NO: 35707 - DNA, 699 bp, Glycine max
  Peptide Sequence Number=SeqID_127392
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 35708 - DNA, 532 bp, Glycine max
  Peptide Sequence Number=SeqID_127393
atggactttcgcggccagccttttggtccgatgcctgcactctgtgccgtggcagaagatgtgaccaaggtgcatgctgtgtgtgtgcgctgtggcgagctggcacagtatagtcaccgtttggtggcaggcgacaatcaggtgatgctcggcgagatgcaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 35709 - DNA, 216 bp, Glycine max
  Peptide Sequence Number=SeqID_127394
atgggttcatccccggtgtggcttctctctctttcaaactttgctgaaaagatgtttacaaacgagaaagaaaatctcaagcctgaggttgcttcgagtaacctcggcataggcacgaacttctgtcggaatctagtcataaaacgtgtttcattctctcttctccgttctatcgtcatacccgtaatcttcgttccgggtaagtctttgcattga

SEQ ID NO: 35710 - DNA, 741 bp, Glycine max
  Peptide Sequence Number=SeqID_127395
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggcccttgattatcatcagaataaaaattccgtgggaaacagttttgttagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35711 - DNA, 225 bp, Glycine max
  Peptide Sequence Number=SeqID_127396
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcactccctgagtagctggctagtcctgccatcttccatggcctgctaa

SEQ ID NO: 35712 - DNA, 186 bp, Glycine max
  Peptide Sequence Number=SeqID_127397
atgtcggctgaaaagtatcagtctgggctttttaactgccgatgtcggctatggaaatgttcgatcggcgtcatccggcgatgcttcttttttaaaccaggatcgtcatctttcctggccgacagtcgactagcatgtttttcgatcagtatcggtgaatcatgtttttttccgagatgggcataa

SEQ ID NO: 35713 - DNA, 441 bp, Glycine max
  Peptide Sequence Number=SeqID_127398
atggcccgcacgaagaaaacaggggagatgacgactgaggctgcaaaggaaatcgctgagaagatcataagtcattttcaactaaccattacaattatatttcaatattttgtgaatgccatgtacaactgtgtgttttctgtacatgattcctttgaggagcaggcgacacagggatccttcgtcccccatggacgccaggatgttctgaccgctgctattggacgtccagagcaccctggacgtgtccatgttgctggagccagtgtcaccatcaggcactactttgctgacccagcaaatcagggaccagttagaggagtccatcacagaaaaagtgacgaggcagctcatggcatcgttcagccagatgcagtcccagatgcaatctcagggacttgcaccgcctcccgaccctctggtggtccctctggtcctcaa

SEQ ID NO: 35714 - DNA, 291 bp, Glycine max
  Peptide Sequence Number=SeqID_127399
atgacaagcagagacaaaatttggtcattctgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagagcggcgggcccgatgatacgcgaaatacccaagtggttatccgtataacattcttttgctatctgaacgacaagtcatggtcacccgcgactctcgtcaaccgagaggagtga

SEQ ID NO: 35715 - DNA, 609 bp, Glycine max
  Peptide Sequence Number=SeqID_127400
cctctggtcgatggaacaatgtaggcaagggaagtcggcaaaatggatccgtaacctcgggaaaaggattaaggctcgggctgggcaacggggtccctcgaccttctcggctgtacggtaggacggtgcgagctgctgttccgcctggaatcgagagcgtcgtgcgtgcctttttggtcagaactggcgatcgggatgaaccggaagctgggcttacggtgcttcccacgtgcgtcgacagtcaacctcagaaccccggtacggacaaggggacgctattcaaccaagcgcgggtaaacggcgggagtaactatgactctcgggttaaggtagccaaatgcctcgtcatcagtgtagtgacgcgcatgaatggattaacgagattcccactgtcctgtactatccagcgaaaccacagccaagggaacgggcttggcggaatcgcggggaaagaagaccctgttgagcttgactctaggacgggggaagcccgtctgatagcgctctgtgcgcgtactccgaaagggaatcggcctgcccaccctggaaacggctcagccggaggtagggtccagcggctggagagcaccgcacgtcgcgtggtgtccg

SEQ ID NO: 35716 - DNA, 273 bp, Glycine max
  Peptide Sequence Number=SeqID_127401
atggcttacacccacattccggtgtggcacctcttgtcaatgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcggagaaatggaggttgatgaaccttggctagggttatggctaccattgaattatcatgtagatatgggatcaagtctggcatag

SEQ ID NO: 35717 - DNA, 405 bp, Glycine max
  Peptide Sequence Number=SeqID_127402
atggataatgaagagggcatgcaggaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcaacccgccttgaatccgggcctagacagaaacacggccgtgttcggtcgaaggtatagtccgcaagcttatccttatggcctgcctccggacttcaccccccgtgccaccccagaagatttaagccaagccccgacctttgaggggcaactcccaccttatgagactatcccgggcaagacgatggggaaggagatacccatctggcccctgctcccctcaaagatccatcccgcatga

SEQ ID NO: 35718 - DNA, 693 bp, Glycine max
  Peptide Sequence Number=SeqID_127403
atgaaggttacagcccttaagcaaaccagccatgacatgatcgctcatgtgggtaaggctctagctgccgtggaagagctgagaaagttccttgtggctgattcattggaagaagtgaacagaaaactggacaagttctacatggtcctcatcttgagaagcttacacttaaactttgatcatgtgtgtgatcaagtacttgctggggaccaggttccatcaatggattccctcatcactagacttctccgcgtgcctcatgtatcgaaggatgaaaatcctgctgatagtatggagacgtcagccatggttgcatctcgtggtagaggaggcggctgcaacagtagaagaggtcgcagtggaaggggtggatgtcctcattgcacctactacaacaggatgggtcacacccaagagaattgctatttgttgcatgggtttcccgacaaggtcacacatgtttctagatcagagaaagcagagtttagattctttgatgaggagtatcaggagtatttgaagcttaaattcgagaaacccagcaaccaagctcaatcctcatctgtaccatgtttttcaacagcatgtatctctcaatccattgaaggtcctagtccttggatattcgactcaggtgcctttgatcatatttatggaacatgggacggggcaattgattggagaaggacatga

SEQ ID NO: 35719 - DNA, 120 bp, Glycine max
  Peptide Sequence Number=SeqID_127404
cttgtgtcttcttcagagatggggcatgctggatggcccttaactgaccataatataatagccagccgttttccaggtcactctaactactcaaatttgccatatgtggaaagtcattaa

SEQ ID NO: 35720 - DNA, 348 bp, Glycine max
  Peptide Sequence Number=SeqID_127405
atgtggaaaatacccaaaagggagggcaaaagggttattttgggactttttcagacccctgggcccactagaaaacttaggaatgaagcaaccagctcgtttgggcgagcaaggttgcttcaggttgaagcaacaactcacctgggcgagctgttgttcaacctcctcccctcatttcctataaataggcgtgagggggttgaaggaaaaaaagaaaaagaaaaaacgaggctaaggagcttccgaatcgcttccgtgatcgattcttacactgttcttcgttcattcttcgttcatcgaccgattagtttttattttgaagttttgaattcactctatgcaccctaa

SEQ ID NO: 35721 - DNA, 333 bp, Glycine max
  Peptide Sequence Number=SeqID_127406
atgaagtcaggtgacatgcggggttaccgtatggttacccgcacctttcgtcaaccaggggcaaatgagcccgttgatgcgaagagactaacatcgtcttatacaccttttgccatccagggacagcgagttaggtggcaggcggagataccttatggtcatccgcacctttcgtcaaccgaggggaatgaatttgacggttttactctcgtcgtccggaaacattcaagcccaatgacgtgcgagattcttctctactgggcaaggacgatagagtgcaatggcgtagggaagtgtcatggttgtccaactttgtcgctttcaagacactga

SEQ ID NO: 35722 - DNA, 300 bp, Glycine max
  Peptide Sequence Number=SeqID_127407
atgttggtggcgactccgcgcatccttcctcctttgggaagcgcacccatgagcctcgccctcgctcgcccgcgaagggcacgttgcgacagttggcgactccactcgggactaattttgttttatcaagtcaaggttaaaggtctagatgtcactagcctcaaggaattagaacgattgatgggacctctccaaaggcaagccttccgcaaagtgtatgggaagattctagatttgaccgtagcggaggtatttacggaagctgtcgtgtccctcgcccaatactatgaccagccgtag

SEQ ID NO: 35723 - DNA, 156 bp, Glycine max
  Peptide Sequence Number=SeqID_127408
atggacctgatcttttttatctttcttttgctaaccactgttattaaggcctttgactccctggtggttttggagcttcaagaagatggaaaactgactacctcagatgatcctcctgtggtgtttggctgtttagatggaagctttatacaacag

SEQ ID NO: 35724 - DNA, 393 bp, Glycine max
  Peptide Sequence Number=SeqID_127409
atgctgaagatgggagattcagctaaagttgtgatcaaacaagacatgaagggaataaggcataaatatgggtttaacaacaatgaacgtgagaaggcacagaagaaaagggtggtggatgatgaaactgccgacaaacatcaactggatgaagactggccatacgactaccttaaggggattaataatattgctatcaagggtcttgatgatgctcaacagcctaaatcaaaggcttctgctaggtcgattgccctcaagctacaaaaaaaggaagaactgagtgcagctaactttcagactcaaactgcgattgcccagacctctgaatggactgtggctcgaggaatccatagatatcagaattccccactcgcatacatgtttcagtga

SEQ ID NO: 35725 - DNA, 171 bp, Glycine max
  Peptide Sequence Number=SeqID_127410
atgagcctcaagttaccctcactgttgagagaactacacgtcctcgccttgagaggactacgcgtcctcaccatcagagggctgcacgccctcaccatcagaggactacacgtcctcgccttgagagggctacacgccctcatcttgggtactagttaccctcaccgttga

SEQ ID NO: 35726 - DNA, 129 bp, Glycine max
  Peptide Sequence Number=SeqID_127411
atgttggtggcgactccgcgcacctttcctcctttggaaagcgcacccgtagcatggaaaacacctttcaatggaaatggccccaaggaagcttgtctcaaagagatccaggaaagacaaagcggctga

SEQ ID NO: 35727 - DNA, 303 bp, Glycine max
  Peptide Sequence Number=SeqID_127412
atggctcaggagcggacatggatgtcttgtgtcttgttggaacaagtgcgaaaccaaccaaacacagagggcgggtacttctgtggtaggcccgctatgccgttccgagtctgttttatgcggtccaaacctcttgctgaatccttgaccacagttgcaattctgctcaaagaggggagacacccggaggaaagatatggttttcttcccccgagaggacatcctagaatttcctcaaattcttcaatggttggtactaattggaagtctccgaatgtgaagcatctcaaaggttggtcgtag

SEQ ID NO: 35728 - DNA, 438 bp, Glycine max
  Peptide Sequence Number=SeqID_127413
atgtaccctctactagaactgatccacaagagatgtaccctctcttgttctcagtcaacaacccaagtagatgtaccctctacttgtaccacaaaggatgtaccctccaatgtgttaagacaaagttctcaggcggttaaacctttgaaactttgtgaatggggatacaaaagaattctcaggcgggagaagggaggcacaaaagaattcaggtggttagtcctttgttcttttggaaaagggagaagagagacacaaaaagaatttagacggttagtccttggcgaatcctttttggcaaaggaagaagagatgaaaagaatgaatagcacaagttttcaaggtttggaaaaccagaaaactttggaaagcttttggcaaaaggaagaagaagagactcagaaatcaattggcaaaagtttgttgtctaaagaatga

SEQ ID NO: 35729 - DNA, 427 bp, Glycine max
  Peptide Sequence Number=SeqID_127414
atgattatgaggggtcaagacatttatagtagtcaagaggagactacttcttcctcttcttcttgtggaaatgaagatgaagtaaggggtgaagagtctactgaggaagcctacccccatgaagaaggtggcctcctaatgcacaagattagtttccaagttgaacctctctatcattttcccaccccaaaaccttataaacttcaatggctcaatgagcaaggggaaatgatagttaaccaacaagtgaaggtggccaaagatcaactaactatgaaagataagagggatgaggaagaaaaactagaaaaacaaaagaaaaagaagggtagtaaggccttgtcttcaaaggcaaaggggaaggaaaaagaggaaaaagattcctccaagaagattgttaagaaggaaaatcattttgcaacaaaag

SEQ ID NO: 35730 - DNA, 756 bp, Glycine max
  Peptide Sequence Number=SeqID_127415
atggacaagaagatccgcagtattgtgagtagcattctgaaaaatgcttctgttcctgatgctgatgaagatgtcccaacatcttccaccccaaatgtttctgtgcctgatgttgataaagatgttccaacatcttccgctccaaatgctgaagccctctcttcacccagtgaagaggaatcaacagaagaagaagatcaagccacagagaagaccccggcaccacgggcaccagaacctgctccaggtgacctcattgaccttgaagaagtagaatctgatgaggaacccattgccaacagacttgctgttgaaagagaactgggaagagatgccttggcttgcaaggagatcatggacctcatcaaggctgctggactactgaagacagtcaccaagttgggagactgttatgaaagcctagtcagggaattcattgtcaacattccctctgacataacaaacagaaaaagtgatgattatcagaaagtgtttgtcagaggaaagtgtgttagattctcccctgctgtgatcaacaaatacctgggcagacctactgaaggagtggtggatattgatgtttctgagcatcagattgccaaggaaatcactgccaaacgagtccagcattggccaaagaaagggaagctttctgcagggaagctgagtgtgaagtatgcaattctgcataggattggcgctgcaaactgggtacccaccaatcatacttccactgttgccacaaggtttgggtaa

SEQ ID NO: 35731 - DNA, 780 bp, Glycine max
  Peptide Sequence Number=SeqID_127416
atggcaagagctggtgacaatggtggtgtatatcatcaactggacgaatctcaacgcttatttctggacgcgtggactacacaaatgcaacgtttgttgaaccgtaacaaagaagagccctacagacgaatagtcaaatcttcctcatttactcttaaacctctatcccctagagaagtgtgtgatgaccaaatcagaatgggagaaaagagagaacaagagaaagaaaatagtgaggcaccacaaaggaatatgaaaaagaagagtgatacacccgaggaaaagagtgatacacataagagagagagtgatacacatgagagaaaatttaattattttgcaaaggcgagtgaagtgaggaaagtgttacctgttcatgaaccactcaatctacagtattgcaaagacagtaaaatttctactgataattctaatgagtttactatttctatttctcctagtgcaacttacaaaagcaatccccaagagactcaacgtaaggatgcacatgacaaagttgagtatgtgaaaagattgtatgaccaagtaaaggtgcaaattgcaaagaagaatgaaagctatgtcaagcaagcccacaagaaaaggaaggaagtggtacttgaacccggtgatgatcctgaacatttgaggacaaatattttccaagaaggagggaatgatgagaatcatgaaactggtcaaatacaggctaaaggcccaagtggagaaggacgaaggcccaagtggagaaggacaaagcccccgagtggagaaggatga

SEQ ID NO: 35732 - DNA, 693 bp, Glycine max
  Peptide Sequence Number=SeqID_127417
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgccccgttttcaccatgggcaaatattatacgcaaggcgacagtgctgatgcgctgcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 35733 - DNA, 381 bp, Glycine max
  Peptide Sequence Number=SeqID_127418
atgagtacgaccgggcgtggggaggcactcggtcctccggattttcaagggccgccgggggcgcaccgacaccacgcgacgtgcggggctcttccagccgctggaccctacctccggctgagcgtttccaggatctgcaccgacgaccgctccgcccgggctcgcgccctgggttttgcagcgaccgccgcgccctcctactcatcggggcttggtccttgccccgacggccgggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 35734 - DNA, 345 bp, Glycine max
  Peptide Sequence Number=SeqID_127419
atgatgattggaggtggaattacctggatgttgtggaagcttgggaggattgatggggacccgacgttgagaggaacgaggataagggctacgtgggagtacgtgagctcaattggaggtgggcagcaggggatggagaccttggggatgtcaggtggggtgctattgcccaaaaccaagcttgaccaatcccgacccaacccgggcataggaactaagaccacaaagcaaggaggcttgtgtggtggctggccagctgtgaactttgagtgttacatgggatatggcctctggagtgtaatcgattaccagctgaaaacgagtcagaaagctagagggcttcta

SEQ ID NO: 35735 - DNA, 187 bp, Glycine max
  Peptide Sequence Number=SeqID_127420
atggcctttgtggataactgggcggtgggtaaggagaaggttggttattggcagagtaatgacattgttgggttggtgggaaacttggctgtccttggaagcaatggactcgaggaaggttccaagttgagtgtaccaaagtacatggcttacacccagtcagttcgtgaaggaataagcaaacatc

SEQ ID NO: 35736 - DNA, 96 bp, Glycine max
  Peptide Sequence Number=SeqID_127421
atgaaccctaagagaataacggtcattcctgagtggtccactccaccaagagtggggaggaaagaatccatgagtttcaagaacccctggatttga

SEQ ID NO: 35737 - DNA, 272 bp, Glycine max
  Peptide Sequence Number=SeqID_127422
tggtaatcgggatgtttttgttgcacggctccatgcttgcgcatgcaacgtgtgacatgcatcctgttcatggtcaccttagccttcgtggcttagacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 35738 - DNA, 836 bp, Glycine max
  Peptide Sequence Number=SeqID_127423
tcgattgggaccaacatttggcggagatagggggcagcacaatcaattggtttcctcgttggaaggaaggcaaggaaggagttcttttctcgtgtggggactaccctaatgttccattgatagggactagcgggtgtattaattataatcccgtgcttgccataagacagctagggtaccccatgaggggagcgccaacggaagggagtctctcacctttccttgtgaaagatttaggtgcgcaaggtctcaaggttatacaaagaatccacaaggcgtggaggagtccgttgaagaaagacaaggagcttagaggcatccgaaatggcgtcatcggaggttatcatgggatggctaagaattcatgcgcgaggctagggaaggcaagactcgcaaaggagaagttcaaatcagctgcctcacacatccagaaggagtacaccgagttacaagaggaaaacgcggcactgcaaaagcccttgaacaagaaacaaaagggccgcaggaggaatatggcgagaaaaattccgaggagcattgaagagttagttgcttgcgcgaggtccaaaaggagtttggctcaacacttggaagctacggagcaaagcatgttagctatcatagggcaatacaaggaagagttgaaccagtctgtggcccatgaacaaaagctagtggaagattttgcacaagtatacactgaaaaagaagcaagagggagggtgattgatgcattgcatcaagaagcgactatgtggatggatagattcgccttgaccttgaatggaagtcaagacctcccgcgtctattagccaaagagaaagccatggccgaa

SEQ ID NO: 35739 - DNA, 144 bp, Glycine max
  Peptide Sequence Number=SeqID_127424
atgtggaccaccacgggggagaagcttgccgcccagctcgcccaggtgagcaaggttgcttcctccagaagcaacagccttctagaggaatcttctggagggcccaagtgggcctggttgctatttacaccccctgtttactaa

SEQ ID NO: 35740 - DNA, 423 bp, Glycine max
  Peptide Sequence Number=SeqID_127425
atggggtcctttggagaagaaggttggcagtgggaattcttatggagaagaaacctttttgacaatgagctgggaagtgcttcagactttatcgaacaggtcacagctctaagccctaatgcagctttgaaggactattgggtgtggggtgctgatccaaaacgaatttttactacaagcactacatacctttgtattaaaggtcatcaacataatctccatcaaagcccttccccttcaaccagtcccaataaaaatgacatggaggttaaggatgatgattatcaggacttagccaaggaattgggagtttttttcacagatgataaaagtagtggtacaaagttgaagactgatatggacaatactgaaaattctccaaaatcagcaactgtgttgggaaatgaagacaatgcctcatga

SEQ ID NO: 35741 - DNA, 405 bp, Glycine max
  Peptide Sequence Number=SeqID_127426
atggaggccatgaaagagcaaatggccgcaatgatggaggccatgatgagcatgaagaagataatggaagccaatgcggttgcaattgccgctaccagcgttgttgctaaggtgaacctgatgtccccatccggcatcaaccaaatgaatcatccaacctcagatatggtaggcaaagatttaggaagtacggacgatcccatgatgtgcaaattcaaaacgagcatgccttcccgccgtatggtttgcctctcaactatacgccacccaatgtggcgtacactcccaataagaatgtcaataactccactcctatacccattgagagccaacaaccccaaactgatcatgcacatgtctcctaaaccgtgggggagacacatgaaattccccatcacaatctag

SEQ ID NO: 35742 - DNA, 537 bp, Glycine max
  Peptide Sequence Number=SeqID_127427
atgggtgccaagcacctcacaaggaccaaagaaaggtcgcatgtcatcaagcaaaggtccccggacgaaattagggaacaaaaggtgcagaagactatgtcagtctctgcatgctatcaagcgttctgtcttacagatagcaaaagaatgtttatacggataaccactccgggtatttccgcccgtcagcatgactcaaaagtcagtatgacagatcttgtaagtgcggaagatgatgtaaatctctgcgtgtcaacgggcttgtcggccgcgattgacgaagggtgcagaatgaccacattggccgctgcttgtcatcgggcccgccgcctctggatgacaaaaggggtgcggataaccgtaaggtgtctccgcgtgtcatcgggcccgccgcctctggatgacacaagggtgcggataaccgtaaggtgtctccgcgtgtcatcgggcccgccgcctctggatgacaaaagggtgcggataaccgtaaggtgtctccgcgtgtcatcgggcccgccgcctctggatgacacaagg

SEQ ID NO: 35743 - DNA, 936 bp, Glycine max
  Peptide Sequence Number=SeqID_127428
atgggatgttacagcgaatggattaagttcaacgtcaggctttttgtaaggaagcatttggaggagaaggaagaagctttggccaaccaaggagagtgggcagcattcatcgacgtattagttctgctagtgtttgggatggtactattcttgaatgtagacgggttggtggatctagcagcaatcgatgcctttcttgcttatcaccacagcaaggaaagtccagtcatcgctgttttagtggatgcatatgatacattcgacttgagatgcgagaagagcagtgcaagaattatctgttgtacgcctgctctttatgtatggttggtatcccccattgtttatcatgaaggctaccctttgagaggtgcgccgtcgaaggaaataatcgcgcctttcatcgcgcgaggttttaatgaatcgaatgcaaagatacttcagaaaatccataaagcgtggaatagagtggaaagaaaagataaagagcttaggggaagtagcaatggcgtcattgtggagctcgaaaagacaagagtggtgaaggataagctgaaggtggcaatcactagggtcaagaaagaatgtgataagttgaaagatatcaacatgaccatggttgaaatgctggaagacaaacaggcaaaggtgtcagctctgcagattgaaagggaagcgagtgaaggggtgatagagttattgcacagggaagctctgaaatggacggatagattcactctcactctgaatgagagtcaagagcttccaaggttgttagccatagtcaaggaagtggctgacacatactctgctcccaatgaagccaacatggaggccatgaaagaccaaataaccaccatgatggaggccatgatgagtatgagaaaaatgatggaagtcaacgcggctacaactactgccataagtgtcgccactgag

SEQ ID NO: 35744 - DNA, 552 bp, Glycine max
  Peptide Sequence Number=SeqID_127429
atgacttcaaaagaattgaacgaggagccatatgaagtgaaaatctcatgtacgaaacatgtaaagtgtgtggctaaccccaataacgaaagtttcgtaagggaactggagcaggctaccatgagacaaaagattttctttctaaagaaattcgattcggaactacgatatgtccaaggtccaatatggaaagaatttcagaggttttccttgactttgtccgtgtcaacaaacaattcgaaatgcctcgacttttttagaataggtccgagtcaaatagcaatgattcgaagcactttacactattttggaaacccaaggactcaatcgtatggatatgtaaaatacaggatttccaatcctagcaggaaaagggggggaacggatactcaatttcaagtgagtaaacagaattccatactagatatcatagatacatatagaattctgtggaaagccgtattcgatgaaagtcgtatgtacggcttggagggagatctttcatatctttcgagatccaccctacaatatggggccaaaaagccaaaataa

SEQ ID NO: 35745 - DNA, 513 bp, Glycine max
  Peptide Sequence Number=SeqID_127430
atgccgaacagtaatgcggccggttcgaacagtgatcgccgtttcacaagttggccggcgagtgcgctggtcggtttgggcgcaagcgcacaaatctatcttcgatgtagcgcgggcgggcgcagaataagtaagaaggatgttcctgtgttgcgcgccttcagaggcaaaaagctgatagtaatagagcggcgtccgtcgttgacggcggcgtgccacgcgcagcttattgccgccggtgccatcattgccggcccggcaacttctctagaacaagtcttgaacctgttggaagccggcgctgccgacggggcaattattgacgtcgaggttgacgcggagatgatgttacacttgggcttgcttctggaatcaatggcgacgccgttcgtttttgcatctttcacgaaagtgaacccggatggctacgctcttatcggtgacacgaagcatctccgcaagattgcggacgcgctttttgggccgcctggaacatcatccactcttcattga

SEQ ID NO: 35746 - DNA, 288 bp, Glycine max
  Peptide Sequence Number=SeqID_127431
atggctttgtgttcagtttttcttaatcttcatcttctgctttttgtttgtttgaccatagaagcgttaggtgtggcacccccttcagtagctagttaccttacccaggagatactggagcaagaagctgatagagtgcatggattacctgcgcagcctccgatgaagttcaagaatatggtggttatatcactgtcaatgaaactcaaggcacaacactgttctattggtttttcgaggccactcgcaaaccagaacaaaaagccgttctcttatggcccaatggag

SEQ ID NO: 35747 - DNA, 606 bp, Glycine max
  Peptide Sequence Number=SeqID_127432
atggctcagtctaacacttctcgcttaggcttcccagctttaatcacaaccttgtgtagattgaggggagttggatctgatgctcttatctcctatgaaaacctaaggtcggtcattgacttaacttatatcataaggaactgttggaatgcgaatgaccaaacagttaattttccagaggaaaggaagaccaagctcagagcaactgatacttcagatgccaaattgcaaagcttgtttgaaggacagattctcattatgcaaagcttgcaggaactagctcagcaaaggccaattatgagtgaagatcagttcattaagaaggtggcacctcaacagcatgagctagaaccagaaaatgatcactcatctgaagccatcatccctggagttgttgatttttcaaaaataaaattagagacaagatccaatgaggttgctcatcctggaccagtgccagtaccagctgatgtaccatttccagggggccagaccataccaatcctggctctggacacttctcctccgactactccagtattgcatttgacagataaggaggatgttcaggcacaggatatccaagaccagtcacatgaattttga

SEQ ID NO: 35748 - DNA, 443 bp, Glycine max
  Peptide Sequence Number=SeqID_127433
atgggacaaatcaaccggcaagaggttttaccaagtcaaggtaaaagcctagataccaccagcatcaaggaattagggcggtttatggaacctctccaaatgcaagccttccgcaagacttacggaaagatcttagagttgaccatagcagagaaaaccatacctttcctccgggtgtctcccctctttgagcaaaactgcaactgtggtcaaggattcagcaagaggtacctagaagacaaggcgaggggtatggccaatcaaggagattgggtcccgtttatggatgtgttagctttgctaatttttggggtcgtcctctttccaaacgtggatggtttggtggacctagcagcaatcgacactttccttgcataccaccatagcaaggaaagtccggtggtagctgtcttggcagatttatttgacacatttgaccgaag

SEQ ID NO: 35749 - DNA, 394 bp, Glycine max
  Peptide Sequence Number=SeqID_127434
accatgtatgggggctgacgcctgcccagtgccggaaggtcaaggaagttggtgacctgatgacaggggagccgacgaccgaagccccggtgaacggcggccgtaactataacggtcctaagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaagttactctagggataaccaggctgatcttccccaagagctcacatcgacgggaag

SEQ ID NO: 35750 - DNA, 399 bp, Glycine max
  Peptide Sequence Number=SeqID_127435
atggtggcccgagtaatgttggggaatggttatgagcccggaatgggtttaggcaaggacaacgacgacataactagcctgataagcaccaaaggaaatcgtgggaagtttgggttaggctataaacccacacatgcagatataaggaaaagcattgcgggaaggagaagcggaagtcaaggctcgcgattaagacaagaagacgaaggaagcccgccctgccacataagtaggagctttataagcgcgggtctagtggacgaaggccaagtcattgcaatatgcgaagatgctgctccgagtgggtcgaatttggtacaaccatgccctcctgatttccgactaggaaattggctagtggaggagcgcccggacatttacgcgacaagcataatgtaa

SEQ ID NO: 35751 - DNA, 561 bp, Glycine max
  Peptide Sequence Number=SeqID_127436
tcccagcagtttagcgccagaaatgatgccatagtcattagaggagtgcctgaggtagctacaaacccatctgcatcatctgaaactaagaagcttgaaggcaaactggatgcattggttaacttggtaacccagctggccttgaatcagaaatatgtacctgtcgcaagggtttgtggtttgtgctcctctgttgaccaccatacagacctttgcccttccatgcagcaacctagagcaattgagcagcctgaagcttatgctgcaaatatttacaatagacctcctcaacctcagcagcaaaatcaaccacaatggtccagccctcagcaacaacaacagcagcctgctccttccttccaaaatgctgctggcccaagcagaccatacattcctccaccaatccaacaacagcaacaaccccagaaacaaccaacagttgaggcccctccacaacctttccctcgaagaacttgtgaggcaaatgactatgcagacatgcagtttcagcaagagaccagagcctccattcagagcttaaccatcagatgggacaattag

SEQ ID NO: 35752 - DNA, 690 bp, Glycine max
  Peptide Sequence Number=SeqID_127437
atggccggccgcgaggatgccaccttcgatccggcgcgcccggagaccatcaagggccagaaggtcgggatcaccgcgccgggctcctcgtccgacttcttcgtccgtcacttcctcgcccagcacgatattccggccgacagcatctcgttgatcggcgtcggctcgggcgccgcagcggtggccgcgctggagcagggcaagatcgacctgctggtcaactatgatcctgccgccaccctgatcaccgagcgcaaggtcggcaggatcatcctcgacgcgcgcagcgacgacggcgcccgccaggtctatggcggcctgtacccgacctcggtgatgtacgccaaccagagcttccttgacaagcgacccgaagcggccgagaagatcgcccgcgccgagcagatggccttgaagttcatcgccgacaacagtgctgaagacatcgtggcggcgctgccggacagctacgtgtctggcgaccgcgccacctatgcacgcgcagtggagaacgcccgcgcgatcttcacccgggatggtcacttcacgcctgccgatctggaaacaccgctgaaagtgctgcgtgagttcaacacggatgtcgccaaggccgatatcgatctgtcccggacctataccaatgccttcgtcgagcgtgccaacgctgcggcgccggctgcccaaccgtaa

SEQ ID NO: 35753 - DNA, 131 bp, Glycine max
  Peptide Sequence Number=SeqID_127438
atggcagaaccgggaaagaagcgaaagggttcttcgaggcggagtcaacgacattccgagactcaagaaacgcctattccttcctctatttcctcttcatcattgttctcatccgaagaacaccggatatg

SEQ ID NO: 35754 - DNA, 801 bp, Glycine max
  Peptide Sequence Number=SeqID_127439
atggactggtctctgcgcagccggtatatcctgacggatgataacggtgcccgaaacgcagagagtctctatacctatgctgagcatgtctttgttccccagcgcctgaccatgcaggtaggggaagttaacgccatgtccgacgtactcagcggcgtcccaataaccggtgtgcaatttatgccgaccagcggattgcagaaagagagctccggcgtcagcgtatccggtatcgcccggacatcacaggcccgcgtggaggttcggcagaacggacgacttatctttaacactctggttccggccgggccgtttaccctggatgatgtcccgatggtgcgcaataacgtcgatctggacgtcaccgttgtggagtctgacggttcgaccaatcactacattgttcctgccgcatccgtaaaagcgcaaaacctttcacggcccaccggtttgaccgtgtcggcaggtcaggtgagggatatcgacagtcactacagcgatccgctggttttcaacgtctccgatggctggcgaattttcccctggatgaatctgcttgcctccggtgtggtggctgaagagtaccaggctgcaggggcgcgcactgagtttatggtcaccgacagctggagcctatccaccatcatggccgccagcaaggcgcagtttggtgacagtgatagcggcatcaaaaacgagttacagagcgattattcccttaccgagaatgtggggctctcgggcagcgttgcgcactacagcggtgattatcgggagctggcgccacgccatggacgatga

SEQ ID NO: 35755 - DNA, 348 bp, Glycine max
  Peptide Sequence Number=SeqID_127440
atgttggtgcacatgatccgcactcgtctctttgcagcggcacgggtgaaatcttgccccggtatgcatagtagctgtgtgatagcctccctctctggttgtgctcgcacagttggccctcctccaatatcaggggtggcccaggaaccgttaaaaggaaactactggccccttaaccggaagggcaagtctcgcacactgaaaatgaggacacgtagccctctaaaggtgagggcgtgcagccctctcaaggcgaggaggtgtagtcctctggaggtgagggcgtgcagccctctgctggcaaggacgtgtagtcctttcaaggcgaggacgtgtagtcatctcaag

SEQ ID NO: 35756 - DNA, 723 bp, Glycine max
  Peptide Sequence Number=SeqID_127441
atggaacaggctaattacaccgacaaataccttcaagtgttaggggagtctattagtaaagaaaaggtctttactaaaaccaaggaccatgggtcgtcatcatcggccgttcaaatggaaaaacctttgttcaaaccttttaaggttagcgaaaaagctaaacataaatttagggaacttagaaaacaaagattccctactgaggagataggtgatagccatagtgaattattaagtaagattaatagtttacttaaaaccatccctaaaacctctcaaccttcaaaggaatcatccaaaataaggactagacatacctccaaattaattaatgccattaataaggatagtgacaataattcagaacaagtatctgaagaaggttcagtatctgaaaaggtaattaatctgattaacaccaaacattggaaaacacctttcaaactttattaccaaagaccaaccgtccctgatcttctactagaagaaaaaggcaaaagtaactttaaaagttttagagcaaacaacatctatgaatggaatatagatgttcatacaaaatacaacatcatgaataccctccagcatatgatcatggtggccacgacataccaagcgtcccatgaatgtccagaagaaacaattgtatacattcttgtggcaggattttctggccaattaaaaggatggtgggataattatatcactaatgaggaaaagtaa

SEQ ID NO: 35757 - DNA, 422 bp, Glycine max
  Peptide Sequence Number=SeqID_127442
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggccttttcgctattacgccagctgggaaaagggggatgtgctgcaaggcgattaagttgggtaacgccagggttttcccagtcacgacgttggcgaattggagctccaccgcggtggcggccgctctagaactagtggatcccccgggctgcaggaattcgatcctagctcggcctggcgaggagcagcctggggaggaagggagaggcgggagggaaagaaggaagatttgggacgagttgcactgggcacagagactaggaaggggctga

SEQ ID NO: 35758 - DNA, 372 bp, Glycine max
  Peptide Sequence Number=SeqID_127443
atggaactcactcgtgaaagatcaaaatgcttcaagaggttctttcttgatgtggatgtaagaaggaaagtgaatattgagtttgccaacttctcggatggaagaaaaggttttgatgatcttgattctttaaatgatagaggtcaaatggatccaaaagcttggtggctagatcatgacgctaatgctccaatacttcaaaagcaacctacgacttctctcaaggaatactccacaatatcatcaagaggaaacttgtgggatgtagctggaaatgattttgaatcacttgatgattgtggtattcttgaaattgctagtttgtctttagacgaaccagagttagatgatgtctttttcaatgatgattga

SEQ ID NO: 35759 - DNA, 573 bp, Glycine max
  Peptide Sequence Number=SeqID_127444
atgccctccagcttcgcggacttggtattttccagggagagaatcgaagtaggtttgaagagagggaagttcgattacgtctcctccacaagtaccaatgctaggaggatcggagcaactggggaaaaacggaaggaaagagatacccatgccatcactttagcacccgcatgggtcaagccaccacaggcctctcatgctcgcgtcggggactcttccaattcagcacccatacaacctagagcgcccgcacctatccagagggaggccccccaagctccggctccaaccacgactcgcccggccgacaatgcccactttggcaccggttccaacacgatgaggaactttaccgcaaggccaacaccagaattcaccccgatcccaatgacgtacgaagacctcttgccgtccctcatcgccaaccagatggctgtgatatctctcgggaagatctaccaacctcctttcccaaagtggtataaccctaacgcaacctgcgcataccttgggaaaaccccgggcactccaccgaaaaatgcctggcccttaaatacaaggtccaacatttga

SEQ ID NO: 35760 - DNA, 498 bp, Glycine max
  Peptide Sequence Number=SeqID_127445
atggataacaaagaaggaatgcaagaacagatgaaggccgacctatcggccttaaaagatcagatggcttctatcacggaggccatgctaaaacttcaaaaaactatagaagataatgctacggcggccacttccaatacagctagggaagcggaaccggtgctacagcccgcaataaacttgggccgagaccgaaacccgatgggttttaatcagaggtatagtcctcgagcctacccttatggtttgcctccagacttcactccccgtaccgctccagacgatttgagccaagcccctaccttcgaggggcagctccctcctcatgccaactatcctctgcaagaagatgatgaaggggacgcccatttaggccctctacttcccctcaaggaaccagcccctaccttgcataatatgaatatatatagcatgaagtgccttacaaagtgttggatgggaaatggctccaagaaagctttccgcaaagagatctag

SEQ ID NO: 35761 - DNA, 333 bp, Glycine max
  Peptide Sequence Number=SeqID_127446
atggggttcgatttgaattgggaggtcgatctctccccttacatcctggcaactgccatcgaaagcctgcactaccatggagctcgatctcaggtgcgatgcgttaaaaggcaacttatccaaagtagccttaggcatgacattgaaggaagagccattgtcgatgagcactttggccactatgtggtacaaacatttgacagacacatgcaaggctctgttgtgtccctagccctcgacgtgatgctattgactatacccccgaaaccctccacggatatgtcttgtgctacatgggcctcattcaaaatcttgaccaacaacgccctataa

SEQ ID NO: 35762 - DNA, 390 bp, Glycine max
  Peptide Sequence Number=SeqID_127447
catttggggactgcgtcggcgggtcaaggggtgcgaatacgcgaccgctgcgggttatgccgctcagccccgtgatattggttactttggccgacagcgagctgatgtcggtagctcattccttcttatcgctcagaggcgcgtacctccacaaaactgtgtgactatttttgtatggaaacggaataggctttctaggaccttcctcatctgcggattggatgcatacatgttgttcttcatccccctcatcgctgacttcctgtcggccttgggctatcatatgttgcaacaggttgcattagggttataccaccttgagaaaggaggttcgaagatctttccgggagatatcacaaccatctggttggcgatgagggatggcaagag

SEQ ID NO: 35763 - DNA, 573 bp, Glycine max
  Peptide Sequence Number=SeqID_127448
ttgtggtcgaggattcggcaagagagttggatcgtgtaaagcaaactcgaaacggcgtagtgggcctaccgcggaagtacttggaaggcaaggcaagggatatggtgaatcaagaggagtgggtcccgtttgcggacgtatttactttgctctttccaaacgtggacgtggggattacccaaacgttccgttgataggtacgaggggttgtattaactacaatcccacacttgctataagacagttagggtaccccatgaggggagcaccgacggaagagagcctcttgcctttccttgtgagaggtttcggtgcgcaaagtttcaagattgtacaaatagtccataaggcgtgggaaagcccgttaagaaaagataaagaacttaggggcatccgtaatggcatcatcggtggttatcatgaatggctaaaagttcatacacgagggttagattggctctctaagttgaaaattatcaacgaggagaacttcgaagctccagaagaggatgaagaagtccgagctctaaaaacagagctaggaaaggcaagactcgccaaagaaaaattcaa

SEQ ID NO: 35764 - DNA, 788 bp, Glycine max
  Peptide Sequence Number=SeqID_127449
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagcttgggttggagtttgacaactccaaacctgccttcagttacaatggttctggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35765 - DNA, 201 bp, Glycine max
  Peptide Sequence Number=SeqID_127450
atgttcaagatgatcaagattgaatcaagaacacttcaaggttcaagaggaaatttgatttcaagaatcaagaatcaagattcaaggttcaagtttccaagaatcaagattcaaggttcaagattcaagactcaagattcaaaaatcaaaaggagacttaatcaagataagtatgaaaaggttttttcaaaaactgagtag

SEQ ID NO: 35766 - DNA, 234 bp, Glycine max
  Peptide Sequence Number=SeqID_127451
atggtactcacatttggcacccgagtcatgccacttggggtagggtggctagaagaccctttcgggagagaagttatctttcgggagtgggctctgtgcattattatagctcgtgccgggggccgtattgttgactggtcggggcatggctggagctgtgcgttgggccggcgttctctctgccgcgggcggcccttttacttgagtcgggaaggaactcccggctcggattaa

SEQ ID NO: 35767 - DNA, 147 bp, Glycine max
  Peptide Sequence Number=SeqID_127452
atgagactttttcgcaatctcgctcggaagacgctaacatctccgggaaaggtgcagtctcagctggaagacgctgacatctccgggaaaggtgcaggttacgatgttagtcactgcacgctatcgggctttgaggcttacgaatag

SEQ ID NO: 35768 - DNA, 276 bp, Glycine max
  Peptide Sequence Number=SeqID_127453
atggttgctcacatcccagatccaagggttgatccttctcagtatcgtgatttagtacattattggtgttctgagaaaggacagaaaataagcaacatcaacaaaaggagctgctcaaaatatgaggacttgcattgcatgggaaccaataatcttccaagacggattcatgagatgacaacaaaggctaagggagtgcaaccttctagggcagaaatttatattgacactcgaactcgaaaagatggaagcattgttcctgaaaaggctgctatt

SEQ ID NO: 35769 - DNA, 1178 bp, Glycine max
  misc_feature (74)..(74): n is a, c, g, or t
  Peptide Sequence Number=SeqID_127454
atgggacctctccaaaggcaagccttccgcaaagtgtacgggaagattctagatttgaccgcagtggaggtatntacggaagctgtcgtatcccttgcccaatactatgaccagtcgttgaggtgtttcacgtttggggacttccaaatggtacgaactattgaagagtttgaggaaatattaggatgccctcttggggggagaaaaccgtatcttttctccggctttcttccttccttgagcaagattgcagttgtggttggaggttcaacaaaagagttggatcgcatgaagcaaactcggaacggcgtagtgggcctgcctcggaaatacttggaaggcaaggcaagggatatggcaagccaagagaagtggggcccatttgaggatatattagctttgttgatttttggggttgtcctctttccgaacgttgacggtttggtagacttagccgcaattgatgctttcctcgcatatcaccatagcaaggaaagtccagtggtggctatcttggcagatttgtttgacacctttgaccggaggtgtgagaaaaacagtgcacggattgtctgttgtttacccgctctttgtgtgtggtcgatttcacacctattccaacaagacacaagaccacccgtgtccgcttcaaagttatcgctcatgcgccgaaaaaggaagagtcgattgggaccaacatttggcggggatagggggcagcgcaatcaattggtgtgctgggttggaaggaaggcaaggaaggagttcttttctcgtgtggggactaccctaatgtttccattgatagggactagggggtgtattaattataatcccgcactcgccataagacagctagggtaccccatgaggggagcgccaacggaagggagtctctcacctttccttgtgaaagatttaggcacgcaaggtctcaaggttatacaaagaatccacaaggcgtggaggagtccgttgaggaaagacaaggagcttaggggcatccgtaatggcgtcatcggaggttatcatggatggctaagaattcacacacgagggttagattggctctccaagttgaaagttatcgatgaggagaacttcgaagctccggaggaagatgaagaagtccgagctctaaaattggagctagggaaggcaagactcgccaaggagaa

SEQ ID NO: 35770 - DNA, 309 bp, Glycine max
  Peptide Sequence Number=SeqID_127455
atgacagcggaatggagaaggaagaaagatgattggagacgccacttcaaggagaagatgagtcaagaagaagctcaccactatagtgtcgcaacctacccttcggcgggagggcgacgcgagactcacaggtgtgtcttccaagaaaggaaaatgcgcggagtcgccaccaacgtttattcaaggaaaacgtcggaaaaaccggaaaagacgtggtctaggaactttaagtgtgaaaggttcgggagttgtatttacgtacggggaagggtgtttcccttgctcctacgtattcctcaattgtggtaa

SEQ ID NO: 35771 - DNA, 524 bp, Glycine max
  Peptide Sequence Number=SeqID_127456
atggcttctaggaaacccaaaagtattggttcaagacccacaacacaatatgatacaaggagattttcctccttagatgcttggaaccgctctgagggaccttcaccaaaacaatctagagtcagaggccatttagtgaagattgatgctgacagtctcaacatattcttggagacacctgtggtattggcagaaggtgaaactttacccacatactccagatactgcaggttgcccatagattatagagagattgaggctgctttatgcataccaggccaagggtacatcttgaacactgagggccatcctgggaagattctcaggaaggatttgactactctagctcaggtgtggagtgttctctcatactccaacctggcccccacatcacatacctctgatctgatagtggacaaagctaggctgatctttggcctagtctctcgcatggacatgaacataggagcacttatttctggccagatgacttctatagctcagtctaacacttctagacttgg

SEQ ID NO: 35772 - DNA, 387 bp, Glycine max
  Peptide Sequence Number=SeqID_127457
atggcttcgtctggtacaccggcaatcttaacagtgttgcatatttcaatgaatgtttccaagtgtgcatatgggtcttcattagcttgcacttcaggacgtgcaatgctggtgaaaaattgtggtactgaactcctcaaggattcccttgatgatggtaaatcaggtgataataagtcagagaaacgagtctcctcctcaagaatggatgcaactgttctatcttgcagaagtttccttctcctctcggccctgttcctttgcaatgtagcctcaatttctaagtccaaaggaactaaattgcctatgggagatctatgcaacaagaaaagacaaataggaattaagaacaaatattcacaaaagcaatcaaagaataacaaataa

SEQ ID NO: 35773 - DNA, 327 bp, Glycine max
  Peptide Sequence Number=SeqID_127458
atggaaagtaaaagagtagggaagaaggaaacaaacacacaagagtttttatattggttcgacaacaacccgtgcctacatccagtccccaagcgacctgtggtccttgagatttctttcaacctttggatgtaccctccactagaactgatccacaagagatgtaccctttcttgttctcagtcaacaacccaagtagatgtatcctctacttgtaccacaaaggatgtaccctccaatgtgttaagacaaagatctcaggcggttaaacctttgatactttgtgaatggggatacaaaagaattctcaagcggttagtcctttga

SEQ ID NO: 35774 - DNA, 639 bp, Glycine max
  Peptide Sequence Number=SeqID_127459
atgctggaaatttttcaacaacaaaaccaaatgttagttttggaattgtacatagaaaaggatgtggctggtggttctatgtttcattttgcaaattctcttacatcatgtggaaataatttatctaataatgaggcgcaactgccaagaaatgtgagcaacttacatggtgatgaagattatgatgatgatgatgatgatgatgattatcttgtgtctaactcatacgttgaagagtctttaaacgaagatgatagtgttgacggtatatctgatacagacgatgaagtcaccgacatgattcaaccagtaataattgttcacccagcagaaggtgtacaaggaattcaaaatccattttgtaatgatgctttgcattataacaatatcaactggagtcatcctgatgaggaagacatttgtggtttggagatgccatcgagttttaatgttggccaagaattatatgttgacatggattttgatagtaaagatgcggtcaaaaatgcagtcaaactatatgttatgaaggtgcatcaaagtttcaaagttgttgaaagcaaattgaacaagtatgtcgtttgttgcttgaataaaagtacagagtgtccttgccttttctatatgagggcaatttaa

SEQ ID NO: 35775 - DNA, 252 bp, Glycine max
  Peptide Sequence Number=SeqID_127460
atgccgcaacacaattcgtctcatacccactacatgcaagtaaaaggggtaactcaaggcttttcatccctggtaatcgattaccagaggccaaactcgaatcacacagcttcaggacatgaaaagctgaaaaaggcactactggtaatcgattaccagaggcctccacaacctgctgccttcatttctaagcctggtaatcgattagacccccttggtaatcgattaccaaaagccctcatagcttcctga

SEQ ID NO: 35776 - DNA, 453 bp, Glycine max
  Peptide Sequence Number=SeqID_127461
atgaccattcgaggccttgggctcaatggccccgatgacatctattccccacatggagaaaggccaaggggcggacatgacattcagaggatgtggtggagcattgacattatctgcgaacgcttggcatttgatcttcctggccatagcatgcccgttggcgtgcgttccaaacgagccctcatggacttcctcgatcatgtgatttgcctccctggcatccacacaccgcaggagtgtcatgtcgtgatttctcttatacagtatgcttctgctcatgaagaaaccggctgccaaccttctcaatgtcctcttatcattgtcggcaatctctggcgggtattctttgcttacgacatatcacttgatgtcgaaataccaaggctttctgtcccgttcctcttctacttggcaacaatgcgtggtttgccacgacaccaaaattcaatgtag

SEQ ID NO: 35777 - DNA, 285 bp, Glycine max
  Peptide Sequence Number=SeqID_127462
atgtcgtccagcttcgcagacctagtattcgtcggggaaagaatcgaagtaggggttgaaaagaggggaagttcgattacgtttcctccacaagtgccaatgctaaaagaatcagagcaactggggcaaaaaggaaggaggggagatgcccacgctgtcacttcggcgcccgcatgggtcaaacccccgcagacatctcatgggtacacatcagtacgcgcaacatcatcagagcttctcagctcacgccgggaactcctccagttcagcacccgtacagcctag

SEQ ID NO: 35778 - DNA, 468 bp, Glycine max
  Peptide Sequence Number=SeqID_127463
atgggtgaccaagaggagacacaggaacagatgaaagccgacatgtcggctttgaaagagcaaatggcttctatgatggaggccatgctaggaatgaggcaactcatggagaaaaacgtggccaccgttgccactgttagttcggctactgaagcagacccaactctcctagctatcgtgcaccatcctcccccaaatgcggtaggacgaggaaggagcacactggggcacaacaacaacccccatttgggatacaatcaagtggcttacccttatggattgccacctaattacacgccgccagtcatgcaagatgatgcgggtcgtgtctcttcccccatccttgaaggggagccttctcaacagcccgatgaggtccacaaagatcatcatgagtatgcccaaggggatgtcgagttctaccccccgatccccgtcgaggggccggcacccaacactgtgccttag

SEQ ID NO: 35779 - DNA, 552 bp, Glycine max
  Peptide Sequence Number=SeqID_127464
atgttcgaccgaagatgcgaaaagagcagcacaagaattgtttgttgtacaccagctctctatgtatggctcgtcttgcacctttttctccaaaaaagtaggcctacttgtccattacaaggtcaccgcttatgcgctaaaaagggaaaggcaaattgggagcaactcttggctagtgtggcaggggcatccatcaattggttcccctattggaaggaaggaagagctggagttttgttctcatgcgagggatttccaaatgttcccttaatgggaacaaggggttgtattaattataatcccgccctcgccttaagacagcttggctaccccatgaggggagcgccattagagggaagcatcacacatttcatcgcatggggttttagtgaccccaatgtgagggtacttcgaggagtctgcaaggcatgggatgcggtgcaagggaaggataaagagcttaggggaagccgtaatgaggtcatcggcagctatcataagtggctgaaagtccagacacaagagttggatttgctcccaaagccaaagtga

SEQ ID NO: 35780 - DNA, 495 bp, Glycine max
  Peptide Sequence Number=SeqID_127465
atgggcgtggctgtcgaccagcacgacgtcatggccctggcgcgccaggaagtacgcggaggcccagcacccataacccgccctcatggtccggcgtcatggccccgaccctcgggggctggcgtcacggccgggctacgccggccggcgccgcagtcggcgcggccatcaggcggcgcggtgcagcttgatgatggcggcggcggtcggatcgcgcaccaggtcggccagggaatagccgttgagcgcctcgtagaacgcctgcagggtctgcgccagcacccccgacaggcggcaggcgccgtccagcgcacagggcggttcgcggcagtcgatcagcggcccctgctgctccagttcacgcaccaggtcgcccaggcggtaatcagcggccgggcgcgccagcgccagcccgccgcccttgccgcgcgccgtgctgacccagccgcgctgcgacatgaagtgcaccaccttgaccaggtggttgcgcgacag

SEQ ID NO: 35781 - DNA, 51 bp, Glycine max
  Peptide Sequence Number=SeqID_127466
atgggggtggtcttcatcattggaagtgcggtagacaggctttgtggttga

SEQ ID NO: 35782 - DNA, 499 bp, Glycine max
  Peptide Sequence Number=SeqID_127467
gaagatcttgcctgagagaaatgtcatgatttaccacacaaaatttgatgagttcaaggcagacctagaaagaaggaactggcacaaggaattgacaaactttctagatgggagcatcgatgtggcaatagtgaaggagttctacgctaacctttatgatcctgagggtaaatcacccaagcaggtgagggtgagaggccacctaattaagtttgatgaagatgccctcaacaccttcttgaagacaccagtgattatcgaggagggggaagacctcccagcttactccagattctgtcgtttgaggccagatccacaggaactggcaaaccgactattcatccctaggaggggatttgagcttaatgctgatgggctgccattgaagatcttacggaagaatctgaccacgctcgctcagacatggagtgttttatcattctccaacctggcccctacttctcacacgctggcatcacactggacagggccaggttga

SEQ ID NO: 35783 - DNA, 216 bp, Glycine max
  Peptide Sequence Number=SeqID_127468
atggttcgaactgggaaagcggcagcctgtagcggcaagcaattaagcggcggtgtgagttacgctcagctcttggcaccccaggctacacttgcctatgttccggctcctgaacaggaaacagctatgaccagatacgccagagctcaaaaaccctcatacactaaagggaatcaaaagttggccccccctgaggtcgacggtttgcttgcctaa

SEQ ID NO: 35784 - DNA, 280 bp, Glycine max
  Peptide Sequence Number=SeqID_127469
aagttgtcatcgtcaaaaagggggagattgtagaagcaagcttcatgatgaatcaagattgattcaaaggagttttgatgataacaaaggtgatgacaaaaagctcaaagaatcaaagaatgagttcaagattgaatcaagaacacttcaaggttcaaaaggaaatttgatttcaagaatcaagaatcaagtttcaagattcaagttccaagaatcaagatcaagattcaagactcaagattcaagaatcaagagaagactcaatcaagataagtattaa

SEQ ID NO: 35785 - DNA, 669 bp, Glycine max
  Peptide Sequence Number=SeqID_127470
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacaaactttagtaatcaactgcatggatactgccgaagagattgttactcctggtgctgccgctagtgcattcaaaaacccttccatgcttgctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 35786 - DNA, 294 bp, Glycine max
  Peptide Sequence Number=SeqID_127471
atgtcaggatttacacgcaattctcctcaaatttcagccagcccgtatcaattagacttcacactttatgcttcggggtcatacaatgctcaatggaatgccccggggctcctccatgataagcacacgttgcgttcgagtcgtatcctcagaaaaatggaggttgaggaaccttggttggggttatggctaccattgaattatcaagtagatatgggagcaagtcagcatatgacaacggaatttggggtggtcttcgtcattggaagtgcggtagacagactttgtggttga

SEQ ID NO: 35787 - DNA, 797 bp, Glycine max
  Peptide Sequence Number=SeqID_127472
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaaatctaggatacgaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35788 - DNA, 69 bp, Glycine max
  Peptide Sequence Number=SeqID_127473
atgaacggaaaactgccaggaagctacattataaacagaacctcgaagagagttaagcttcgtccttag

SEQ ID NO: 35789 - DNA, 577 bp, Glycine max
  Peptide Sequence Number=SeqID_127474
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 35790 - DNA, 789 bp, Glycine max
  Peptide Sequence Number=SeqID_127475
atggctacctcaccaaaagaaacctcagctcctggttcaccctctgtaccatcatctccatcatccaccaaagcaccatcaaaccaggaacgacctgaattcaatatccaacccatacaaatgattcctggttcagcccctgttactgagaaactggtccccaaaagacaacagggaatgaagacttctgaaaaccctagccttgcaacaagtcctagggaagtagacacgaagatggataagaagatccgcagtattgtgagtaacattctgaaaaatgcttctgtgcctgatgctgatgaagatgttccaacatcttccaccccgaatgtttctgtccctgaggttgataaagatgttccaacatcttccaccccgaatgtttctgtccctgatgctgacaaagatgttccaacatcttccactccaaatgctgaagccctcccttcacccagtgaagaggaatcaacagaagaagaggatcaagcctcagagaagacccctgcaccacgggcaccagaacctgctccaggtaacctcattgacctagaagaagtggaatctgatgaggaacccattgccaacaagttggcacctggcattgcagaaaggttacaaagcagaaagggaaaaacccccattactaggtctggacgaatcaaaactatggcacagaagaagagcacacctatcactcctaccacatccagatggagcaaagttgcaattccttccaagaagaggaaagaaatttcctcatctgattctgattatgatgtcgaactagat

SEQ ID NO: 35791 - DNA, 318 bp, Glycine max
  Peptide Sequence Number=SeqID_127476
atgccaaggagatgtgggatactctccaacttacacatgaaggcaccactgatgaagtttcaaaaatttgtcaagaaaagaagaatcgagagaagtcagaacttcaacaatggaagaagatctcaagaagattctcaagttcttagattctacaaatgcaaccaacttggtcacatcaaagcaaattgtccttcaaatgaagaatggcctgagaaaagcgataagaaaaggtatgatgaaagaaggaccaagaagcgtgcattgcatgggatgacaatgactcattcgacggttccgagaaggagatcaaccttctaa

SEQ ID NO: 35792 - DNA, 636 bp, Glycine max
  Peptide Sequence Number=SeqID_127477
atgaaagataagagggatgaggaagaaaaactagaaaaacaaaagaaaaagaaggatagtaaggccttgtgttcaaaggccaaggggaaggaaaaggaggaaaaggattcctccaagaagattgttaacaaggaaaatcattttgcaacaaaatgtgatattaaaatagtactccttcttaaacaatctttcgaccttctcctatcaagggaaacatcccttagcaccgccatacctcttgagcttgaggttattcctcaagtaaaggagttgttggatgagggtttggttcgcaagagcttaaatcctcgtgctttattggtgcctaaaataggtattattaggcaccaaatccctatgataggtggtataatgaatgcgttgagtggtgcaacactcttttgtaaaatcactcatgcacccaacatcttcaagatttgtgtacatagggactcattaggtagtgatcaaggccttcccatggaccctaagagaataaaggccattcctaagtggcctactccaccaagtgttgaggaaagaatccatgagtttcaagaacctctggatttgaggtcaaatccttttcaagggggagggaatgatgcaatcctaccccccaagggcattggatag

SEQ ID NO: 35793 - DNA, 753 bp, Glycine max
  Peptide Sequence Number=SeqID_127478
atggcgaatcaagaggagtgggtctcgtttgcggatatactagctttgctaatctttggggttgtcctctttccaaacgtggacagtttggtggacctagccgcaattgatgctttccttgcatatcaccatagcaaggagagcccgatggtagctatcttggcggacttatttgatacatttgaccaaaggtgcgagatgaacagtgcacagattgtctgttgcttacccgctctttgtgtgcggttgggacgagggggttgtattaactataatcccgcacttgccataagacagctagggtatcccatgaggggagcaccaaccgaagagagtctctcgcctttccttgtgagagattttggcacgcaaagtctcaagattatacaaagagtccacaaggcatggagaagttcattgaggaaagacaaagagcttaggggcatccgtaatggtgtcatcggtggttatcatggatggctaagagttcatacgcgagggttagattggctctccaagttgaaagctatcaatgaggagaaattcgaagcttcggaggaagatgaagaagtccaagctctaaaattagagctagggaggacaagactcgccaaagaaaagttcaagtcagccgctacaaacatccgaaaagagtgcaccgagttacaagaggaaaatgcagccactgcaagagcccttgaacaagaaaccaaaagggcccgcaaggaggaacatgaccgagataaattctga

SEQ ID NO: 35794 - DNA, 126 bp, Glycine max
  Peptide Sequence Number=SeqID_127479
atggcaatgcatccgaagaagcttcttgctaaaagggctaggaaggtcaccgcaggggagggattcagtgcagttccgcaagcggagattgagtttgatggacaccgtttccgaagtgaggagtga

SEQ ID NO: 35795 - DNA, 360 bp, Glycine max
  Peptide Sequence Number=SeqID_127480
atgtgtcaacgggctcgttggccgcgattgacaaagggtgtagaagacgacgttagtctctgcatgctatcgtgctttgagtcatacggatatcaaaagaatgtttatacggataaccacttgggtatttccgcctgccccctaacttcacggtctcggccagaagacattgacatctccgggaagggtgcaggtgacgacagagtaaatgagtgtgtgcgggttactgtcgggtgtctctacatgccaccagactcttgggtcacggtaacaaaaggtggggtggtcgacaaaagcagggcttttgctcctacgtatcctcaatttgtgatgaggaactcagacctacgtagttcttga

SEQ ID NO: 35796 - DNA, 147 bp, Glycine max
  Peptide Sequence Number=SeqID_127481
atggagaggtgcgctttacgactccgaaaatggcttcctttcgcgatttggagcaaaaatggtgtgcaaaggttggagctttgttggagcttcaatggtgaggaagaagaaaggaaaaaacaacgtatgccacatgtctccttttga

SEQ ID NO: 35797 - DNA, 504 bp, Glycine max
  Peptide Sequence Number=SeqID_127482
atggcaagagtatcgaaagtagtcaaaatctcattgcaagaattggaccgagtgaagcaaaacagaaatggggtggttgggataccaaggaagcgcttggaggagaaggcaaaagctttggcggatcaaggagaatggacttcattcgttgatgttttagcactgatagtatttgggatcatcctctttccgaatgtggatgggctagtggatttagcgttgatcaacgcttttcttgcttatcaccacaacaaggaaagcccaatcgttgctgttttggctaatgcctatgacattttcaacctaagatgcgaaaagagcagtgctagaatcgtctgttgtacacccgctctttatgtatggctggtctcccacatttttcatcataaaagtagacccgtctgtcccctacaaggtcatcgcatgtgtgtcgagaaagggaaagcaaagtgggaggaactcttggcacgcatggtaggggcgtccgttaattggttcccctga

SEQ ID NO: 35798 - DNA, 132 bp, Glycine max
  Peptide Sequence Number=SeqID_127483
atggctacaccaatgagcactgcttgctatttagataaagatgaaaccggtcagtcaatagatgttaagcaatatcgagatttcaatcaaatcccaaacaatcacatcttagtgccattaaaagaatcataa

SEQ ID NO: 35799 - DNA, 285 bp, Glycine max
  Peptide Sequence Number=SeqID_127484
atggttgaggactcatctattgaatctttcatcaagctcacatttgcaacttcttcttcactagaagagctggaggatgtggatgcattgtcttcccaggctatcaagttgttttctaaggtagataggacattcatatttgatgtgaccttgcttcccacatgcgaagcatgtgaaggtttagagaattttctatatttagatcttttgagaaattttcaaaacttcttcaccatcgagcttaaattctcttcatcttcgtcatcactagagctttctttgtaa

SEQ ID NO: 35800 - DNA, 429 bp, Glycine max
  Peptide Sequence Number=SeqID_127485
atggagaatggttatgactttttgagagaaggcatgcactatatagttctgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35801 - DNA, 405 bp, Glycine max
  Peptide Sequence Number=SeqID_127486
atgacagattgcggggtacctgactctattacaggagacgtccccacgtgcttcccggtgctgacgtcgaaggtgcatatgaagggaatcacaggagcactatacagggcacgttgtgatgctttgaccgtcacagatgtgtcctggttgccttacactgagcatcggggggttagggcctttgagctgatttcatcattccaggatgacaggtggatgcatttcgtggacaacgtacttgctgtggatgagctttgtctagtgcctgggcaggtatctgcggattacatggagtggtttttctggatatctcacccattcatgataccgacccaggcaggtgaccagcctagagatgcacctgccgcagaccctgaggagtacatgcagccgcccagcccctag

SEQ ID NO: 35802 - DNA, 237 bp, Glycine max
  Peptide Sequence Number=SeqID_127487
atggcttcttcttccttccccctcggaggtgtatatctctatgggactgcgtggctattttggtacgggaaaggaacaggtttagctgccaaggggtgtccgggcttttgcgaagctgtgcccttggtgaagtatatcaccaagggtttgggcttcgcaacagtgctcccatccgtggattgcatgcatatgtgctactcctctcttccttcactgccaacttctagtcgaccttga

SEQ ID NO: 35803 - DNA, 690 bp, Glycine max
  Peptide Sequence Number=SeqID_127488
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctgggttctatccctccacgacaagagttgccaatgtagtgaaaatctcagcacaagaggtgaaccaggaaagcccggtcgtcgccattttggccatgtatgacacgttcgaccggggatgtgaaaagagtggcgcaagaattgtttgttatgcactggctctctatgtgtggctggtttcacacctttttctccaagaaggtaggcccgtctatccgctacaaggtcaccgctcgtgcatcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 35804 - DNA, 420 bp, Glycine max
  Peptide Sequence Number=SeqID_127489
atgttttccaagaaggagggaatgatgagaatcatgaaactggccaaatacaggctaaaggcccaagtggagaaggacgaagcccccgagtggagaaggatgaaggcccaagtggagaaggatgaaggcccagaggcagagacactatcaagactattaattgttgctgaaggcccaaacttatcttcctttaccggaagtggcgtctaccccgacttatcttccttcaccggaagtggcgtctaccctgacttatcttccttaaccggaagtggcgtctaccctgacttatctcccttcaccggaagtggcgtcatccaaatcttcgtagcctgtatcaaacgatccgctcctactcaggttcacatcagtcggcctgcaagcgttttaaaaaaaattgcgcaatgtcggctgaaatag

SEQ ID NO: 35805 - DNA, 1113 bp, Glycine max
  Peptide Sequence Number=SeqID_127490
atggccaatcaaggagactgggtcccgtttatggatgtgttagctttgctaatttttggggtcgtcctctttccaaacgtggatggtttgatagacctagcagcaatcgacgctttccttgcctaccaccatagtaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaggtagaacaatcagttggttccccctatggaaggaaggaaaagaaggagtccttttctcatgtggaaggtacccaaacattccgctggtaggaacgaggggttgtattaattacaatcccacgctcgctataagacaactagggtaccccatgagggagcaccgacggaagaaagcatgtctctttctttatcaagagcttagaggcattcgtaatggtatcattggtgggtaccacgaatggctaaaagttcatatacgaggtttagattggctcgccaagttaaaagtcgtcagcgaagaggattttgaagcaccggaagaggacgaagaagtccaatctctcaaaagcgagttaggaaaggcaaaacttgccaaggagaagatcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcggagggaagaaagagaccagtcgcgagcacatagcatggttctgaaagaggagttaattgcttgttcaaggtccaaaagaagcttgtctcagcgtttatgcgagacggagaccaacatgctagctatcatcgccaagtaccaagaagagttaggtctagccacggcccacgagcatagaatcgtggatgagtatgctcaa

SEQ ID NO: 35806 - DNA, 579 bp, Glycine max
  Peptide Sequence Number=SeqID_127491
atggacatgaatttggggtacctcatctcccaccagatctctttgattgcacaacatgatacatccagacttggattccctgccttgatcacaactctatgcaaggccagaggagtccagtcagattctagatccttggagaacttgagccctgccattaacttggcatatattaagaagaactgttggaatcttgatgatccaatagtgacatttagagggccaaggaaggctaggggtaagaggtcagaggccctcactacttcagcaccaccagagacaccagctccttcttcttccatagctccattacctcccactcagactccaattattcctcctacatctacacaaataccatttccaattcctatatctgaaggaccatcagattttatatttacaccaaagatcatggatgagttttatgcgcaggtggcttggctaggagcccagccttctccttctggagggggtggggcctccgcagcccaggagcctgttcctgaggagccagtagcagcagcagagggggaagatgagctcacccctcaagaggaggagacttctatagactag

SEQ ID NO: 35807 - DNA, 299 bp, Glycine max
  Peptide Sequence Number=SeqID_127492
gtgacatcaaggtggctcacaaaacactcaagtcccaaaactcacaaaataactcttcaatcccggacttggttcagaactcgtgcaaccttcatgtttatatagcagtgtgcgtatctgggctgcaacaacttgcgttggatgagatctatcattctcctgaaaaatctgcacttaaagatctaaaagatcaagatgtcctggacattgtatccgacatcgtggatcctgcagcttcaattcttcatttgacattttatcttgccttgtgcattgtgcagcccgatctgattccttga

SEQ ID NO: 35808 - DNA, 138 bp, Glycine max
  Peptide Sequence Number=SeqID_127493
atgtcgttctccaaaggaaatgataaaatggctccgaagaaactctccatgaagaggtttagaagggacgccactggagaaggctccattgccgcctcaaagtttgatagtcaccgtttccgaagtgtcgagcactag

SEQ ID NO: 35809 - DNA, 465 bp, Glycine max
  Peptide Sequence Number=SeqID_127494
atgacttcaaaagaattgaacgaggagccatatgaagtgaaaatctcatgtacgtttcgtaagggaactggagcaggctaccatgagacaaaagattttctttctaaagaaattcgattcggaactacgatatgtccaaggatttccaatcctagcaggaaaagggggggaacggatactcaatttcaagtgagtaaacagaattccatactagatatcatagatacatatagaattctgtggaaagccgtattcgatgaaagtcggatgtacggcttggagggagatctttcatatctttcgagatccaccctacaatatgggggccaaaaagccaaaataaatgattttagcccttataaaagttataaaaaaacggattcctcctttcacgctcatgtcaggggggagggactggagaagaaaaaaccgcaaaatccgatccaatttatcgtaatcgattag

SEQ ID NO: 35810 - DNA, 405 bp, Glycine max
  Peptide Sequence Number=SeqID_127495
atggcacgcagagacaaattatggtcattctgcacccttttgtcatccagaggcggcggacccgatgacatgcggagacaaattatggtcattccgcacacccttttgccattcagacaacagtcgtgtccgatggcacgtgcagagacaaattatggtcaagatctctacacccttttgatcatccagaggcggcgggatacccgagtgcggaaaaattatccgtataaacattccgcaccccttttgcattctaagacactaatcgctgatggcaggcagagacgacaattcgtcttctgcacccttttgttcgccccgggaacaacgagtcatttgacatgcggaaattttatggtcattccgtaccccgcgactctcgtcaaccgagaggaacgaaattag

SEQ ID NO: 35811 - DNA, 348 bp, Glycine max
  Peptide Sequence Number=SeqID_127496
atggatcattttaaggtgctaataccttcctcaagcgtaaatacaactcccgaacttagaattttcattttgaccggtttccttcggtttttccgacgttttccacaaataaacgttggtggcgactccgcgcatctttcctcctttggaaagcgcacccgtgagcctcgcctcgctcgcccgcgaaagggcacgctgcgacagtattctgaaaaaggacggaaaataagcaacattaacgaaaggaatcactcaaaatgtgaggacttgcatcgcatgggaaccaaggatcttccaagacggattcatgagatgacaacaaaggctaagggagtgcaaccgtcttaa
